United States Patent 8,344,211 (PLANT NUCLEOTIDE SEQUENCES AND CORRESPONDING POLYPEPTIDES) - sequence listing, part 18

SEQ ID NO: 68945 - DNA, 631 bp, Zea mays
  misc_feature: Ceres CLONE 1546014
  misc_feature: Encodes the peptide sequence at SEQ ID NO. 68946
  misc_feature (238)..(238): n is a, c, t, g, unknown, or other
  misc_feature (253)..(253): n is a, c, t, g, unknown, or other
  misc_feature (269)..(269): n is a, c, t, g, unknown, or other
  misc_feature (276)..(276): n is a, c, t, g, unknown, or other
  misc_feature (365)..(365): n is a, c, t, g, unknown, or other
  misc_feature (368)..(368): n is a, c, t, g, unknown, or other
  misc_feature (631)..(631): n is a, c, t, g, unknown, or other
cgtcgtggcagccttctctattatagtggatcccccgggctgcaggaattcgtctcacccctagaaaaacccccacactttttcctggcaaaccctgcacgcctccgcaaccgcgtcgtcggcgtgcgcgatcccgagaggcccagccatcagcttccttggcggggtgtgtatgcgcgtacgtcggccgtgaccagatcggctgagccaaggccatggcggaaccgggcctcctcgngccggaccccttcgnggacctccccttcccngaatttnaggtgtccatctactgctacagtttcccgctcgaggacttggatctggaggatctggacctggacatggacttcgacctcttcctcttnggntgggaagggcaaccctcgcaaccgtccccgctcgcgacctcgtcctcctcggccgggtctccggttggaggctcgtcctcttccggtgccgtcggggacggcagagggctgacgaatgaggagtcttcggagtcgtcttcgaggagcgcgagcggcacggatggcagccgcaaggcggatgggggaggtaggacaaaacgaagcggcgcgcgcgggcaggtactcaaccctctagagcgcgcaccttgtcgcggcctgatgan

SEQ ID NO: 68946 - protein, 138 aa, Zea mays
  misc_feature: Ceres CLONE 1546014
  misc_feature (8)..(8): Xaa is any aa, unknown, or other
  misc_feature (13)..(13): Xaa is any aa, unknown, or other
  misc_feature (21)..(21): Xaa is any aa, unknown, or other
  misc_feature (50)..(50): Xaa is any aa, unknown, or other
MAEPGLLXPDPFXDLPFPEFXVSIYCYSFPLEDLDLEDLDLDMDFDLFLXGWEGQPSQPSPLATSSSSAGSPVGGSSSSGAVGDGRGLTNEESSESSSRSASGTDGSRKADGGGRTKRSGARGQVLNPLERAPCRGLM

SEQ ID NO: 68947 - DNA, 620 bp, Zea mays
  misc_feature: Ceres CLONE 1546015
ctccccgcggtggcggccgctctagaactagtggatcccccgggctgcaggaattcgtctcacccctagaaaaaatccctgtctggtgctgggtggaccggggacatcgtcggcgagcttctcctgtaccgaccaccgtctcacatggtactcagcgcccagcccttgctccatctccatggcatggactgctccatacaggccacgctcggcctccaccttcggcgcccaacgagcaggcgttagggccgcgcagcaccttcctctagcgtgctcggctccagccatggcgtgtggacgctcaagttcggccctcctctggcctctactcccatggtacaagcccctcttccatggtgccccccatcatcgcgttctcattccctgtgagggcagggagaaatcgggtgtgtactcgtggctagcatgtgggtcgggccaccagttccgaccgaattgtgcgccggcgtgctgaggccgccgtggtaccgtgcgttgccgtggcacgcttccggcaccatcttgaagcacgcagtgaggacacgtgtcatctgaagagcaagttggtacctggaatctcaagtcccaggtcaagaacaggtaccacaggatgaggcgct

SEQ ID NO: 68948 - DNA, 642 bp, Zea mays
  misc_feature: Ceres CLONE 1546016
  misc_feature: Encodes the peptide sequence at SEQ ID NO. 68949
  misc_feature (382)..(382): n is a, c, t, g, unknown, or other
  misc_feature (634)..(634): n is a, c, t, g, unknown, or other
ccccgcggtggcggccgctctagaactagtggatcccccgggctgcaggaattcgtctcacccctagaaaaacgcgctgcttcgttggctttcggctacgccctttacacatctgaatctcacctaaccgcccagccccgcgtcccccacctcatggcgccggctatggggctgaagcggcctgcggcgggagcaggggcggcagcagcacaaaccatcacgatgtccacgactgccttgcgggacgcggtgcgcaccaccctacgggaggccgaggccacggcgaaagctaccgccccgtgcccgccaggatcccggctacggcgactgcgccgacgaagatcactagggatggggtgctgtcgcctggagagaggtcganccgtagcggtggacctatgtggtctacaccaccagcgccacggtcaaggccaaggggagggcgctcatcggcggagcattcaagagcagtccgcgtcagtcgccgatgccgcctgtcgaggaatcatgtcctttataacatcatatgttgtgcccgacggcttgacacatagtgtcacacctgcatatattacatacatgtcatgcagatgattgaaacatttctttggtggagccaatgcgtgtgtctacnactaggac

SEQ ID NO: 68949 - protein, 146 aa, Zea mays
  misc_feature: Ceres CLONE 1546016
  misc_feature (77)..(77): Xaa is any aa, unknown, or other
MAPAMGLKRPAAGAGAAAAQTITMSTTALRDAVRTTLREAEATAKATAPCPPGSRLRRLRRRRSLGMGCCRLERGRXVAVDLCGLHHQRHGQGQGEGAHRRSIQEQSASVADAACRGIMSFITSYVVPDGLTHSVTPAYITYMSCR

SEQ ID NO: 68950 - DNA, 632 bp, Zea mays
  misc_feature: Ceres CLONE 1546017
  misc_feature: Encodes the peptide sequence at SEQ ID NO. 68951
agctccccgcggtggcggccgctctagaactagtggatcccccgggctgcaggaattcgtctcacccctagaaaaatctagacacaccaaagagatcaaatcccctccaattccacataaggctttaagtgattagcgagagagatttgccgtattcttttgagctcttgcgcttggattgcttctttttctttctcacttgttcttgtgatcatcactcaattgtaatcaaggcaagaggcaccaattgtgtggtggcccttgcggggaagttttgtttcccggctttgatttgagaagagaagctcattcggtcggagggaccgtttgagagagggaagggttgaaagagacccagcctttgtggcctcctcaacggggagtaggtttgcgagaaccgaacctcggtaaaacaaatccgtgtgtcacactcttcatttgcttgcgatttgttttgcgccctctctcgcagactcgtttatattttaacgctaacccggcttgtagttgtgttcatatttgtaaaatttcagtttcgccctattcacccccccccccccctctaggcgactatcagctgcagtagacagtctccgtcagagtgccatggaggaaggcattcttgacattga

SEQ ID NO: 68951 - protein, 44 aa, Zea mays
  misc_feature: Ceres CLONE 1546017
APRGGGRSRTSGSPGLQEFVSPLEKSRHTKEIKSPPIPHKALSD

SEQ ID NO: 68952 - DNA, 644 bp, Zea mays
  misc_feature: Ceres CLONE 1546024
  misc_feature (465)..(465): n is a, c, t, g, unknown, or other
  misc_feature (590)..(590): n is a, c, t, g, unknown, or other
tccccgcggtggcggccgctctagaactagtggatcccccgggctgcaggaattcgtctcacccctagaaaattagtaatgttattatcaaagcagtcgttgatccttaccttttgtatcctccctaacatgatagcgttgctgttttgatgctgttacttggttttcatgccaacatggcttcaatactatcgttgtttttgagcactttgagaattgtagcccccggcatgcctctccaaagacggtgcatggagattcaaaccggtatcttgcttgctgccaaaagcaaccagatttgtgaactcgtcatgtgtgaattgtgatgttgtattgctctctagtttaccaattttacctcccacacaagaggggagggggggaaaaccaacccaattttaccaaaacctagtattgctcaccttttgtcaccccccctcctaaatcgtgttcccccgcgttganctttttagaaaccccacctggccggctttggaaaatccttcaatatggaatattccatttgggggaaccttttttttcccaacaaaaaacaaaaaaaccaacccctcgctttggggaacccccantgtcccgccccataaacggagtttccttaataacgcgccgctatacccggggcg

SEQ ID NO: 68953 - DNA, 666 bp, Zea mays
  misc_feature: Ceres CLONE 1546027
  misc_feature: SWISSPROT Homolog: EC 3.2.1.23 Beta-galactosidase
  misc_feature (266)..(266): n is a, c, t, g, unknown, or other
ggagctccccgcggtggcggccgctctagaactagtggatcccccgggctgcaggaattcgtctcacccctagaaaagaaaaattgaaccgtgtttgtttacgaactgtatttttgtttggttgttgaaccgtgtttgtttaccgaacatattggccttatgttatgttttaccatgttgtcgatgacacaatactatatgacgatagcaactatgctattgtagttttggtcattgttcacctgatatgtgccatatttcggtancatttcgttagtgggcatcccgaactgtttcctttctactcattccatttttaattattgaacttttatttagcaatatcttgacttctttgagagaaaaaaaaaaaaaaagacgagacgctcgaggtacccaattcgccctatagtgagtcgtattacgcgcgctcactggccgtcttttttacacgtcgtgactgggaaaaccctggcgttacccaacttaatcgctttgcagcacatcccccttttcgccagctggcgtaataacgaaagaggcccgcaccgatcgccctttcccaacagttgcgcagccttgattgggaaatggaaattgtaagctttaatattttggttaaaaatccccgttaaaatttttgttaaaatcacctcatttttttta

SEQ ID NO: 68954 - DNA, 629 bp, Zea mays
  misc_feature: Ceres CLONE 1546033
  misc_feature: Encodes the peptide sequence at SEQ ID NO. 68955
tccccgcggtggcggccgctctagaactagtggatcccccgggctgcaggaattcgtctcacccctagaaaaatagaaaaaagttggattcgacagaggccgtgctgtacatatagtacaaatacacacacacgcccgcctctgaagcaatgcaatgcaatgcaatttctccactgccaaggatgtgtctgtcatctctcatcaaccaagtgtcggtgcgtaccaactgtacgcgcgttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttcccaacagttgcgcagcctgaatggcgaatggaaattgtaagcgttaatattttgttaaaattcgcgttaaatttttgttaaatcagctcatttttttaacaaataggcgaaatcggcaaaatcccttataaaatcaaagaatagaccgagatagggttgagtgttgttcccagtttggaacaagagtccacta

SEQ ID NO: 68955 - protein, 108 aa, Zea mays
  misc_feature: Ceres CLONE 1546033
  misc_feature: SWISSPROT Homolog: EC 3.2.1.23 Beta-galactosidase
MQCNAISPLPRMCLSSLINQVSVRTNCTRVKKKKKNETLEVPNSPYSESYYARSLAVVLQRRDWENPGVTQLNRLAAHPPFASWRNSEEARTDRPSQQLRSLNGEWKL

SEQ ID NO: 68956 - DNA, 741 bp, Zea mays
  misc_feature: Ceres CLONE 1546035
  misc_feature: Encodes the peptide sequence at SEQ ID NO. 68957
ctggagctcaccgcggtggcggccgctctagactagtggatcccccgggctgcaggaattcgtctcacccctagaaaactcgtggccctgctcgcctaggcacgggcgcgcgcgcgagcgggtggcgcctgcacggccgcaccgcatgccgggacggacgacgacaggaattggtgacgcggatgcagccggtgcgcggcgccgcgctgtattcttggccggtgtagttgtagtgcagtgccactcacgttcggtggcgggtggtacgtgcggtgcggacgtaccaccgtcgcctcggattctttctatctcttctctcttcctttttttttgttttgctgtactatattgcgacccccattgagatgctttattttatatatcttattttattgcagagggggggcccccccccccaaaaaaaacaaaaaaaaaaaaaaaaaaacgagacgctcgggggtaccccatttcgcccttataggggagtcgtatttacgccccgctccctgggccgtcctttttacaaacgttcttgatcggggaaaaaccctggggggttcccccaactttaattgccctttggcggcaattccccccttttcgcccacttgtggctaaaaacgcgaaaaagggccccgccaaccgattcccccctttccccaaaaattttggcacaaacccttggaatggccgaaaatggaaaatttgttaaggcgttttaaatttttgtgttttaaaaat

SEQ ID NO: 68957 - protein, 72 aa, Zea mays
  misc_feature: Ceres CLONE 1546035
MPGRTTTGIGDADAAGARRRAVFLAGVVVVQCHSRSVAGGTCGADVPPSPRILSISSLFLFFCFAVLYCDPH

SEQ ID NO: 68958 - DNA, 632 bp, Zea mays
  misc_feature: Ceres CLONE 1546036
  misc_feature: Encodes the peptide sequence at SEQ ID NO. 68959
ggagctccccgcggtggcggccgctctagaactagtggatcccccgggctgcaggaattcgtctcacccctagaaaaactggacggggtcgacgtgggatcaagaagccccgtggcctagatcagtggcctgcattgcacttggctggtgcgctggtctaccatctcccaagtgggagagtggacgtcataatttgtggcagagggggtacgcgttcgcgcggcccctgaaaaacatgaagtggctccaagcaaacaaaagttgggcataatggctgccaaacagttttgccatgaaatgatagaagtgctgcaaacaagcatctctacaaatctagtctatggaacatgaggtttctttgtgccctgtggagccccctttcccccctagaaatgtatatttatcgcgccccacaggcctcttttttaatcgcagatgtgggagaaacccttgaataccccaattaataccccttgaaaaaaaccccctttttccccgggggggaaaaaacaaaaagccccccgcacaaactcctccccaaagtgtgccccccctccgagggcaaaaggaaatttcaaaccccaaaatttttgcaaaaaaacccccttaattttcttaaaaaaccccccttt

SEQ ID NO: 68959 - protein, 37 aa, Zea mays
  misc_feature: Ceres CLONE 1546036
MEHEVSLCPVEPPFPPRNVYLSRPTGLFFNRRCGRNP

SEQ ID NO: 68960 - DNA, 703 bp, Zea mays
  misc_feature: Ceres CLONE 1546048
ggagctccccgcggtggcggccgctctagaactagtggatcccccgggctgcaggaattcgtctcacccctagaaaaattgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacatgcatgtttggttgatccgattgcgttctgctgtaacccatatattaaattggtccccgatgatttgattttgatactttttttttttttttttttccctaaaaaaaaaaaaaaaaaacgaagaccctcgaggtacccccatttcccccttattggggagcccgttttaccccccgcctctcgggccgtttgttttcccacccgtgggggcgggggaaacccccgggggttttcccaaattttattcccctttgggaaaaactcccccctttttcccccggtggggggttttattagaaaaagaggccccccccccaattttccccctttcccccaattttgttcgccccccccgatagggggggagaggggaaatattttctccccctcttattatttttttttgtaaaaacaccccgcctgtaatattttttttttttaataacaacccctcccttttttttttttttaaccaa

SEQ ID NO: 68961 - DNA, 701 bp, Zea mays
  misc_feature: Ceres CLONE 1546051
  misc_feature: Encodes the peptide sequence at SEQ ID NO. 68962
  misc_feature (521)..(521): n is a, c, t, g, unknown, or other
  misc_feature (558)..(558): n is a, c, t, g, unknown, or other
ctggagctccccgcggtggcggccgctctagaactagtggatcccccgggctgcaggaattcgtctcacccctagaaaaacccaattcccgtccatcagctcgcaccagcgaccagagcagcagaccaagcaagcgcgagggagagaagagacgaagaagaaaagaaaagccggagctctgccgagcttagtccgcggaggcggcgaccggcgacgcgtaaccatggagcgggcggaggaggcgcagcccgccgccgagcggagggcgccctcgacggcgccgtcggcgcgggtgtcgatctgggagtcggtacgcgcgtgcggggtgtggggggaaggagctggacaaggccgagctgtggaggcaggtcgtcatgccacgctacctgcgccgggccgtcgcggccgccgtcaaggccaaggacgaggccgccggcgtggcggtggcggcggcggccgctgaggaccgcgcgggggaggacgccgattgcccggcggtggcgcccgtgggtgtgttcgtncactcgcgcagtggcggggcgcaacgggcccgagctncaggtgcggctgcccgagctcattcaccgaggaagcaggggctttgaatcctttcagttgggaagccttccgatttgtccacctgggtttgagtggtttgggaaaggtagcctgaccaggcgataaccgggccaaaggtggtt

SEQ ID NO: 68962 - protein, 76 aa, Zea mays
  misc_feature: Ceres CLONE 1546051
  misc_feature (62)..(62): Xaa is any aa, unknown, or other
MPRYLRRAVAAAVKAKDEAAGVAVAAAAAEDRAGEDADCPAVAPVGVFVHSRSGGAQRARAXGAAARAHSPRKQGL

SEQ ID NO: 68963 - DNA, 694 bp, Zea mays
  misc_feature: Ceres CLONE 1546062
  misc_feature: Translation starting site: 232
caaagctggagctcaccgcggtggcggccgctctagaactggtggatcccccgggctgcaggaattcgtctcacccctagaataaagccagctcgaccgacgagacgacaacgccgccgcgccgcgcgcacgcccgacgccgacgccgacgccgacgacgacacgccctccgcccggtcccggtgaggcagcgaacgcccgccacacgtacagataccgtgcgcgcccggcatgggggtgaccaccgccggggaggccgtctgtaagtccccggcgcgggcctcggtcatcgtgaggctcaacgccgcgttcctcgccttcttcctcttcgcctacgtggcgctcctcctccaccccaagtactcgggcctcgtcgaccgcggcgccacctccctcgtccgctgcaccttccgcgactcctgcccgccgccgaatcagcagctctcacggtaggtaagctgggatgcgtggcggcaaacatcgtagcggaggacgagcgcatcgtgaacgcggggcgcgcgcccggcatgttcgacgagctccggggcctgctgcagatggggctggttgacatcgtgcgcgactagctgctggccctgggcgtgggagggcaaccccgtggccctgggaattccaacgcgtggtctgacgcattcccgtggttggacctgttcccggagtggatcgcccaggg

SEQ ID NO: 68964 - DNA, 612 bp, Zea mays
  misc_feature: Ceres CLONE 1546068
  misc_feature: Encodes the peptide sequence at SEQ ID NO. 68965
  misc_feature (543)..(543): n is a, c, t, g, unknown, or other
ctcaccgcggtggcggccgctctagaactagtggatcccccgggctgcaggaattcgtctcacccctagaaaaaatcgcctttgcccgcacacacggctcccattccatttccgctgcttgacgcgcacccacaccaccacagcacgcgacgcgagaccgaatccatccgtccgacgccgcctcgcctccctcagccctccgcagctcggcctctgcttgcgttgcgttgcgttgcgtgtgtatgtagtggccgcaacacaaaatcaagagacgtgatctatgcgaccgccaacagccaacgaccggcctccaagcggtgggggtggagcagcagcagctggtgcagcagcacgccaccacgacgtggggggggtggtctcctacctccaggaagccgacccccccgccccctcaacgacgtcgacgctcgccctcggccgcgacgacccccaccccagggcccgcagggatgacaaacggcccggccccggaaagcagcccgggggaaaaaggaccccggaacccccccgggaaacggtcanggaggcgggccaaaaaggcggggcacgaacggggtccctcccccagggttggtcccccccccttggggg

SEQ ID NO: 68965 - protein, 47 aa, Zea mays
  misc_feature: Ceres CLONE 1546068
  misc_feature (25)..(25): Xaa is any aa, unknown, or other
MTNGPAPESSPGEKGPRNPPGKRSXRRAKKAGHERGPSPRVGPPPLG

SEQ ID NO: 68966 - DNA, 686 bp, Zea mays
  misc_feature: Ceres CLONE 1546083
  misc_feature (66)..(66): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (391)..(391): n is a, c, t, g, unknown, or other
  misc_feature (392)..(392): n is a, c, t, g, unknown, or other
  misc_feature (436)..(436): n is a, c, t, g, unknown, or other
  misc_feature (452)..(452): n is a, c, t, g, unknown, or other
  misc_feature (572)..(572): n is a, c, t, g, unknown, or other
  misc_feature (639)..(639): n is a, c, t, g, unknown, or other
  misc_feature (660)..(660): n is a, c, t, g, unknown, or other
  misc_feature (682)..(682): n is a, c, t, g, unknown, or other
tccccgcggtggcggccgctctagaactagtggatccccgggctgcaggattcgtctcaccctagnaaactcgcgctcccacccactgacccaccccacgccgccgcctctcccagtgggtcctccgcatctcccatctcccatctcccgtctcccctcttcctcctcccctgcgatcttctccaccgcatcacctccctcgaaccctagacccacccacgcgcccattgccttcggtcgccatgtccgccgctcagcttctccgtcactcgtgcacgctgaggaggttgcaaaatgctgtaggttgttataattttagttttggtcggaatttctccagcgtttttgttgcccccccccccggggggaagaagaggggtaaannnanccnntttttcctttttttcccaaaataaaaaaaaaaaaaaaaacctcnaggagtgggggcggcnccttaaagggaagcccccccctggaaaaaagaagcacacgcgctcccccccaggtggagaaccccgggtaaaggggatccattcccacgggggaacgggggggctaaagcgcgggcgggncctaagaagggtggagacaccggcccacccacgcgaaaagggggggcgagggtgttttttggggaangggacgtttcatatgggaatntttgtcgtagggtcggattagngaaa

SEQ ID NO: 68967 - DNA, 686 bp, Zea mays
  misc_feature: Ceres CLONE 1546085
  misc_feature (371)..(371): n is a, c, t, g, unknown, or other
  misc_feature (388)..(388): n is a, c, t, g, unknown, or other
  misc_feature (394)..(394): n is a, c, t, g, unknown, or other
  misc_feature (402)..(402): n is a, c, t, g, unknown, or other
  misc_feature (403)..(403): n is a, c, t, g, unknown, or other
  misc_feature (436)..(436): n is a, c, t, g, unknown, or other
  misc_feature (437)..(437): n is a, c, t, g, unknown, or other
  misc_feature (456)..(456): n is a, c, t, g, unknown, or other
ctccccgcggtggcggccgctctagaactagtggatcccccgggctgcaggaattcgtctcacccctagaaaaattcagctctgatggcttcgttccattgcaaaccacctcccgttctgatttctgcgggcggaattccataaggccctcccccctcccctatcctcctccccttgccactccaattcctctgcaaaattttctcatggcagccgacgtttccatccgcactcgatccgcctcaaccacccgctaattcctcctagttctagacttctagtctcctctctctctctctctctctctctctcctgcgccgactcatcttcatcctcgtctcacctccctgctgctgctgacgctgctgccngcaagatcaaaatcgtncaaaangtgtttanngtgatggtgctttcgaccctcatagtgcctttnngtcaattgcctgacccaangaacaaaggtctgtcgaactggcatcttcaagaagaaaggatgtcatttcccccttcgttccttccgaataatccggcccaaggcccaaccggggaacttcaaaggttgtacctttgggaaaaaacatacccttgtgttttaaaaaattcaagggaattttttcccccccaaaaaaaggcccaggggaaaagggggcccttttacgcggggaaaactttgggggccgccc

SEQ ID NO: 68968 - DNA, 931 bp, Zea mays
  misc_feature: Ceres CLONE 1546086
  misc_feature: Encodes the peptide sequence at SEQ ID NO. 68969
  misc_feature (10)..(10): n is a, c, t, g, unknown, or other
  misc_feature (11)..(11): n is a, c, t, g, unknown, or other
  misc_feature (46)..(46): n is a, c, t, g, unknown, or other
ccccccttgnngggcttttggcttcttgggtgttgaaggaagagtncttactcctttgtgggctcgcgcggtggcggccgctctagaactagtggatcccccgggctgcaggaattcgtctcacccctagaaaaaaaagtccccacagcactctccccgaccttgtcgtccagtcgtccaccccaccgccgcagcctcgccccgaggagacaggagaacaccaggatgccggcgaccccgacgatcatcggcgccctcctgggactgggcactcagatgtactccaacgccctccgcaagctttccctacatgcgccattgatgatgaacaccttgtttagaatttttttgtcaagtgacctgaaattattttagcaaaatggtggcccgcgaccccatgggtcccggactcgtggggaaccccctccttggacttccccctccccggccgtgggcggtgtgcggattgtctatacatgggcggcctcttggtgtattaaataaaaagaccctcgacccctcacttgttttccccgaatccgaattcccaaatttctgtgatgttaaccaacatataatgggcggcttgcttgaaaagtgggcggatgtcctcttaacctttttccgcttggtggtgagcatccttcaacaaataatccctagctacctcccctctccgtgctcacacccagaagacttcccctcatatcacatgtgggaacgcctcgcttacccccccggcgaagccctgaaagcggcccctgctctttcctttattttaccccgcccctcgtacgtgggtgagtaaagccacctgccgctgcttttcccccaccctccactatctgcccctcttacagtccgcaccccgttccccggccttcttcacgcggtgttgggttgtctattttcacaaacccattgcccatgg

SEQ ID NO: 68969 - protein, 49 aa, Zea mays
  misc_feature: Ceres CLONE 1546086
MPATPTIIGALLGLGTQMYSNALRKLSLHAPLMMNTLFRIFLSSDLKLF

SEQ ID NO: 68970 - DNA, 716 bp, Zea mays
  misc_feature: Ceres CLONE 1546100
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (401)..(401): n is a, c, t, g, unknown, or other
  misc_feature (618)..(618): n is a, c, t, g, unknown, or other
ctggagctcaccgcggtggcggccgctctagaactagtggatcccccgggctgcaggaattcgtctcacccctagaaaaagttgttgttttttttattattttgttcgtcatcatacactaagcttctgtgaaaatgaaaaagtcttggacgttgttgttatgttgccattatgccatttttcatgtataagaacttactaagaatcttccattgactcggtaaannnnnnnnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnnnnnnnnnnnnnnnnnnnnnnnnnnnnnnnnnnnnnnnnnnnnngnnnnnnnnnggggggggggnnnnnnggnnnaangggggggggggccccccccccccccccccccccggggattcaaaaagcgggcagagggagaaaacccgcggaaacgcccccaatgattcctctgttgggaaaacacccccttttgggggggggggggaaaaaaaaaaaaaacccccccccccaccttctttttttcctgagtggggcgccggcccctaaccgtcaaagaagaattttggtggttttntttttttttttataaaactttccccgtataatattttttttaaaaacccccccttttttttttttggaaaagaggggcgcccaattttggggcgttct

SEQ ID NO: 68971 - DNA, 652 bp, Zea mays
  misc_feature: Ceres CLONE 1546101
  misc_feature: Encodes the peptide sequence at SEQ ID NO. 68972
  misc_feature (509)..(509): n is a, c, t, g, unknown, or other
ctggagctccccgcggtggcggccgctctagaactagtggatcccccgggctgcaggaattcgtctcacccctagaaaaacacctcccatcgtcattgcttgctccatgtggagtcactttattactgcattacactagctagctagctagccacagccagcttcatcttcacgtcgattcgatccatcggtgctgtgtgtaccgtacgccagcttgctgatccatcgccggccgacgatggaggtgagcacgtgggtgatgctggtggcggccgccgccgcgtacatggcgtggttctggcggctgtcgcgggggctcagcgggccgcgggtgtggccggtgctcggcagcctgccggggctggtgcagcacgccgaggacatgcacgagtggatcgtgggcaacctgcgccgcacgggaggcacctaccagacctgcatcttcacggtgcccggggtggcgcgccacagcgggctggtcacggtcacgtgcgaccctcgcaacttgnagcacgtcctccaaggggcgcttcgacaaactacccaaaggccccttttggaaccgccgccttccgggaactgtttcggggaacggattcttaattccaaaggggaacagttggtgggccaaccaaaaagggcccccttctat

SEQ ID NO: 68972 - protein, 138 aa, Zea mays
  misc_feature: Ceres CLONE 1546101
  misc_feature (91)..(91): Xaa is any aa, unknown, or other
MEVSTWVMLVAAAAAYMAWFWRLSRGLSGPRVWPVLGSLPGLVQHAEDMHEWIVGNLRRTGGTYQTCIFTVPGVARHSGLVTVTCDPRNLXHVLQGALRQTTQRPLLEPPPSGNCFGERILNSKGEQLVGQPKRAPFY

SEQ ID NO: 68973 - DNA, 716 bp, Zea mays
  misc_feature: Ceres CLONE 1546104
  misc_feature: Encodes the peptide sequence at SEQ ID NO. 68974
  misc_feature (590)..(590): n is a, c, t, g, unknown, or other
ctggagctccccgcggtggcggccgctctagaactagtggatcccccgggctgcaggaattcgtctcacccctagaaaaaacacactcgcacgcacgagaaggccggagaggcggcgcacccggagaggcaaaggtaagcgatccctctccccccctccctccctccctcgtatcgtatccaggacaacagcccgtgcaatccgatcccgatggcggcccggccggacgcgcgcagcggctactgcgccgcgacgcgcaccttccgtagcaagagcgcggacgtcccgctccccgccgacgcggacctggacgtcgtcaggttcctcgcgtcccgccgccacgcgggcgttgtcgcgctcgtcgacgctgccacgggccaccgggtcacgtaccaggaactctggcgcgcggtggaaggggcggacaccgcgctcgccgcgccgccgctgtctctccgcaagggccaggtcgagctcatactctcaccgaactccgtccaattccccgtcgccgccctcgtagcgatgtccatcgggagcgtcgtcaccagcgccaacccgctcaacacgccaggtgagatcgcctagcntatcgcctacgcgcgccccgtcgtctgcttatctacccgcagactcctgccgaaagatccgtgcgccggcaggcggagccgcatacgcgtcgtcctactcgaggccgaacagctcccctccgacgg

SEQ ID NO: 68974 - protein, 125 aa, Zea mays
  misc_feature: Ceres CLONE 1546104
  misc_feature: SWISSPROT Homolog: EC 6.2.1.12 4-coumarate--CoA ligase
MAARPDARSGYCAATRTFRSKSADVPLPADADLDVVRFLASRRHAGVVALVDAATGHRVTYQELWRAVEGADTALAAPPLSLRKGQVELILSPNSVQFPVAALVAMSIGSVVTSANPLNTPGEIA

SEQ ID NO: 68975 - DNA, 671 bp, Zea mays
  misc_feature: Ceres CLONE 1546107
  misc_feature: Encodes the peptide sequence at SEQ ID NO. 68976
  misc_feature (281)..(281): n is a, c, t, g, unknown, or other
ctggagctccccgcggtggcggccgccctagaaactagtggatcccccgggccgcaggaattcgtctcacccctagaaaaaactgcagccgccggccctcagcaagcaagcaagggacagaacgcggcggggatgggcagcggggtccgggcgctgatgcgccggaagcaggtagactccccgagcgacgcgcgccgccggcagcgcccaccagctccgcaaggagctctccgtcacccagctcgtcgccatcggtgttgggtccacaattggagcttgcntcttacctcctgtttggccaatttgcccgggaacaattccgggccggaattaaccttttcttttttctaaacccgaaaaaaaaccgggccttttaaccctttttttatgggaaaattggttaaccctttccccttcggaggaagaggcccccattattattccaaacccccggttgcgaaaaaagtttcccccggttttatttggggggggctttttaaaccctaaaaaacccccatgtggggggaacccccccctccccccggggggatttttccccaaaacaacccccttttttttttagagaaaagaaaaaaaaacccccccgcgtttttttttccccccccaagaaacccccccccggtgggatggtgtggtaaaaaaaacccccc

SEQ ID NO: 68976 - protein, 72 aa, Zea mays
  misc_feature: Ceres CLONE 1546107
  misc_feature (50)..(50): Xaa is any aa, unknown, or other
MGSGVRALMRRKQVDSPSDARRRQRPPAPQGALRHPARRHRCWVHNWSLXLTSCLANLPGNNSGPELTFSFF

SEQ ID NO: 68977 - DNA, 645 bp, Zea mays
  misc_feature: Ceres CLONE 1546109
  misc_feature: Encodes the peptide sequence at SEQ ID NO. 68978
ctccccgcggtggcggccgctctagaactagtggatcccccgggctgcaggaattcgtctcacccctagaaaaactagatgagcttgtatttcatcactgtatgttttatgccatcattatgtacagagaatatacatgtaacatggtgtggatagttcctcaaaatatgtgcaggactttccaaatttgtaacacagattttgtactaaaagacagctggttctgtactgccaaaacactgaaagacagagttgtattactcctcagcatttcttgcaaaccagaacctttttggccaaaaaaaaaaaaaaaaacgagacgctcgaggtacccaattcaccctataatgagtcgtattactcgcgctcactggacgtcgttttacaacatcagtgactggaaaaaccctggcgttacccaacttaatcgccttgcagcacatccccctttcgccagctggcgtaatagcgaagaggcccgcaccgatcacccttcccaacagttgcgcagcctgaatggcaaatggaaattgtaagcgttaatatgttgttaaaattcgcgttaaatttgtgttaaatcaactcatttttttaaccaataggcctaaaatcggcaaaatcccttataaatcacaataatccacc

SEQ ID NO: 68978 - protein, 130 aa, Zea mays
  misc_feature: Ceres CLONE 1546109
  misc_feature: SWISSPROT Homolog: EC 3.2.1.23 Beta-galactosidase
MVWIVPQNMCRTFQICNTDFVLKDSWFCTAKTLKDRVVLLLSISCKPEPFWPKKKKKTRRSRYPIHPIMSRITRAHWTSFYNISDWKNPGVTQLNRLAAHPPFASWRNSEEARTDHPSQQLRSLNGKWKL

SEQ ID NO: 68979 - DNA, 636 bp, Zea mays
  misc_feature: Ceres CLONE 1546113
  misc_feature: Encodes the peptide sequence at SEQ ID NO. 68980
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
ctcaccgcggtggcggccgctctagaactagtggatcccccgggctgcaggaattcgtctcacccctagaaaaaaagaccagatgccactctgagcttcccattaacctcgagctctggtcatcacaattaattaaaacaaaccgttcccgcagctcgtgccgacaatggcggcctctgttgagcggcacctggccccccacccgtggccggccaatgcgcctcccaagagcttcgacatgttccgctccggcggcccaggaggcaagcgccgcaccggccccgactccgactccgaggacgaggacagcattcccccggactggcggtcgctgtacagcccgcgcctggaggtggagccgtccgcccacgacccacgcgacgaggccacctccgacgcgtgggtgcgacgccacccggcgctcgtccggctcacgggcaagcacccgttcaactcggagccgccggtgccgcggctgatggcgcacggcttcgtcaccccggcgccgctccactacgtgcgcaaccacggggcggtcccccgggcggatgcacgannnnnnnnnnnnnngnnnnngnnnnnnnnnnnnnnnnnnnnnnnnnnnnnnnnnnnnnnnnnnnnnnnnnnnnnnnnnnt

SEQ ID NO: 68980 - protein, 130 aa, Zea mays
  misc_feature: Ceres CLONE 1546113
  misc_feature: SWISSPROT Homolog: EC 1.7.1.2 Nitrate reductase (NAD(P)H)
MAASVERHLAPHPWPANAPPKSFDMFRSGGPGGKRRTGPDSDSEDEDSIPPDWRSLYSPRLEVEPSAHDPRDEATSDAWVRRHPALVRLTGKHPFNSEPPVPRLMAHGFVTPAPLHYVRNHGAVPRADAR

SEQ ID NO: 68981 - DNA, 636 bp, Zea mays
  misc_feature: Ceres CLONE 1546115
  misc_feature: Encodes the peptide sequence at SEQ ID NO. 68982
tccccgcggtggcggccgctctagaactagtggatcccccgggctgcaggaattcgtctcacccctagaaaaagagagcaaaagggaaataaaggagctctcgcaggcactcggtactgacatgagtgatctcatgctcttgataccttggtactcttacatcaccccttcttcttcaccttcttcttgttcttgctcatccctcctctccggccctctcttcctcctgcctctctctagctaggacgatcttcaacaaccctctccccctctaattctctttccccatatagagagaataaaggagagagagagagaggcgaaggcaggcagctaattttcttttgttcaagggaaaggacagcacgtgccggagcgagctcataagctggtagctgcatcagttcctgaggcaaaaccacctgtttacgatcttgcagtcatcatcacgctattagttgaggataatttcgcgcacaagagcacgacaagccgagaatttttgggggcgtcggcttcgacctgtaggcgatggcggcgtactaccacggtggcgccggcacggacatccaggccagcaccgacggcctgcagacgctgtacctcatgaacccgagctacgccggcggctacgct

SEQ ID NO: 68982 - protein, 35 aa, Zea mays
  misc_feature: Ceres CLONE 1546115
MAAYYHGGAGTDIQASTDGLQTLYLMNPSYAGGYA

SEQ ID NO: 68983 - DNA, 769 bp, Zea mays
  misc_feature: Ceres CLONE 1546120
  misc_feature (291)..(291): n is a, c, t, g, unknown, or other
  misc_feature (643)..(643): n is a, c, t, g, unknown, or other
ctggagctccccgcggtggcggccgctctagaactagtggatcccccgggctgcaggaattcgtctcacccctagaaaaacagccccgcgccggcgctccccccactcgcgctcggcgcagcgcccccgcaacttgcgctcggtcgctccagcgcgggcacgcggcagcgcccctcctccgcggcacggctccgccggccgtccgcccgtgacccgcgcaacggccgcccggtaaggccaggcgcttagtcttgcaggccatccggcagccgctcggccgcccgcccctcngctctcctctgcaggccttgtcccccaatagctcgatccaggagcaaaaagaccgaacctgtgggaggtgaaggtgattttaaggaggtacacgccaccatagaacgaaatttcataatgctttggcaaacgagttgaagactatgggcaaccggaatcctgtccccgtcaaaatctggaaaaattgggcttcgttccccgcctccaaataatccccagaaggcactagtttccgccttaaccccccagttcaagaaaccccttttggttcccccaagaaaattcctgagcccccctttacccgggggggggatatcatggggggggggaaagggggaaaccctgggaaccnggaaacccctttttttccccaaagagggaaaaccccactttcaattgggagggggggggcccccccaaaaaaaaagggtttttaaaaaaagagctgtttaaccctcaagggaaaaggaaaaaaaaa

SEQ ID NO: 68984 - DNA, 581 bp, Zea mays
  misc_feature: Ceres CLONE 1546121
  misc_feature: Translation starting site: 135
  misc_feature: SWISSPROT Homolog: EC 1.14.13.11 Trans-cinnamate 4-monooxygenase
  misc_feature (299)..(299): n is a, c, t, g, unknown, or other
  misc_feature (325)..(325): n is a, c, t, g, unknown, or other
  misc_feature (327)..(327): n is a, c, t, g, unknown, or other
  misc_feature (330)..(330): n is a, c, t, g, unknown, or other
  misc_feature (402)..(402): n is a, c, t, g, unknown, or other
  misc_feature (455)..(455): n is a, c, t, g, unknown, or other
  misc_feature (468)..(468): n is a, c, t, g, unknown, or other
  misc_feature (519)..(519): n is a, c, t, g, unknown, or other
acccgcggtggcggccgctctagaactagtggatcccccgggctgcaggaattcgtctcacccctagaaaaaatcgcctccacgaacaaaccacacaccccacctaccccggccggaccggcaggcagcacaacatggacctcgccctcctggagaaggccctgctgggcctgttcgccgcggctgtggtggccatcgccgtggcccagctgagcggcaagcggtaccgcctcccaccggggcccccgggcgcccccgtggttagaaactggctgcaggtgggcgacgacctgaaccanccgcacctgatggccatggcgaagcngntcngcgacatcttcctgctgcgcatgggcgtgcgcaaccctggtggtggtgtcgaccccggagctgggccaggangtgctccacacgcagggcgtggagtcggctcccgcacccgcaacgtggtgtcnacatcttcacggncaggggcaggacatggtgttccacgtgtaccgcgccactggcccagatgcngcgcatatgaccgtcccttcttaccaaaaggtggtgcccaaaaccccccggtgggaaggaga

SEQ ID NO: 68985 - DNA, 689 bp, Zea mays
  misc_feature: Ceres CLONE 1546123
  misc_feature: Translation starting site: 565
  misc_feature (529)..(529): n is a, c, t, g, unknown, or other
  misc_feature (542)..(542): n is a, c, t, g, unknown, or other
aaagctggagctccccgcggtggcggccgctctagaactagtggatcccccgggctgcaggaattcgtctcacccctagaaaaaacaacctcctctcaccacggacagtgcgtgctaggagcccccatggcattttcccgtggcccccccggctaacaccttcctggccacctccctgctgcaccctgccccacagaaccggcgcatcctgcccccgttcttgttcccgttgcgccgcaaggagaaccctgctccgaaaaacgtggcaaatacctccacctctctctgaccggccgctgtggttccccggctccgtggcacccgactacctgcacggcctcctggtccgctactacgggttcgacccattcggtctcgggaagcccgtgcatacctgctaatcgagttggactcgctggaccataacctggctcacaatgacgccgagctcatcatctgcactcggttcgagtcctcccaattcagtccacgaggtgcaacgctacagctaggtgtcggcctgcaacgnttgcggcagtgcnagctatcccctgtccctgggccatgctacccaccctgggtgcccttttcctcaagtgggtaaccggctttccttggcaggagtccgcaatgttgcacttggggaaaggttcctcctactggggctggccgtggcctcttccccttgc

SEQ ID NO: 68986 - DNA, 675 bp, Zea mays
  misc_feature: Ceres CLONE 1546124
tcaccgcggtggcggccgctctagaactagtggatcccccgggctgcaggaattcgtctcacccctagaaaaaacccagatgctgtgggcaaaactttcgaggtcaagagcactgttccattcagcgaaccgtatgtgattgaccctgcaaatcctcctcctgaaaaggactatgaagtatatttcaaagaactcaaagaaggcatcacgggtaaagaggcgttagaggcaacacctgctcaagtttgaagatgtcgttgaattaagaatttcgtctgttttcttaaattctgacacagtaacccccactctgaatgtctaaagtcatctagaaacatagatgacactaatgctaaattttgtagctgaagatcagaccaataaatattcccggtgtgacacccaaaaaaaaaaacgaggaccctcgagggacccaattccgccctatagtgagtcctattcacccgcccttcctgggccgtccttttacaaccgtcgggactgggaaaaaccttggggtttacccactttaatcgcctttggaagaaatcccccctttttcgcaagctggggttaaaaagcaaaaaaggcccccaccccaattcccctttccccaaaaatttgccccacccctgaaagggggaaaagggaaaatttaaaccgcttattattttt

SEQ ID NO: 68987 - DNA, 677 bp, Zea mays
  misc_feature: Ceres CLONE 1546127
  misc_feature: SWISSPROT Homolog: EC 3.2.1.23 Beta-galactosidase
  misc_feature (548)..(548): n is a, c, t, g, unknown, or other
ctggagctccccgcggtggcggccgctctagaactagtggatcccccgggctgcaggaattcgtctcacccctagaaaaacctctgctcccacgacccgtcccccgccgatatgtcgagcttcgccggaggcggcggcggcgcgagatctgggaaccggaggttaaggatgctttagtgtgcttattacctacccattggagtattatccgcgatgcgcatgttgtacttgtccagcagtaaccaagtatgggaccaaagtatgtcaccatacaaaacactgttgctgtggtaatactacctacatcagcgtgttcctgataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatngggaattgtagcgttaatattttgttaaaattcgcgttaaatttttgttaaatcagctcatttttttaaccaataggccgaaatcggcaaaatcccttataaatcaaaagaatagaccgagatagggtt

SEQ ID NO: 68988 - DNA, 648 bp, Zea mays
  misc_feature: Ceres CLONE 1546128
  misc_feature: Encodes the peptide sequence at SEQ ID NO. 68989
  misc_feature (465)..(465): n is a, c, t, g, unknown, or other
  misc_feature (486)..(486): n is a, c, t, g, unknown, or other
  misc_feature (543)..(543): n is a, c, t, g, unknown, or other
ctggagctccccgcggtggcggccgctctagaactagtggatcccccgggctgcaggaattcgtctcacccctagaaaaagcttccaccgtcctccgcctccgcctccatccgccccgcgcccagtactcgtctcttgctttctccctctctctctctccgcgcgcgcacccacgcacgcagtttgagagggtgtgcggcgctcgaggggcgaggagcggggcggtccatggcagaggcaggctgttccgcggtgaggaccaggacggcggggctcgccgccgccgccgccgccgcggcggcgctcctcgtgctcgtggttgtcgccggcagcgcggcgctccctggcgcgcgggtgagggtcctcgacggcctccggcacaggagcacggccgtggcggcgggcggcgcgaggcgttggctgcggtactcctcctggccggcggcggcggcggcaacaacaacnaccaggggcagggcgacgacngcgagcccggcgggcatcgagggcgtcaccgcccggtggaggatcccgaagccgggncaacgacgtgcacgtgttcatcaggaaagcacggcccggcaacacccgggaacctgtcggggggaaaagcaaacccaattaaaaagggggggcctgcaaatcgga

SEQ ID NO: 68989 - protein, 140 aa, Zea mays
  misc_feature: Ceres CLONE 1546128
MAEAGCSAVRTRTAGLAAAAAAAAALLVLVVVAGSAALPGARVRVLDGLRHRSTAVAAGGARRWLRYSSWPAAAAATTTTRGRATTASPAGIEGVTARWRIPKPGQRRARVHQESTARQHPGTCRGEKQTQLKRGGLQIG

SEQ ID NO: 68990 - DNA, 820 bp, Zea mays
  misc_feature: Ceres CLONE 1546139
  misc_feature: SWISSPROT Homolog: EC 3.6.3.14 H(+)-transporting two-sector ATPase
  misc_feature (27)..(27): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
  misc_feature (464)..(464): n is a, c, t, g, unknown, or other
  misc_feature (820)..(820): n is a, c, t, g, unknown, or other
aaaacggaccaacctaaaccacccccncnccnnnnnnncccaaannccaccncacccaaactccccgcggtggcggccgctctagaatagtggatcccccgggctgcaggagttcgtctcacccctagaaaaaagaaaaagaaaatttgattaatgctacttctattagtttggaacaattagaaaagtctaaaaacgaaaccctttattttgaaaaacaaagggcgatgaatcaggtccgacaacgggttttccaacaagctgtagaaggagctctaggaactctgaatagatgtgttcttcagagttcggttacttgatttatcagaaaaaaaaaaaaaaaaacgagacgctcgaggtacccaattcgccctatagtgagtcgtattacgcgcgctcactggccgtcgtttttacaacggtcgtgactggagaaaaccctgggcgttacccaattttaacanccttgtgcggcacaatccccctttttcgccagttgggcgtaataggcaaaaaaggccccgaaccggaacgccctttcccaaaacagttggcgcaaccttgaaatggccgaatgggaaaattgttaaaccgttaaatatttttggttaaaaattccgcgtttaaaatttttttgttaaatatcaacctcactttttttttaacccaattaagggcccaaaatccggcaaaagattccctttttattaaatccaaaaaggaatataaccccgaagacataggggtgttgaaagggtttgggtcccccagtttttcggagaaacagaggagagttctcgctttctttataaggacaacn

SEQ ID NO: 68991 - DNA, 702 bp, Zea mays
  misc_feature: Ceres CLONE 1546144
  misc_feature: Translation starting site: 153
  misc_feature (283)..(283): n is a, c, t, g, unknown, or other
aagctggagctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaagcccgcgtgacgatgcgcaagaccgctgggaggccaagccggccgcnggcgtcgtggagaccgtggtaccggcccgaacgcgtgctgtacctggcccactgtgcggcgagacgccaaactaactgacaggcgagatccggggcgactccggttgtgacacacgggggctgtctgcggaacccgagacattctcccagaaaccggagctggaggtgatccactccccgcttgggcatggtggggggccctctggtgcgtcttccccgagaatggtcccccgccaacagggtcaaaatttgggaggccccgtggttcaaaggcggctccccaaaatcttcgaaggggggacgggagtaccacggggagcccaggctccttcacgccgcgaagatcctccccaccttgggccttccccgttgtggtccttggggcccctttaggaggtacccatcatcgggggggcccc

SEQ ID NO: 68992 - DNA, 724 bp, Zea mays
  misc_feature: Ceres CLONE 1546145
  misc_feature: Encodes the peptide sequence at SEQ ID NO. 68993
ctggagctccccgcggtggcggccgctctagaactagtggatcccccgggctgcaggaattcgtctcacccctagaaaaacttaggttcatctactggtgggaggacaaggtctcaggacagaagagctgaaccatgttgaattgaatgatgcctatttgagcattccagtttgacaaaaacattgatgtctattatctgtaatccttattgttttgttttgtttcctagtttttctctaataaggtgcgtatcggttgtggaaaccaactggacgatgtatttttcatctctgtcagtagtgacatttatccgctgagtctctcacctgctggcggaggcggcccccaaaagccaaattccccagcccacaccacctccacactccaggttagggtttgctgtcggcgatgtcggatcggcagccgtcggaggaaccggaggagcaggtggacctggagggggacgacgacggcatggacgacgacgacgccgggtaccgtcgccgcggaagccgggacgactcggaggagcccgaggaggatgacgacaatgactagcgccacggcgaggccgacgacgacgccgggatggagccggagccggccggaagtaaaggcggggatgacacgggcaaggggcccgacgtcgccggtggcggcccccaaggacgaagaggagaggagcaagtgggatgacatgctcgccctgccgccccatggatc

SEQ ID NO: 68993 - protein, 49 aa, Zea mays
  misc_feature: Ceres CLONE 1546145
MSDRQPSEEPEEQVDLEGDDDGMDDDDAGYRRRGSRDDSEEPEEDDDND

SEQ ID NO: 68994 - DNA, 625 bp, Zea mays
  misc_feature: Ceres CLONE 1546148
  misc_feature (244)..(244): n is a, c, t, g, unknown, or other
  misc_feature (245)..(245): n is a, c, t, g, unknown, or other
  misc_feature (251)..(251): n is a, c, t, g, unknown, or other
  misc_feature (264)..(264): n is a, c, t, g, unknown, or other
  misc_feature (278)..(278): n is a, c, t, g, unknown, or other
  misc_feature (482)..(482): n is a, c, t, g, unknown, or other
ctcaccgcggtggcggccgctctagaactagtggatcccccgggctgcaggaattcgtctcacccctagaaaaactccctcaacttcagcaagttccccgcaaaaccgcagccggaggtcgccggtcgccaccaccaatggggccacccgccatggcgttcaaaagcctcacctcacgccactccccttctcactcacagctcgagccgccgcgtccgcgtgcttgccgtgcgggcgacagaanntctcgnccggccccccttnggaagcgggaaacnagccctagcgcctcctttccgagctcccgcaaccggaagaggccctatcccctaagaaaaaacaccggcccggtggtttcatcttgaaacccccttcgatgaaaaagggcctataccgggggtttccttaaaaacccagaaattgtctttaaagggctcccgtgttttttttttggggccccccccggggcgcgttttcacccnaaaaaagaactggatgaagaaaaaaaccccccaaaggaaaaatgggggcctgggtaaccccccccccccccccaaaaaaacccgaaaaaaaaaaaaaaaccccccccccccatttaaaagggggtggcccaccccccgctcac

SEQ ID NO: 68995 - DNA, 710 bp, Zea mays
  misc_feature: Ceres CLONE 1546151
  misc_feature: Encodes the peptide sequence at SEQ ID NO. 68996
  misc_feature (515)..(515): n is a, c, t, g, unknown, or other
ctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgactgggagctcgccgcgcggtggcgtggaggtcacggcagcaacnactgggaaggtctgctggaccccatcgacggcgtgctccctcaggagctcatccgttacggcaagttcgccccagccacctacgaacagctccgactacgaaccgcttctccccctacggggggaagcgtgaaagtcccgggggaaaaacctttttccaaaaagttcggcctcggggggattgggtaaaaaaggt

SEQ ID NO: 68996 - protein, 149 aa, Zea mays
  misc_feature: Ceres CLONE 1546151
  misc_feature (88)..(88): Xaa is any aa, unknown, or other
MAATVSSCLSLVPTVHHRAGGFPSSVALTNTLQRRRRSRRYLVVASATRAEQEAAPVTIEDVDLSSHQAAADDWELAARWRGGHGSNXWEGLLDPIDGVLPQELIRYGKFAPATYEQLRLRTASPPTGGSVKVPGEKPFSKKFGLGGIG

SEQ ID NO: 68997 - DNA, 713 bp, Zea mays
  misc_feature: Ceres CLONE 1546158
  misc_feature: Encodes the peptide sequence at SEQ ID NO. 68998
tggagctccccgcggtggcggccgctctagaactagtggatcccccgggctgcaggaattcgtctcacccctagaaaaaatcgattcaacgacgctgtctgggctctctctgttttttttttgttccaatcatcatcaccatcatcagaggagaggaggagagtagattggattggtcagattactctcactctcctccactgcagtctctctgaagagaagaggctaatccaatccagcccagccctgcctttccacagttcctggagaaaatcctcactcgggtgcgcgaagcagcttgattcgcctgcgcagctcatcggaagagagccaggagcttgttcttggctgctggaccgatctttgagcagccgccgctgatcttgccggagggccaagagcctgtgttcttgcaccggagaattctcggccagccgtgccggatagggttgagggtgtgccatgtcagcgtcgcagtcctcgatgagcggcgccggggagccgggggcgcgggcggtggtctggttcaggcgggacctgcgcgtggaggacaacccggcgctggcggcggccgctcgggcggccggggaggtcgtgccggcgtacgtgtgggcgcccgaggaggacggggcctactaccccggcagggtgtcccggtggtggctcagccagagcctccagcacctggacgcctcgctccgccggctcggggc

SEQ ID NO: 68998 - protein, 83 aa, Zea mays
  misc_feature: Ceres CLONE 1546158
  misc_feature: SWISSPROT Homolog: EC 4.1.99.3 Deoxyribodipyrimidine photo-lyase
MSASQSSMSGAGEPGARAVVWFRRDLRVEDNPALAAAARAAGEVVPAYVWAPEEDGAYYPGRVSRWWLSQSLQHLDASLRRLG

SEQ ID NO: 68999 - DNA, 836 bp, Zea mays
  misc_feature: Ceres CLONE 1546160
  misc_feature: Encodes the peptide sequence at SEQ ID NO. 69000
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nttttnnnggttttgtttgtttttcgtggggtgcccttttaanaataccnnnnccgttcctgggactccccgcggtggcggccgctctagactagtggatcccccgggctgcaggaatgcgtctcacccctagaaaaatgctctcgagccaccatcgaccttcaagtctcggcgacgaccccgaggccttcgccgagctcatggtcaaggagctcaagaacggccgcctcgccgtgttctccatgttcggattcttcgtccaggccatcgtcaccgggaagggcccgctcgagaacctcgctgacctcattgccgaccccgtcaacaacaacgcttgggcctacgccacccacttcttccccgggaagtgagggaagggccccccggtgaccctttaggtgtcctggatgcatgggaagcgcgcgcttcgttttggggtttgcaccactgaaattaaacttatgggttcagtcggtggtccccccccacctgggtgtccaatggcccatcgagggacactaaaaataaaaaacccctggccacgcccggtagggttcccccctttttcgccgcattattgggggaaggttggtaaataatcggcgccgcttctcacggtgccccattttcttttctcaaacctgccccggaccgtggggacaaaaccccccggtggttttttcctcaccttttagatcccccccttgcgggccaagccccccccttttcgccaattaggggggtaaaaactgcctgaaagaggccccggtcccgttttctctctttgtccaacaaaatagggctccccctggttataaaggcgttgtaggtgtatt

SEQ ID NO: 69000 - protein, 84 aa, Zea mays
  misc_feature: Ceres CLONE 1546160
MRLTPRKMLSSHHRPSSLGDDPEAFAELMVKELKNGRLAVFSMFGFFVQAIVTGKGPLENLADLIADPVNNNAWAYATHFFPGK

SEQ ID NO: 69001 - DNA, 592 bp, Zea mays
  misc_feature: Ceres CLONE 1546163
  misc_feature: Translation starting site: 151
gccggttggcggccgctctagaactagtggatcccccgggctgcaggaattcgtctcaccccctagaaaaagctactcaatttgatcaaccgccatccattctcctcctccgttgcagctgcggcatccatccagtagtccgaccaatccatggcttcagcgttcgggaccgcctccacttgcggcattaaacatgcacctgccccggcgttgcgcttttgctgccggcccccatggaagccaccttttttcccttcgttctccgccctccgcttggttttcccctttccccccccaaaatattattaacccccccccaaaagaaaataaaacttccggggaaaaccctccaaaagagcgcttttccaaaagggggggccccgcctttcgggaaaaaaatcgacaaaaggggggggtgaaaaaaaaaatttttgtggaaagaaatttcccccgggggggggggttttctcccctttttttcccccaccaagggggggggaaaaaaattttttccccccaccaaaaaaggaggggtgggcccccccacaattaaattattaaaggggtgccccccccccccaaaaaaaaaaaa

SEQ ID NO: 69002 - DNA, 2298 bp, Zea mays
  misc_feature: Ceres CLONE 1546167
  misc_feature: Encodes the peptide sequence at SEQ ID NO. 69003
actccccgactccccctcccttccatctcttcccttgcatttagcctcccgcggttcaggaggcgcgggccattcccaaccatcgttgcagtggtggcaggtattggcctgtcgagacgagacccatgggcattcaggtcgcggcggtggtgaccccgccgccgtgctcttccccctcctcctctacggcgtcgccttcgtcctcggccattgccacgtcgccgcggcacgccgttcttggcgccaggctggcgaggagccagtcgtcgctggcttgctggaacgccggtcttggccggcggcgcggcgggatcaggcgcgctctcagtgcgagcatcgacagcgtcgggagcggcggcggggaggacgaggagttcctgaggaggatccaggagctcgcggcgggtcagcacccgggcggcggcggctgcgggtggccggcgagcgtggagcggaacgcgagcagcgtcgggctgccgctgtctctgcggatgctcaaacggaggaagcagcagcagcagctggagcaggggcggtggaacgagcggctgatagactgcgccggcgagtccgcgcgcgccgcggtgggccgtgccttctcctcgatggtgctcatcatccgggagctccagagcttcacgctgcagatgcgggaggcggtcgtctacgaggacctgcagggcgtcctggcgcgcgtccacgccgagatgcacgcctccttcgtctggctcttccagcacatcttctccggcaccccggccctcatggtctccctcatgctgctcctcgccaacttcaccgtctactccatgggcgacagcgtcgcggcggctgccagcctcgtcccaccccaggcagccgtggagatggtggacatccagcagcaaccggagcaacagcaatcccattcccagcagcggttcgacacccccgcgctcaagacgttctccactggccgcacggcctcagtgggtggaaacggcgacgggggcggcaaagtgcggccggttgccggcgccaccggcgacggccagtcggacgagtcgtcgcatcggcaaaacggagcggtggtgctgccgcaggacttgtcgcagtcgcaggcgacgccactggcgtccgtgtccgactcgatggccgtggaggatgcgcaagcacaagagactgtacaggacgacgagctggccatctggaaacggatatccgatgaagccgccaggatgcaggcgagcgtgcgtgcagaggagctgatggacccggaaaccctggagcagctcgtcgcgccggtggaggcgccgaagccagacacggtccactactcgccggagcacgtggccacggcgcagaggtacgagcaggccctgtccgaggagcccaacagctcgctgctcctggcaaactttgcgcagttcctgtaccaggtgcagggcgacctcgacagggcggagcacttcttcaagagggcggcgcgcgcggagcccgcggacgcggaggcgctggggcggtacgcggcgttcctgtggcaggcgcgcgacgacctcgcggccgcggaggagacgtaccaggaggccatcgccgccgaccccggcaacgcgcaccacgcggcagcctacgcgcacttcctgtggaacacgggcggtgaggacacatgctacccgctcgactgatgcgtgcgtgcgtgcgtccaccgccgctagcgtccagcacagatcatcggtgccctgccctcccataaaaacttcaaacgaaaagaaagagaaaatggtcactccgccgccccgctgaccgctgtccactccactccctcggcaagtccaggctcttctaacggcatgtgcttgagcggccgcccgggcatcatgtgaagctgaagctgaagcagatacacttgcgttactctggaaccgctcgtttgctttagcctctaggcattttctcttcctctgtggttgctcgttttggggtaagtagtgtggagcaatggccaacggaaatccgcggctcgctgctgcttcccgatctggaaacccggccggcgactgcgagttgagaggccgggaacggcggcagcgctcgggagtcggtggggcccgtccacttggcgacgcatggatgtttcctggtggcacttttgtacgttgtcgttgagatttgtgagatgcagctttgttcagtggagcaggaaagtatgcgtattaatactgatatactggcagccatttgctttctttgtaactgtgcagatcaataaactgtataagaagctctccattttttttcatccaaaaaaaaaaaaaaaaa

SEQ ID NO: 69003 - protein, 512 aa, Zea mays
  misc_feature: Ceres CLONE 1546167
MGIQVAAVVTPPPCSSPSSSTASPSSSAIATSPRHAVLGARLARSQSSLACWNAGLGRRRGGIRRALSASIDSVGSGGGEDEEFLRRIQELAAGQHPGGGGCGWPASVERNASSVGLPLSLRMLKRRKQQQQLEQGRWNERLIDCAGESARAAVGRAFSSMVLIIRELQSFTLQMREAVVYEDLQGVLARVHAEMHASFVWLFQHIFSGTPALMVSLMLLLANFTVYSMGDSVAAAASLVPPQAAVEMVDIQQQPEQQQSHSQQRFDTPALKTFSTGRTASVGGNGDGGGKVRPVAGATGDGQSDESSHRQNGAVVLPQDLSQSQATPLASVSDSMAVEDAQAQETVQDDELAIWKRISDEAARMQASVRAEELMDPETLEQLVAPVEAPKPDTVHYSPEHVATAQRYEQALSEEPNSSLLLANFAQFLYQVQGDLDRAEHFFKRAARAEPADAEALGRYAAFLWQARDDLAAAEETYQEAIAADPGNAHHAAAYAHFLWNTGGEDTCYPLD

SEQ ID NO: 69004 - DNA, 711 bp, Zea mays
  misc_feature: Ceres CLONE 1546168
  misc_feature: Encodes the peptide sequence at SEQ ID NO. 69005
tggagctccccgcggtggcggccgctctagaactagtggatcccccgggctgcaggaattcgtctcacccctagaaaaaagtccagtccacgccaccaaccgcgaggcgaaccaaaccaaccccctctccccaatcccgcgcgccctaccaaccatcggcgtcggcaatggcggccatggcgaccaaggccgccgcgggcaccgtgtcgctggacctcgccgcgccgtcgcgccgccaccaccgcccgagctcggcgcgcccgcccgtccgccccgccgtccgcggtctgcgggcgcctgggcgccgcgtgatcgccgcgccggcggcggcggcagcggcggcggcggtgcaggctggtgccgaggagatcgtgctgcagcccatcaaggagatctccggcaccgtcaagctgccggggtccaagtcgctttccaacaggatcctcctgctcgccgccctgtccgaggggacaacagtggttgataacctgttgaacagtgaggatgtccactacatgctcggggccttgaggactcttggtctctctgtcgaagcggacaaagctgccaaaagagctgtagttgttggctgtggtggaaagttcccagttgaggatgctaaagaggaagtgcagctcttcttggggaatgctggaactgcaatgcggccattgacagcagctgttactgctgctggtggaaatgcaactt

SEQ ID NO: 69005 - protein, 181 aa, Zea mays
  misc_feature: Ceres CLONE 1546168
  misc_feature: SWISSPROT Homolog: EC 2.5.1.19 3-phosphoshikimate 1-carboxyvinyltransferase
MAAMATKAAAGTVSLDLAAPSRRHHRPSSARPPVRPAVRGLRAPGRRVIAAPAAAAAAAAVQAGAEEIVLQPIKEISGTVKLPGSKSLSNRILLLAALSEGTTVVDNLLNSEDVHYMLGALRTLGLSVEADKAAKRAVVVGCGGKFPVEDAKEEVQLFLGNAGTAMRPLTAAVTAAGGNAT

SEQ ID NO: 69006 - DNA, 721 bp, Zea mays
  misc_feature: Ceres CLONE 1546172
  misc_feature: Encodes the peptide sequence at SEQ ID NO. 69007
  misc_feature (666)..(666): n is a, c, t, g, unknown, or other
aagctggagctccccgcggtggcggccgctctagaactagtggatcccccgggctgcaggaattcgtctcacccctagaaaaagcaaccccagcacgtccacgccctccccctcctcctcctcgtcgtcctcccctgcctcatcccctgtctccgcgcgacgaccgagatggcgccaaccgccgccaccgccggcgcatccgacgagggcgccagcgcgctgctcgggctcctgcagcgggtgcagtcggaggcgctgcgcacgctggggcctcacgacttcgaccccaagttctacgtcgacctgccgctggcgaccgacgagcgcgccgcggcggccgcccttgcggcgctgccgcgcccgtcgccgtcgcgggcggagctagacgacttcctgtcccgctacttcggggaccccgggtccgatctcgtggcggacgtcccaccggacttcgagcccgagccgcgcgggttcctgccccacgtccacagccccgaggcgcgggcgtgggcgctggaggtgcacgcgctgtggaagcgcctggcgcggcgggtggcgcccgacgtcgcggcgcggccggaccggcacacgctgatgccgctgcccggcagggccgtcgtgccgggatccaggttccgggaggtatactactgggactcctattgngtcatcagaggattgctggtgagcaaaatgtacgacacggcaaagactattgtgc

SEQ ID NO: 69007 - protein, 184 aa, Zea mays
  misc_feature: Ceres CLONE 1546172
  misc_feature: SWISSPROT Homolog: EC 3.2.1.28 Alpha,alpha-trehalase
  misc_feature (166)..(166): Xaa is any aa, unknown, or other
MAPTAATAGASDEGASALLGLLQRVQSEALRTLGPHDFDPKFYVDLPLATDERAAAAALAALPRPSPSRAELDDFLSRYFGDPGSDLVADVPPDFEPEPRGFLPHVHSPEARAWALEVHALWKRLARRVAPDVAARPDRHTLMPLPGRAVVPGSRFREVYYWDSYXVIRGLLVSKMYDTAKTIV

SEQ ID NO: 69008 - DNA, 670 bp, Zea mays
  misc_feature: Ceres CLONE 1546175
  misc_feature: Encodes the peptide sequence at SEQ ID NO. 69009
  misc_feature (294)..(294): n is a, c, t, g, unknown, or other
  misc_feature (374)..(374): n is a, c, t, g, unknown, or other
ctggagctccccgcggtggcggccgctctagaactagtggatcccccgggctgcaggaattcgtctcacccctagaaaaaagctgacgcctccgcgcagcccctcccatggctctgcttgcgctacggttcgggccgcttctccctgccccgccccaccaccgtcgggtcctgcggaaccgatgccgagtccggatcgtcgcctccaatgcccccacccccgtgagggacgggggcgctgccgcggtggtgtggtttaagcatgatctgcgcatcgacgaccaccgggcctcgncgtacgcgtctcggagccgcggcgccccgtcgtggcagcttacgtcttctgacgacgcatcctcggccgctattcagatnaaaatgctggaactgctgctatttgctctggaagatccttagatgacgttgaaatctcaaaaatctgatttgcccataggcctgggaaacccctaaaaattttgtgctaaaacctgtgaaaagaaggaaaagcagggtccggttttttcgaaagaaaaaatttaattttgaaggggcggaagggccttgcccaagtgtgaaaacccccttacccaagggggcccttccccaaggggaaaccccccccaaaaattgggggttggggagccccctttttaaaacataaaaaaacccgt

SEQ ID NO: 69009 - protein, 102 aa, Zea mays
  misc_feature: Ceres CLONE 1546175
  misc_feature (63)..(63): Xaa is any aa, unknown, or other
  misc_feature (89)..(89): Xaa is any aa, unknown, or other
MALLALRFGPLLPAPPHHRRVLRNRCRVRIVASNAPTPVRDGGAAAVVWFKHDLRIDDHRASXYASRSRGAPSWQLTSSDDASSAAIQXKMLELLLFALEDP

SEQ ID NO: 69010 - DNA, 835 bp, Zea mays
  misc_feature: Ceres CLONE 1546178
  misc_feature (19)..(19): n is a, c, t, g, unknown, or other
tttcgttttgggggggggntttttctcttttatgttatatcgaacccacacgggggcgtaaggccgcggtggcggccgctctagactagtggatcccccgggctgcaggaattcgtctcacccctagaaaaaaagaacgaattcgcctccggctctcctcttctcgagcgttttcggcaccacggcgcagtaggatggcggcggcggccccgacgagagcagaggtgctgtcgctcttccgttccttactccgcacggcggaagaagttttcggactcacacatcggcgagtaccctcgcccgacgcgcggcggagtcctttcgcgaagtcccggggtgctgttaggaggtgggctaggcggtgggtgaggatagggataaaaaaaaaaggggacaaaagtaacacagaaatgacacccccatcttttccctccgtctgggggtgtgcctaccctccaaggatggtgggtggggggggggatgctccccccttgggggtgtggtgtgcccccccacccccaacagttgagtgttcaagctgtcgtcgtattagttcctcgcgacgccaaaccaggtggtggtgccagcggggtgctattactagctgggtggcgcgggtgcgctctcccgccgggggaccgccccccgccacggatgggggtcggcccattcccccgttctgggtttcggctggataagcagggacacttttgagtgtctggggttggtcggcggagagccgcgggggcgctttgtttttgagaccttggagaatccagtgcactttccggtgaccacattatcctgtttatgtattcgggcctccccctccccc

SEQ ID NO: 69011 - DNA, 637 bp, Zea mays
  misc_feature: Ceres CLONE 1546181
  misc_feature: Encodes the peptide sequence at SEQ ID NO. 69012
ctggagctccccgcggtggcggccgctctagaactagtggatcccccgggctgcaggaattcgtctcacccctagaaaaagcgcaggatcgtcgcgtcgcgtcgcgtctcttctcttccttcccctctcccccccgctcctctccgctccgccccgctcaaaaaccctaggcggcgcccggatcccgcgtccggctccccccagcgcctccgcccgtgctcggcgtccatcgttgccggcctccccgatggacccggcggggccgcgcgtggccacggatcccgccggatcgggtgccgcaccgccgcgcgaggaattggacaggagaggaggaggggcgtgcagcggcgccgcagcggcagaggggagcgcgtcgcggctcgcgggcgctggactgggagatccgagggctggaattctggaatcttcaggtcaagcagaagcatatttgcacacatgtaccatggatgtttctcagttgactgctgaagctgtcacccagtgtggagctagagtgtctttattaccccagattggggcacttcagtcagaaactccttgtctgaccttgggccgtgattccagtgcagaatcaatggagaagctgcatgggcagtgagtccttgccatgctgtaa

SEQ ID NO: 69012 - protein, 123 aa, Zea mays
  misc_feature: Ceres CLONE 1546181
MDPAGPRVATDPAGSGAAPPREELDRRGGGACSGAAAAEGSASRLAGAGLGDPRAGILESSGQAEAYLHTCTMDVSQLTAEAVTQCGARVSLLPQIGALQSETPCLTLGRDSSAESMEKLHGQ

SEQ ID NO: 69013 - DNA, 659 bp, Zea mays
  misc_feature: Ceres CLONE 1546183
  misc_feature (365)..(365): n is a, c, t, g, unknown, or other
  misc_feature (366)..(366): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (630)..(630): n is a, c, t, g, unknown, or other
tggagctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgcctcgnnccctcggcggccgccgccagcaggaggaaccggcggcggcgtgtcctcccggtccgggctcccgggcggccccgttgcgggttggcccaaggatttacctttggaggccccccccagaaagggataaaggggccccttgtccccctcaccccggggaaaagaaaattcttaaggggggtacgccccctctcggggggaagagatcccccccccccccccctcannnnngggggggaaataatttttttgtggcggccgccgggnaaaaaaaaagggggggactcctttttttt

SEQ ID NO: 69014 - DNA, 831 bp, Zea mays
  misc_feature: Ceres CLONE 1546184
  misc_feature: SWISSPROT Homolog: EC 3.4.25.1 Proteasome endopeptidase complex
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (60)..(60): n is a, c, t, g, unknown, or other
  misc_feature (61)..(61): n is a, c, t, g, unknown, or other
tttctcccctccctcatcccttcttacnnnnacnnnnnnnnatataannnnnnccaatanngggctcaccgcggtggcggccgctctagaactagtggatcccccgggctgcaggaattcgtctcacccctagaaaaatgagggggcaaatttcctccacaacattgaaatcggaattattcgagctgaccgtgagttcaaagttctaagcccatcagagatcaggggatttcttggaagaggtggagtaagttgtctgttgatgatttactgttccaaacaagaatagtagcatcacttacgaccagccagcctgaaccttgcccttgcttttctcactccgcaaaccggacttgcctctacccccatgtcctcggttttccccctcctctaaacttgatttgttcccggttatagtggggtttccgcggggggaggggcgggggggacacccttcttgttaggataatttttccccccccctcttcccgaattttgtttttttaactacctttctttcgccgcctggttattcggccctcctcctccttgcacaccgattccctctttgacgcctccacgtctacccctactttccgttgtgttaccgccgctgccgacactctatggttccctacccctttggcgacctccccgctatcccccccccccttcccatctggcgcatggatatcttccgcggcttgcccttccacccgagtggtgtggtgtttcccacaccgggtgtcccttccggtccctggcttctcaccactctccaccactcccacacgttgatgcgaacctccccagtatgtattcgccctcgct

SEQ ID NO: 69015 - DNA, 653 bp, Zea mays
  misc_feature: Ceres CLONE 1546185
  misc_feature: Encodes the peptide sequence at SEQ ID NO. 69016
  misc_feature (360)..(360): n is a, c, t, g, unknown, or other
  misc_feature (380)..(380): n is a, c, t, g, unknown, or other
  misc_feature (427)..(427): n is a, c, t, g, unknown, or other
  misc_feature (428)..(428): n is a, c, t, g, unknown, or other
  misc_feature (449)..(449): n is a, c, t, g, unknown, or other
  misc_feature (483)..(483): n is a, c, t, g, unknown, or other
  misc_feature (508)..(508): n is a, c, t, g, unknown, or other
  misc_feature (516)..(516): n is a, c, t, g, unknown, or other
  misc_feature (519)..(519): n is a, c, t, g, unknown, or other
  misc_feature (522)..(522): n is a, c, t, g, unknown, or other
  misc_feature (558)..(558): n is a, c, t, g, unknown, or other
  misc_feature (559)..(559): n is a, c, t, g, unknown, or other
  misc_feature (581)..(581): n is a, c, t, g, unknown, or other
ctccccgcggtggcggccgctctagaactagtggatcccccgggctgcaggaattcgtctcacccctagaaaagtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcngaacgccatcgagggcatgnaacggcaggagctggacggggcgcacatcaccgtcaacgaggcccanntcccgcgcggccgtggtagcngcggcggttggttacgggtgtggccgtgtaggcngctgctacggcggtggcggcccccntgatggcngcngcngctacggcggtggcggcggcggctacggtgggcgcnngcgctacgggtggttggtggcngccgctacggcggtgggcaaccggtgggggcggctaacggaacccccaacggggacctggaggaactggacg

SEQ ID NO: 69016 - protein, 112 aa, Zea mays
  misc_feature: Ceres CLONE 1546185
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (63)..(63): Xaa is any aa, unknown, or other
  misc_feature (70)..(70): Xaa is any aa, unknown, or other
  misc_feature (85)..(85): Xaa is any aa, unknown, or other
  misc_feature (86)..(86): Xaa is any aa, unknown, or other
  misc_feature (93)..(93): Xaa is any aa, unknown, or other
  misc_feature (104)..(104): Xaa is any aa, unknown, or other
MAASDVEYRCFVGGLAWATDDHSLHNAFSTYGEVLESKIILDRETQRSRGFGFVTFSTEEAMXNAIEGMXRQELDGAHITVNEAXXPRGRGSXGGWLRVWPCRXLLRRWRPP

SEQ ID NO: 69017 - DNA, 743 bp, Zea mays
  misc_feature: Ceres CLONE 1546190
  misc_feature: Encodes the peptide sequence at SEQ ID NO. 69018
  misc_feature (1)..(1): n is a, c, t, g, unknown, or other
  misc_feature (2)..(2): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (424)..(424): n is a, c, t, g, unknown, or other
nnttcactccgttcccctgatcttcgtaaannnnntnntggatcccccgggctgcaggaattcgtctcacccctagaaaaaaggcgcaagtgaagcgaaaaggaaaggaagctacgagatgtcggcgaccactgcagcggtgcccttctggcgggcggcggggatgacctacatcggctactcctacatctgcgctgcgctggtccggaactgcctcaaagagcccttcaagtctgaggccgcgtcccggcgagaagggttcatatccccatttccaattgtacggatggcaagcaagagaagccaactgtccgcacacaatcatattactaagggctggctccttggcgaaatagtcttttcttcggatgatttgaaccgtcgttgcaagttttttggaattgttttccaccccctgaccaanaattaaaaaatgctgaagaaaaaataagttatttgaaaaaatgtgacttttttcaaatgtctaggttgttgtcgaaataaaaaaccaaatagccatttacgataatccaagtagttataacttattggaacgtccttcccccgcttgttactgtaaaaatggtgatattttcgaacgttctaatgtggtaccacaatatggccataaaaatgaatttctttttacaccgtaggtttccgcggtatttttcttttttatggtctacacacttttgtataatcccttatttttaccccgctgtcgtatactccgcgttgta

SEQ ID NO: 69018 - protein, 103 aa, Zea mays
  misc_feature: Ceres CLONE 1546190
  misc_feature (9)..(60): Pfam Name: ATP-synt_Eps Pfam Description: Mitochondrial ATP synthase epsilon chain
  misc_feature (102)..(102): Xaa is any aa, unknown, or other
MSATTAAVPFWRAAGMTYIGYSYICAALVRNCLKEPFKSEAASRREGFISPFPIVRMASKRSQLSAHNHITKGWLLGEIVFSSDDLNRRCKFFGIVFHPLTXN

SEQ ID NO: 69019 - DNA, 669 bp, Zea mays
  misc_feature: Ceres CLONE 1546199
  misc_feature: Encodes the peptide sequence at SEQ ID NO. 69020
ctccccgcggtggcggccgctctagaactagtggatcccccgggctgcaggaattcgtctcacccctagaaaaacttgaggttgacgttgcggaacttctacaaaagcttcagagtagggacgccctggaaaaggaggtcgaactgcttcggcgacagaaagctgcttcggagcaagcggcgctggacgcaaagcacaggcaaggttcgggtggtatgtggggatggctcgctggaagtccgccaccttcacagtagttcgtacaggccgtggttcatatattttacttgtaacattacatatcatttgacatttgtctacgttctctttgtcacgtggcattcgtggttcgttacgacccacaaagaacaccctgctctggctagcgttatattgtgctcatagagaatctataggttgcctcctcacaatcactcaaatgtatcattacgttgtacacatgtactgatcatgtgagaacttccatttgacgtacaagacaaacaaaatacgagacgctcgatgtaccccactctgccgtaacgtgagtcgtattactcgcgctcactggccgtctttttacaacgtctagactgggaaaaccctggcgttaccaacttactccccttgaccacatcccctttcaccggcaggggtaaagccaagaag

SEQ ID NO: 69020 - protein, 84 aa, Zea mays
  misc_feature: Ceres CLONE 1546199
PRGGGRSRTSGSPGLQEFVSPLEKLEVDVAELLQKLQSRDALEKEVELLRRQKAASEQAALDAKHRQGSGGMWGWLAGSPPPSQ

SEQ ID NO: 69021 - DNA, 702 bp, Zea mays
  misc_feature: Ceres CLONE 1546200
  misc_feature: Encodes the peptide sequence at SEQ ID NO. 69022
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
ggggtgtcgctcagcgatcgatcaatanannnngtggatcccccgggctgcaggaattcgtctcacccctagaaaaaaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtggatccatgccatgttatgaatctagtccttcctttcttgaatcttccatgtgacgcggcgtgtgcgtcccttcatgtgtgatgatgcccgatgaatactacaaataaaacgttgtgactggcccctctctaaatcataaataaaaaaaccctaaaaaataaaaaaaaccaaaaccccccgagggaccccatttcccccctttagtgaagcccttatttaccgcgcctctctggggccggttttttttaccacccttcggtggacggggaaaaaacccttgggcgtttccccacatcttaatctccc

SEQ ID NO: 69022 - protein, 63 aa, Zea mays; identical to SEQ ID NO: 8705
  misc_feature: Ceres CLONE 1546200

SEQ ID NO: 69023 - DNA, 640 bp, Zea mays
  misc_feature: Ceres CLONE 1546204
  misc_feature: Encodes the peptide sequence at SEQ ID NO. 69024
  misc_feature (509)..(509): n is a, c, t, g, unknown, or other
  misc_feature (578)..(578): n is a, c, t, g, unknown, or other
  misc_feature (617)..(617): n is a, c, t, g, unknown, or other
ggagctccccgcggtggcggccgctctagaactagtggatcccccgggctgcaggaattcgtctcacccctagaaaatcacggccacatcatcggcgccatagccatcggcctcactcactagctgtctagctagcttccagccgcagcagcttgtcgtgcggatagatagaagcgccaagccactcgctgggccggggtacggttgttgttctgtgactctcgcacaatgccggccatggtggaggaggaggagctcatcagaggggcggcgcccgagccggagccggagccgcacctcctggtggtgaccttcccggcgcagggccacatcaacccggtgcggcacctcgcgcgccgcctgctgcgcgccacgggggcgcgggtcaccgtctccacggccgtgtccgcgctccgcaagatgttcccgggcgagcaggcgggcgcggagggccaccgcgacgccgcggggggtgtggtacgtgccctactccgacggctacgacgacngcttcgaccgcgacgcgcacgacgccacgcactacatggagcagatcaagctcgtgggcgccgccacgnctgggtgccgtcctcgaccgcctccgcggcgtgggccgncccgtcacgctcgtcgtgtaacg

SEQ ID NO: 69024 - protein, 137 aa, Zea mays
  misc_feature: Ceres CLONE 1546204
  misc_feature (94)..(94): Xaa is any aa, unknown, or other
  misc_feature (117)..(117): Xaa is any aa, unknown, or other
  misc_feature (130)..(130): Xaa is any aa, unknown, or other
MPAMVEEEELIRGAAPEPEPEPHLLVVTFPAQGHINPVRHLARRLLRATGARVTVSTAVSALRKMFPGEQAGAEGHRDAAGGVVRALLRRLRRXLRPRRARRHALHGADQARGRRHXWVPSSTASAAWAXPSRSSCN

SEQ ID NO: 69025 - DNA, 569 bp, Zea mays
  misc_feature: Ceres CLONE 1546205
  misc_feature (84)..(84): n is a, c, t, g, unknown, or other
  misc_feature (302)..(302): n is a, c, t, g, unknown, or other
  misc_feature (379)..(379): n is a, c, t, g, unknown, or other
aaagctggagctccccgcggtggcggccgctctagaactagtggatcccccgggctgcaggaattcgtctcacccctagaaaanctaaatctatcgtccgcaccagcagcgagtgaaggaggagcctgcccgcgcctgcgcctggttgtaattgtagctcacgctcaccccttcagttgaccaccgctgcggcagcaatggcggcgaagtcgccggcagcaccgccgcggcttcccgctggtcccgctgctgctgtcgctcctggcggccgcccgcgtacggccgcctcatcttccgacggnggcccgccgcgccgctcctcccggtaatcgcctcgcggcgcccccgcccaagccgaatggcaacaacctacggtttnctccctggaccccaccggggctcggaacccttccgggggtggggccaaaggtttcccttttttaaagggggcccctttctttttgggggggaaaaaaaccctcccaaaaaaaaggggggcgccgcccctttgggggggcccccccccccccccacaagagggccccccccaaaagtctcttttttttttc

SEQ ID NO: 69026 - DNA, 670 bp, Zea mays
  misc_feature: Ceres CLONE 1546209
  misc_feature: Encodes the peptide sequence at SEQ ID NO. 69027
  misc_feature (405)..(405): n is a, c, t, g, unknown, or other
  misc_feature (434)..(434): n is a, c, t, g, unknown, or other
  misc_feature (435)..(435): n is a, c, t, g, unknown, or other
  misc_feature (440)..(440): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (470)..(470): n is a, c, t, g, unknown, or other
  misc_feature (485)..(485): n is a, c, t, g, unknown, or other
  misc_feature (486)..(486): n is a, c, t, g, unknown, or other
  misc_feature (491)..(491): n is a, c, t, g, unknown, or other
  misc_feature (492)..(492): n is a, c, t, g, unknown, or other
  misc_feature (501)..(501): n is a, c, t, g, unknown, or other
  misc_feature (506)..(506): n is a, c, t, g, unknown, or other
  misc_feature (543)..(543): n is a, c, t, g, unknown, or other
  misc_feature (631)..(631): n is a, c, t, g, unknown, or other
ggagctccccgcggtggcggccgctctagaactagtggatcccccgggctgcaggaattcgtctcacccctagaaaaaaaaaaacgcacgcgagccgcgagcagaatacagcagcacgggcgccagcgccatcctgatctcgctatctcccttctcccccgatgcgatctcgccaaaccctaatcccgccgcccgccgcgcggccgtcgccggagccctagccccgaatgtggcggtgacgcgcgcggcgtgtcaccaccaccaccaactcagcgagcgtgcgcgcccgccacgccacgccacgccaccgcccgtcgtgccggccgacaccgagcagccatgggcgccgcccgacagtggctgctcccgctcgtctccgtctccgtcgtctcgctcctgctcttncctctcgcgctctcgggcttttctcgctnnctcgngctcttngnngcgctcccgcgccctcttangtgcgccgggggggnncgcgnngcgccctcnttcgnctacctgctcgcgggcggccgaggggacggcaggaanctcctgcggctgctcctccgcgtctcccacccaaggaccggtacctggttcaccttttccgcaacgggccgggattccaagggccgcnaaatttccccggggccgccgggggggcctttcccggtgg

SEQ ID NO: 69027 - protein, 110 aa, Zea mays
  misc_feature: Ceres CLONE 1546209
  misc_feature (22)..(22): Xaa is any aa, unknown, or other
  misc_feature (32)..(32): Xaa is any aa, unknown, or other
  misc_feature (34)..(34): Xaa is any aa, unknown, or other
  misc_feature (36)..(36): Xaa is any aa, unknown, or other
  misc_feature (37)..(37): Xaa is any aa, unknown, or other
  misc_feature (44)..(44): Xaa is any aa, unknown, or other
  misc_feature (49)..(49): Xaa is any aa, unknown, or other
  misc_feature (51)..(51): Xaa is any aa, unknown, or other
  misc_feature (56)..(56): Xaa is any aa, unknown, or other
  misc_feature (68)..(68): Xaa is any aa, unknown, or other
  misc_feature (98)..(98): Xaa is any aa, unknown, or other
MGAARQWLLPLVSVSVVSLLLXPLALSGFSRXLXLXXALPRPLXCAGGXRXAPSFXYLLAGGRGDGRXLLRLLLRVSHPRTGTWFTFSATGRDSKGRXISPGPPGGPFPV

SEQ ID NO: 69028 - DNA, 740 bp, Zea mays
  misc_feature: Ceres CLONE 1546218
  misc_feature: Encodes the peptide sequence at SEQ ID NO. 69029
  misc_feature (735)..(735): n is a, c, t, g, unknown, or other
aaagctggagctcaccgcggtggcggccgctctagaactagtggatcccccgggctgcaggaattcgtctcacccctagaaaaaagaggagagagtcgctcagcactgcacgactcctcccccatctaccactacctgtctacctacccagcccatcgatcacccctcgcaacgcaatggcgctggccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccggagaagaatccggcggcgccggtaaagtgggcggtcgacagctggaagtcgaagaaggcgctgcagctcccagagtacccgaaccaggaggagctggacacggtgctcaaaactatcgagacgttcccgccggtggtgttcgccggagaggcgcgccacctcgaggagcgcatggccgaggccgccatgggccgcgccttcatcctccagggcggcgactgcgccgagagcttcaaggagttccacgccaacaacatccgtgacaccttccgtatcctgctgcagatgggcgccgtgctcatgttcggtggtcaggtgccggtcgtcaaggtgggggaggatgggctggcantttgc

SEQ ID NO: 69029 - protein, 188 aa, Zea mays
  misc_feature: Ceres CLONE 1546218
  misc_feature (78)..(186): Pfam Name: DAHP_synth_2 Pfam Description: Class-II DAHP synthetase family
  misc_feature: SWISSPROT Homolog: EC 2.5.1.54 3-deoxy-7-phosphoheptulonate synthase
  misc_feature (187)..(187): Xaa is any aa, unknown, or other
MALATNSAAAAAAAVSGGAASQPHRAATFLPLKRRTISAIHAADPSKNNGPAVPAAAAAKSSASAVATPEKNPAAPVKWAVDSWKSKKALQLPEYPNQEELDTVLKTIETFPPVVFAGEARHLEERMAEAAMGRAFILQGGDCAESFKEFHANNIRDTFRILLQMGAVLMFGGQVPVVKVGEDGLAXC

SEQ ID NO: 69030 - DNA, 680 bp, Zea mays
  misc_feature: Ceres CLONE 1546222
  misc_feature: Encodes the peptide sequence at SEQ ID NO. 69031
ggagctccccgcggtggcggccgctctagaactagtggatcccccgggctgcaggaattcgtctcacccctagaaaaactagaaaaaaaaagttcatctgttatctgtatcagtctctatttttataagctgtcatgtattttctcaaaactatcttgtgttgattttgtgtgatgtgtacttttaatggcacgggccatgtatttccttggaaacgaccataagagtttgtatatggacttattttttcccccattttatttcttgcgatgggctgtgtatttgcttgaaagataaggatgatattatctttgtatttgaactctaaatgcttaaataaagtgatcatcctggatggagaaaaaaaaaaaaacaaaaaaataattattaaaaaaataaatacccccccaaatacaaaattaaaaaaaaaaataaaaaaaaataaataaaaaaaacaaaaaggtaaaaaaaaaaaaaaaccggaaccccccggggccccaattcccccaattagggatctaaataccccgcccccctgggccctttttttaaaacctcttaattgggaaaaaccttgggttttcccaaattaaacccttttaaaaaaatccccctttttccccgtggggataaaagaaaaaagcccccccaccatatccctttcccaaaaggtgcgcccc

SEQ ID NO: 69031 - protein, 49 aa, Zea mays
  misc_feature: Ceres CLONE 1546222
MILSLYLNSKCLNKVIILDGEKKKNKKIIIKKINTPPNTKLKKKIKKNK

SEQ ID NO: 69032 - DNA, 785 bp, Zea mays
  misc_feature: Ceres CLONE 1546224
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (61)..(61): n is a, c, t, g, unknown, or other
ttttttttcttttttctggttctttcccctcccattcccccccacacnnnnnaataatttnattccccgcggtggcggccgctctagaactagtggatcccccgggctgcaggaattcgtctcacccctagaaaatacatcatcggtgtcgacggctacaccacggatgatctgaggtctgccctgcagcagatgggtatactggcacggtaacaccttccggagcttccgtttccactaccaggtcaacgaagagaaacgagaaaacagacagaatggtgacgaaacaagtgcgaccgtttccatgctcgatgggaatgccgattttgcattgtaggctgtagcggttgtgttcgtgtgtgtgtgcccacacgcggtggtggcctattcttgtgctgtgaataactgcccctcctccgcctcccgatatggcgaaattttgaagtgagtacagtacaacctaacaccccccatgatggaaaaaccaatggagaaaggggaaaaacaaacaaaaatggtctggcgacggctaaaaaaaaaaaaaaaaaacgaagacgcctccgaggtaccccaatttcccccataaaggggaatccgtaattaaccgcggcgcctcactgggccgttccttttttacaaaccgctcctggaaccttgggaaaaaaaccccctgggggtttacccccaacctttaattccgccctttggcaagccgcacttccccccttttgccgcccaagtttgggcggcataacattaccggacaataagggccccctcacccc

SEQ ID NO: 69033 - DNA, 694 bp, Zea mays
  misc_feature: Ceres CLONE 1546229
  misc_feature: Encodes the peptide sequence at SEQ ID NO. 69034
  misc_feature (551)..(551): n is a, c, t, g, unknown, or other
ctggagctccccgcggtggcggccgctctagaactagtggatcccccgggctgcaggaattcgtctcacccctagaaaaactcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagtgtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaggtcattcctgggcccggtgagaagcaatgatagttgttcagccaaggggggaggagaacagtttgcagcccgngagatctcctccatggtctcatcaagatgcgtgagatccctgaagcttacttggccagccgatcaagaagctgttgccagggtccctgctacttaacaaattcaaaaggcggccccaaagatcctgggtgaatcctgccccat

SEQ ID NO: 69034 - protein, 151 aa, Zea mays
  misc_feature: Ceres CLONE 1546229
MAGKGDGPAIGIDLGTTYSCVGVWQHDRVEIIANDQCNRTTPSYVAFTDSERLIGDAAKNQVAMNPINTVFDAKRLIGRRFSDASVQSDIKLWPFRSFLGPVRSNDSCSAKGGGEQFAAREISSMVSSRCVRSLKLTWPADQEAVARVPAT

SEQ ID NO: 69035 - DNA, 732 bp, Zea mays
  misc_feature: Ceres CLONE 1546230
  misc_feature: Encodes the peptide sequence at SEQ ID NO. 69036
  misc_feature (637)..(637): n is a, c, t, g, unknown, or other
  misc_feature (732)..(732): n is a, c, t, g, unknown, or other
ggagctcaccgcggtggcggccgctctagaactagtggatcccccgggctgcaggaattcctctcacccctagaaaaatccctccccacctgcaccaccaccaacaccaaccaacaggtggcgagagcgagagcgagagcaaagagctgagcgggacggagcagctagcgctagggataacgcacacccaccaccatggcgacgcccggagagcagccggcggaggtcgtgtccgtcgagatgcccgcacccgacgggtggaccaagaagtttactcccttgagaggggggagatctgaaattgtttttgtttccccaacgggcgaggacattaacaacaggatgcaattaagccactacctaaagggcggcggggggaggccctgctgtttccgaagtttgatccccccaccggggcaacccccacggcgtcctggctcttttctgcggcaaaggcaggggtttttcgtaggccccgggcgggaggccgctctcccaagccccggcacggcccctcccgggggagggcaggggccaagaagcggaaaaaagagagactccctgaagccgcaagaaacccgaaagtggttccacactgcgttcggggtgagaagagggcgccccactcgccagcgcncgacaagacgacactagcctagtgaaggacaccgccatctttggccagtgatcaggggggtgccgcctgctaaccaggaagcaggcccaagcgcn

SEQ ID NO: 69036 - protein, 152 aa, Zea mays
  misc_feature: Ceres CLONE 1546230
  misc_feature (8)..(74): Pfam Name: MBD Pfam Description: Methyl-CpG binding domain
  misc_feature (148)..(148): Xaa is any aa, unknown, or other
MATPGEQPAEVVSVEMPAPDGWTKKFTPLRGGRSEIVFVSPTGEDINNRMQLSHYLKGGGGRPCCFRSLIPPPGQPPRRPGSFLRQRQGFFVGPGREAALPSPGTAPPGGGQGPRSGKKRDSLKPQETRKWFHTAFGVRRGRPTRQRXTRRH

SEQ ID NO: 69037 - DNA, 684 bp, Zea mays
  misc_feature: Ceres CLONE 1546231
  misc_feature: Encodes the peptide sequence at SEQ ID NO. 69038
  misc_feature (395)..(395): n is a, c, t, g, unknown, or other
  misc_feature (396)..(396): n is a, c, t, g, unknown, or other
ctccccgcggtggcggccgctctagaactagtggatcccccgggctgcaggaattcgtctcacccctagaaaaaaggtggaaaaccctttcaccgtcctcctgcgtcgccactcgccagagcggagcagcgagcggcgcgcgcgatggcaggcggcggtctccagggagccaagaagcgcaagcgcgagcacgcggaagggaagacaaagcctcggaagcaagtcaagggaggcggggacggagcgaagcggaagagccactcggccgccggcggctacactgcccatggcggcgccggcgaagttgtggcgaggaagaagaccccggttacccccaaggagaagcgcctcgcggccaaggaaatgtcggaggccaggaagatgaagaggaggcnnctttacagccttgagaaggaactaacgaaattgtggggaaaagatgagatgtcacgatgtgagcaaaaaggagaggtccaaggcagtaaattcaggctatccctaaaatggatgggaaaattttgggacattgcccccttcacttgttactggacgtggtccttcaaacatgtggaaaaggggggctcccgaatcaaaaaaggggagcccttctttggaggtcccaaaaccccctttggcttgccccctttctggaaagaaaaattgcccgtttttccttgtaaagaa

SEQ ID NO: 69038 - protein, 180 aa, Zea mays
  misc_feature: Ceres CLONE 1546231
  misc_feature (84)..(84): Xaa is any aa, unknown, or other
MAGGGLQGAKKRKREHAEGKTKPRKQVKGGGDGAKRKSHSAAGGYTAHGGAGEVVARKKTPVTPKEKRLAAKEMSEARKMKRRXLYSLEKELTKLWGKDEMSRCEQKGEVQGSKFRLSLKWMGKFWDIAPFTCYWTWSFKHVEKGGSRIKKGEPFFGGPKTPFGLPPFWKEKLPVFPCKE

SEQ ID NO: 69039 - DNA, 730 bp, Zea mays
  misc_feature: Ceres CLONE 1546233
  misc_feature: Pfam Name: Tyrosinase Pfam Description: Common central domain of tyrosinase
  misc_feature: SWISSPROT Homolog: EC 1.10.3.1 Catechol oxidase
  misc_feature (588)..(588): n is a, c, t, g, unknown, or other
  misc_feature (615)..(615): n is a, c, t, g, unknown, or other
caaagctggagcttaccgcgggtggcggccgctccagaacaagtggaacccccgggccggaggaattcgtcttacccctagaaaaagtggcgcgcgtgtttgttttctggccatctgctccatttgctcggggagcctgattaataaagcatttaggcgcgcgcgaagcaacaaactataggtctgggctagctatggccggtagcaaccggcactctgctgctcgcactccgcatcgtcctcttctgcgccctcccctccgtggccacccaccttgttcccgctcgtcacaaggccatgcgcctactccctgccaagaaccatcctcgccgccagcggcctcgaccctcacctcatctcctgcgccgacgacggctccgccaaggcccagctgtcggatggcgatggaggccacaacaaggccggtagcggcggcaggcccatagtcaccgacctgctgtcgtgcggcgagccccgcctcccatcccacgcgctcccgcccttccgctgctgcccgccgacgccggcgtccgacgctgccgtcgccaacttcacgttcccccgaccaggcgagccgctccggacgcngcggccagcgcacggggcccgcggcgncgacagcgtcgcccagtacgcgcgcgccgtggcgcttaatgaagcccttcccgagtcggacccgcgcagcttctaccagcaagccaacattcactgcgcctactggaccagcggc

SEQ ID NO: 69040 - DNA, 609 bp, Zea mays
  misc_feature: Ceres CLONE 1546240
  misc_feature (29)..(29): n is a, c, t, g, unknown, or other
  misc_feature (30)..(30): n is a, c, t, g, unknown, or other
  misc_feature (240)..(240): n is a, c, t, g, unknown, or other
  misc_feature (265)..(265): n is a, c, t, g, unknown, or other
ctgggagctccacctgcggtggcggccgnnctctagaaaactagtggatcccccgggctgcaggaattcgtctcacccctagaaaaagtaacaactcccccaatccgtcccgtcggccggacgagcagggcccaagggcccaccttaccatggcgaccgccactgccgcccccgtccccgccggcgtgcacccgtacctgcgcgcccgcactcgctgcggcccaccgtcgcctgcaccgnctgcggcttcccggccgcagcagcnagccgcttcgtcttccctgccggcccgtcgtccatgctgccaccgctgcaaatgaagcgggcgcctggtgccggaactggtttgccctttcaacgagctaccgaacggatggggggaggactgtggaactccctccccgtaaaaccggccttccggtgctgaaaattggggcccccgccccccccaaaaggaaggggggccggggaatttaaaggggttttccctttttcccaaacccccggtgaacccccaaaaagggggggggaaaaaaattccccccgccgattctaaaaaaaactttttttttccccggcccctttaaaaaaaggggggggtgaaaaaac

SEQ ID NO: 69041 - DNA, 699 bp, Zea mays
  misc_feature: Ceres CLONE 1546242
  misc_feature: Encodes the peptide sequence at SEQ ID NO. 69042
  misc_feature (191)..(191): n is a, c, t, g, unknown, or other
  misc_feature (202)..(202): n is a, c, t, g, unknown, or other
  misc_feature (264)..(264): n is a, c, t, g, unknown, or other
  misc_feature (324)..(324): n is a, c, t, g, unknown, or other
  misc_feature (344)..(344): n is a, c, t, g, unknown, or other
  misc_feature (388)..(388): n is a, c, t, g, unknown, or other
  misc_feature (394)..(394): n is a, c, t, g, unknown, or other
  misc_feature (432)..(432): n is a, c, t, g, unknown, or other
  misc_feature (650)..(650): n is a, c, t, g, unknown, or other
tggagctccccgcggtggcggccgctctagaactagtggatcccccgggctgcaggaattcgtctcacccctagaaaaagcccacacaacaaagcacaccacccccaccccccgaaacggacgccacccctccccgcctcgtctcgctccgctccggcccgttccggctctcgccaccccagccgagatgnggtcgccgccncccccaccgtggcgcgccgggcgcctccattccccgctccccatgctcctgctcttcgtcgnggcgctggcggcgcgggcgggggccgaagacctctcgagcgacgcgcgggcgctcctggngttccgcgacgccctgaggnggcgcctgatttgcaacgcctcggacgtggggggggcgtgctcntccacnggggtctcctgccagaacggacgcgtcgcggggctgcngcctccccggggccaccctctcgggggcagtccccccggggaagctcgggaacttgacggggcttcccactcttaagcttccggctcaagggggcttatcggggggggtccccggtcaaactcctcctccggcggcgggttttacggaaggccttcttcaaggggaaaccggctgctccggggggttccccccaggggaaatcattctgcttcagggngcctggaagggttctcctcagggagggaaaaacctgttcagggccccac

SEQ ID NO: 69042 - protein, 106 aa, Zea mays
  misc_feature: Ceres CLONE 1546242
  misc_feature (2)..(2): Xaa is any aa, unknown, or other
  misc_feature (26)..(26): Xaa is any aa, unknown, or other
  misc_feature (46)..(46): Xaa is any aa, unknown, or other
  misc_feature (53)..(53): Xaa is any aa, unknown, or other
  misc_feature (82)..(82): Xaa is any aa, unknown, or other
MXSPPPPPWRAGRLHSPLPMLLLFVXALAARAGAEDLSSDARALLXFRDALRXRLICNASDVGGACSSTGVSCQNGRVAGLXPPRGHPLGGSPPGEARELDGASHS

SEQ ID NO: 69043 - DNA, 715 bp, Zea mays
  misc_feature: Ceres CLONE 1546245
  misc_feature: Encodes the peptide sequence at SEQ ID NO. 69044
  misc_feature (406)..(406): n is a, c, t, g, unknown, or other
  misc_feature (479)..(479): n is a, c, t, g, unknown, or other
ctggagctccccgcggtggcggccgctctataactagtggatcccccgggctgcaggaattcgtctcacccctagaaaaagtgtctgtcgtttcggctgtgagcctgtactgagacagacatgctcgacagggagagggagaccgaaagaagggtgagcggcactagccagcatggtggcggtcgtcctagctctcaatccgcctcctccgctgctggccacggcctttcctttctcatccccctcgcggtttgccacctgccttcatctccccgagtaatcccctgagaagattgctcctccgccccattccgtgcgcctcatcgacgtcttccatcttgatgccgaacacggaactcgaagactgagcctgcccactatggacatgagagatggagatgaggcnccgccggattcgaggccccgcctcatctgacttttcctcaagacgtctcccttcgactacgtctcccgttacncgaaccacttccagagctttgtaatgtacgtaccggatatgggcgacaaggtgattgtggtcactacgctcgagggcgtgccatcggaattcctcgcagacaagctaattggctcatggagcttcgcttgccgctcggatcaagagttccggtgtgcactgccctctctcctctatcatctatgaagtagtggattcaggctgaacttattgacgctgcttccctgggaaatgcaa

SEQ ID NO: 69044 - protein, 53 aa, Zea mays
  misc_feature: Ceres CLONE 1546245
MYVPDMGDKVIVVTTLEGVPSEFLADKLIGSWSFACRSDQEFRCALPSLLYHL

SEQ ID NO: 69045 - DNA, 783 bp, Zea mays
  misc_feature: Ceres CLONE 1546246
  misc_feature: Encodes the peptide sequence at SEQ ID NO. 69046
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (568)..(568): n is a, c, t, g, unknown, or other
  misc_feature (675)..(675): n is a, c, t, g, unknown, or other
  misc_feature (690)..(690): n is a, c, t, g, unknown, or other
aaaagctggagctcaccgcggtggcggccgctctagactagtggatcccccgggctgcaggaattcgtctcacccctagaaaaaatcaaccagcgactcacacacccgcgcgccgcttctgtagggccccaaccaaccgcgcagggagaaaaccaccacagcacatgcagcgcctcgcctcctcccggaggctcctccaggccgcgctcgcccccgcccgggccaactccagcctctccgcggccgccgtcgccgcgcccgcgccagcgaatggccccttccccaagatgccggccttcactacacgccgccgccgaacaacgggccgcccgcccaagaaatctttccggaaacgcgcttattttccccagcccaagccctgggtgatttccatccatcgccccctttgacccccccccaaaaggaaaaaatccccttcccttttgtttaataaggaatggccccgcccttcaccccggaaaagcctcttccgggtggcctttgccaaaccatttttgtttggggggggagtggtccttttcaaaatattgggnnnaaaacccccatntacacccccccccccccatgggtgattccccccctcccccctctcttctttattttgtcaatacatagctaatcgcgcaaatttttccccaaaacaccaccgaaaantaaaaaaaaacctcnaaagaaaaataaaaaggagttatttttttttgtatattattctgccgcttaaggaatatacttttatttcgcaatatgccttttcaacataat

SEQ ID NO: 69046 - protein, 81 aa, Zea mays
  misc_feature: Ceres CLONE 1546246
MQRLASSRRLLQAALAPARANSSLSAAAVAAPAPANGPFPKMPAFTTRRRRTTGRPPKKSFRKRAYFPQPKPWVISIHRPL

SEQ ID NO: 69047 - DNA, 726 bp, Zea mays
  misc_feature: Ceres CLONE 1546248
  misc_feature: Encodes the peptide sequence at SEQ ID NO. 69048
ctggagctccccgcggtggcggccgctctagaactagtggatcccccgggctgcaggaattcgtctcacccctagaaaaattctaaactctactgccgtacagtctatgcaacgcctgaagagcacggcgctgcccggagaaggatgcgtgtaaggtgtaactatcgcctactgcagctcaggttgtttctgatagtcttctcttctgccgtccatccggcctgcgcgctcgctctcctgctcttctgcgccaactgggcgaccgccgacgccaacgccgacgacctacgccaggtgctgggatttttgtcggttccttcggcagctttcgtcgcgtccttcgccggcgacgagcactcaccaggtccgctcctgaagaagactgggatattttgcatacacagaggatcatctgtaagttaaatcttctgaaatctggatccaacatttgtaccatactggtgaatatccttgctttacttttgagtcatgtttgaattaacctttctttccccaccatgcaatagttccgtttgatgaactcacgggaatggtgatgctcattttctaaaggaccggtcccctttttgtttatttccaaaggtaccatgattactaaataatgatttattagaaattaatgactgatggggtcaagatgtgtgaaactgttaagagcttgagatctgctgattgacacaccaaaagggaaaatgaaaggtgtct

SEQ ID NO: 69048 - protein, 92 aa, Zea mays
  misc_feature: Ceres CLONE 1546248
MRVRCNYRLLQLRLFLIVFSSAVHPACALALLLFCANWATADANADDLRQVLGFLSVPSAAFVASFAGDEHSPGPLLKKTGIFCIHRGSSVS

SEQ ID NO: 69049 - DNA, 735 bp, Zea mays
  misc_feature: Ceres CLONE 1546252
  misc_feature: Encodes the peptide sequence at SEQ ID NO. 69050
  misc_feature (23)..(23): n is a, c, t, g, unknown, or other
  misc_feature (617)..(617): n is a, c, t, g, unknown, or other
  misc_feature (665)..(665): n is a, c, t, g, unknown, or other
  misc_feature (672)..(672): n is a, c, t, g, unknown, or other
aaagctggagctccaccgcggtngcggccgctctagaatagtggatcccccgggctgcaggaattcgtctcacccctagaaaaaacctccgctccgctcccgtcccgccatgggcaactccctcgcctgcttctgctgcgcgggcggcgccgcggggcacgtggcgcccgccgcgctcccctcggaccccgcctacgacgagggcctcggccactccttctgctacgtccggcccgataaggtgctcgtgcccttctccgcggacgacgacctggtcgccgacgccaaggcggccgaggacgccaccacgttccgggccatctcgggggccgcgctcagcgccaacgtctccacgccgctctccacgtccctcctcctgctgctgccggacgagtcggcggcctcctcctccggcttcgagagctccgagtcgttcgccgccgtgccgctgcagccggtcccgaggttcccgtcggggcccatctgcgcgcccgccgggacgggggtcgggggccgggttcctctccgggccatagaaggagggggttcctctcgggccccctcgacgccgcgctcatgtcgtccggcccgctccctggcgcccgcacgtcccgccncatggggaggcgccgtgccctcgctccgccggagccctgtcgcacgcngccgccncctgcgggatctcaccccgcgcgatcctcgcgcggacggagaggcttcaggggtcgattggac

SEQ ID NO: 69050 - protein, 208 aa, Zea mays
  misc_feature: Ceres CLONE 1546252
  misc_feature: SWISSPROT Homolog: EC 3.1.3.16 Phosphoprotein phosphatase
  misc_feature (170)..(170): Xaa is any aa, unknown, or other
  misc_feature (186)..(186): Xaa is any aa, unknown, or other
  misc_feature (188)..(188): Xaa is any aa, unknown, or other
MGNSLACFCCAGGAAGHVAPAALPSDPAYDEGLGHSFCYVRPDKVLVPFSADDDLVADAKAAEDATTFRAISGAALSANVSTPLSTSLLLLLPDESAASSSGFESSESFAAVPLQPVPRFPSGPICAPAGTGVGGRVPLRAIEGGGSSRAPSTPRSCRPARSLAPARPAXWGGAVPSLRRSPVARXRXLRDLTPRDPRADGEASGVDW

SEQ ID NO: 69051 - DNA, 690 bp, Zea mays
  misc_feature: Ceres CLONE 1546256
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaacatggatagctctgatagcgttgtctatatgaacatcaatgccgcttgaagcctgaatgtcaggcgcacggattcagaaatatatgatgtggtagtactccatacaatgttccatctcgcgactacaatgctgcaactgcgtaaggcatgatatgtaccgcgtgtgaattcgagcatgtagaatttttagatcgcttcatgtgcacgaatctgtctgatacacagtacctaaattgtaatgtgatgtgtcatgacaactgatcgtatttgctcgataagacaatcacttcatccaacttaatcgccttgcagcacatccccctttcgccagctggcgtaatagcgaagaggcccgcaccgatcgcccttcccacagttgcgcagcctgaatggcgaatggaaattgtaagcggtaatattttgttaaaattcgcgttaattttttgttaaatcagctcatttttttaaccaataggccgaaatcggcaaaatcccttataatccaaagatagaccgagatagggttgactgtttttccagttggaaacaagagtccactattaaagaccgtggactccaacctcaaaaggccaaaaaactgtttatcagg

SEQ ID NO: 69052 - DNA, 636 bp, Zea mays
  misc_feature: Ceres CLONE 1546260
  misc_feature: Encodes the peptide sequence at SEQ ID NO. 69053
ctggagctccccgcggtggcggccgctctagaactagtggatcccccgggctgcaggaattcgtctcacccctagaaaaaactgacacgctcgcctaattataaccacaccgcctagcgccactccccacgtcactcgctgtctgttgtagcaccgcaccagtcttcgccgccggtccgcgggcagatcaagagatggccacggcgatttacctctcctcctcggtggcgccgtcgtcgtgtgcccgcctgcggcggcagactaccagggcgaccgcgtcggcgacggatcgtccgcgcgaggtcgtgtccccgaagcgtcggcttccgctgcggaaggtgccgggcgactacgggccgccggtgctgggcgcgatccgcgaccggttcgagtacttttacgggcccggcggccgcgacgggttcttcacctcccgcgtgcgcgcgcacggctccaccgtggtgcggctcaacatgccgccgggccccttcgtggcgcgcgacccgcgcgtggtggcgctcctcgacgccgcctcgttcccggtgctcttcgacacctcgctcgtcgacaagacggacctcttcacgggaaccttcatgccgtccaccgagctcaccggcgggctaccgcgtgctc

SEQ ID NO: 69053 - protein, 147 aa, Zea mays
  misc_feature: Ceres CLONE 1546260
  misc_feature: SWISSPROT Homolog: EC 4.2.1.92 Hydroperoxide dehydratase
MATAIYLSSSVAPSSCARLRRQTTRATASATDRPREVVSPKRRLPLRKVPGDYGPPVLGAIRDRFEYFYGPGGRDGFFTSRVRAHGSTVVRLNMPPGPFVARDPRVVALLDAASFPVLFDTSLVDKTDLFTGTFMPSTELTGGLPRA

SEQ ID NO: 69054 - DNA, 629 bp, Zea mays
  misc_feature: Ceres CLONE 1546261
  misc_feature (152)..(152): n is a, c, t, g, unknown, or other
  misc_feature (361)..(361): n is a, c, t, g, unknown, or other
  misc_feature (415)..(415): n is a, c, t, g, unknown, or other
  misc_feature (482)..(482): n is a, c, t, g, unknown, or other
ggagctccccgcggtggcggccgctctagaactagtggatcccccgggctgcaggaattcgtctcacccctagaaaaaatcgtctgcagtcgcgtgactcgactttaccccgctgctccgcttccctctctcgtgctcgccgccccacagcntcgaagacgacgaggtggcctcagcacacgcgcgcgcaaccatggcagcattatcagcgaagaccatacaaaatgcattcttggcacaacacacacggaataggcatggtgcaagatatccccagtgatttttgttctctcaatacccgcagcatgcattccttccagaaatgtagattggcagtggctgatttctcagcccaatgggntaataccacatcgacgctatggactagctttcacaaacagcaggcattagctgncatgctgctcaaggtggcactggtgtgtgtcatctgaaaaagtggagttctgaagctcaaaatgcantggatatcctggtgttcctgttgctgggggttaaagggaacccttccaccctcccgaaaatgtccctaaactttagccggcccttttggctgcatggcttgtaaaaaaaaacccaaagggcttggaactttaaaaaaccccggtgga

SEQ ID NO: 69055 - DNA, 688 bp, Zea mays
  misc_feature: Ceres CLONE 1546270
  misc_feature: Encodes the peptide sequence at SEQ ID NO. 69056
ctcaccgcggtggcggccgctctagaactagtggatcccccgggctgcaggaattcgtctcacccctagaaaaacgtcctgcaccagcacactgcacccggctacatggcggccgcctccaccctcgcgttcgggcacccaaaaaccctagccgccgccggcgccaagcccctgcccgccgccacctccacgtccgtctccttcccggccacccaccagcccgcgtgcctgctctcctcgcccgcgcccgggtctctgcgccgccaggacgtcgccgccatggtctccgcgccgccagccgtcggcaccgccatgccgtcgctcgacttcgacacctccgtcttcaacaaggagaaggtctccctcgccggccacgacgagtacatcgtgcgcggcgggaggaacctgttcccgctgctttcggaagcgttcaagggggtcaagcagatcggagtcattggatggagctcgcaaggtcctgcccaagcccagaacctgagagattcactggctgatgccaaggcagattatgttgtggaagattggtctccaggtaaagatccaaatctgtttgaaggaaagcacgggcctgctggtatcccccgaatagggcggtaactttgagccgatatttggggaaaaccggctcccggcaaccgattccttggggtgccggccgaaaatccca

SEQ ID NO: 69056 - protein, 170 aa, Zea mays
  misc_feature: Ceres CLONE 1546270
  misc_feature: SWISSPROT Homolog: EC 1.1.1.86 Ketol-acid reductoisomerase
MAAASTLAFGHPKTLAAAGAKPLPAATSTSVSFPATHQPACLLSSPAPGSLRRQDVAAMVSAPPAVGTAMPSLDFDTSVFNKEKVSLAGHDEYIVRGGRNLFPLLSEAFKGVKQIGVIGWSSQGPAQAQNLRDSLADAKADYVVEDWSPGKDPNLFEGKHGPAGIPRIGR

SEQ ID NO: 69057 - DNA, 662 bp, Zea mays
  misc_feature: Ceres CLONE 1546280
  misc_feature (1)..(1): n is a, c, t, g, unknown, or other
  misc_feature (61)..(61): n is a, c, t, g, unknown, or other
  misc_feature (68)..(68): n is a, c, t, g, unknown, or other
  misc_feature (228)..(228): n is a, c, t, g, unknown, or other
  misc_feature (237)..(237): n is a, c, t, g, unknown, or other
  misc_feature (314)..(314): n is a, c, t, g, unknown, or other
  misc_feature (315)..(315): n is a, c, t, g, unknown, or other
  misc_feature (341)..(341): n is a, c, t, g, unknown, or other
  misc_feature (356)..(356): n is a, c, t, g, unknown, or other
  misc_feature (357)..(357): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (443)..(443): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (654)..(654): n is a, c, t, g, unknown, or other
naagggtggagctccccgcggtggcggccgctctagaactagtggatcccccgggctgcangaattcntctcacccctagaaaaagagactctttcatttccttctaccgcagcctcagaattcccccctcccccgtagcgaaaccctagccgccacgccaaaaccaaatcccgggcgagcccgaaattttccgggcgggttccttgcccgcgaatcgattggattcnagcgattcnactcctttgtgatctctcggcggggtagagcgcggtccaccgtcggccatgttttagcgcttgggcgagggggcacnngggtacctgttttttccaggaggcgnggcccaaccccgaanntatttttttttttccccaccccagggggaaagaaagggggnnnnnnnnnnnnnnnnnnnntnnnttttccaaaaaaaaaaaaaaanaannnntttgggggggggggggggnnnnnnttttaaaaattttaaatgggggaaaaaatttggtttattaaagtttagtagtttgttggtatggttttgttttaaagtgggatattaataaaaagggtttttggggggggggtttttttaaggggtgggggttataataggagaaaattataatgtgaatggatgttagtatgagaggggnaagaagta

SEQ ID NO: 69058 - DNA, 653 bp, Zea mays
  misc_feature: Ceres CLONE 1546291
  misc_feature: Encodes the peptide sequence at SEQ ID NO. 69059
  misc_feature (453)..(453): n is a, c, t, g, unknown, or other
tccccgcggtggcggccgctctagaactagtggatcccccgggctgcaggaattcgtctcacccctagaaaaatgtgcatctcagcagcactagcagtgacaaactcgaagcttgccttctagcttgtttacaccccaaaactaaaactagagtcggcggcggcaacaagcggtacgtagaggatgaagagcaggagcagcactctgttggtgatcctagttctccaggcccttctgctctctgcggctgtggccaaaggacctgcagggccgaataagcagtgctggtgcggcgagtgcaccagctggtcgggcgtgtggacctgcgacgacctcctcaccaagtgcgccgccacctgcaagaactgcgggcgcgtctccacggacaagggcgccaccaagtacagatgccgcgacttcctccccgaaaactgcggctgcaagatccactanagactcatccaatcaaccatggccacagccgatggacccttcttccatatgcatgctctcctcggtccgtccgcctagcttgctacaagcaggccctaataagctagcaagctgttgttggtaaaaaaaaaaaaaaaaacaagaccctcgaggtacccattcccccctatagggggtcgaattacccgcgctccctggcc

SEQ ID NO: 69059 - protein, 115 aa, Zea mays
  misc_feature: Ceres CLONE 1546291
  misc_feature (90)..(90): Xaa is any aa, unknown, or other
MKSRSSTLLVILVLQALLLSAAVAKGPAGPNKQCWCGECTSWSGVWTCDDLLTKCAATCKNCGRVSTDKGATKYRCRDFLPENCGCKIHXRLIQSTMATADGPFFHMHALLGPSA

SEQ ID NO: 69060 - DNA, 669 bp, Zea mays
  misc_feature: Ceres CLONE 1546293
  misc_feature: Encodes the peptide sequence at SEQ ID NO. 69061
  misc_feature (145)..(145): n is a, c, t, g, unknown, or other
  misc_feature (146)..(146): n is a, c, t, g, unknown, or other
  misc_feature (270)..(270): n is a, c, t, g, unknown, or other
  misc_feature (294)..(294): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (323)..(323): n is a, c, t, g, unknown, or other
  misc_feature (324)..(324): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (364)..(364): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (499)..(499): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (609)..(609): n is a, c, t, g, unknown, or other
  misc_feature (611)..(611): n is a, c, t, g, unknown, or other
  misc_feature (614)..(614): n is a, c, t, g, unknown, or other
  misc_feature (619)..(619): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
ggagctccccgcggtggcggccgctctagaactagtggatcccccgggctgcaggaattcgtctcacccctagaaaaatctccatgttcggcttcttcgtccaggccatcgtcaccggcaaggggcccctcgagaacctgctcgnnacactcgacgaccccgtcgccaacaacgcctgggtctacgccacaagttcgcaccagggtcttaagctagctaccgggcccgcgcgtgcccagacattgggttgtacactactcgtttctgtcntgatctgtaccatgtacgaatgcnatttttcttgggctctaaaaaaannnttnncccnnnataatacctttttaaaagggaaaaaattttaaancccaaaagcccttgaggaacccatttcccccatataggaggtcttttttcccccccccctcgggggcccgttttttacacctccggggtgggggaaaacccccgggttttcccacccttttatnnnnnnnngggnctgtggggagagagaaaaaaaaacacaccccccttttttttttttttttggtgtnnngggggggggggggggggggnnngnnnnaaggaaaaaaagaaagagaggatgtngnggnggccncgccccccctccttttttctctttttttcctctnnnntcccccctccccg

SEQ ID NO: 69061 - protein, 92 aa, Zea mays
  misc_feature: Ceres CLONE 1546293
  misc_feature (21)..(21): Xaa is any aa, unknown, or other
  misc_feature (63)..(63): Xaa is any aa, unknown, or other
  misc_feature (71)..(71): Xaa is any aa, unknown, or other
  misc_feature (79)..(79): Xaa is any aa, unknown, or other
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
MFGFFVQAIVTGKGPLENLLXTLDDPVANNAWVYATSSHQGLKLATGPARAQTLGCTLLVSVXICTMYECXFSWALKKXXXXXNTFLKGKKF

SEQ ID NO: 69062 - DNA, 656 bp, Zea mays
  misc_feature: Ceres CLONE 1546301
  misc_feature: SWISSPROT Homolog: EC 3.2.1.23 Beta-galactosidase
acccgcggtggcggccgctctagaactagtggatcccccgggctgcaggaattcgtctcacccctagaaaaagagccgacccgacctcgtgcggtgtgtaggtcgagagagagagagacggcacgagcgatgaagagaaggagcttagggagcggttgactggtcgggaccctgatctcacggaccaggagaggctgatgatcagagagtacttggaacagtacgcggatgccgccgagcgctaggagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagatagggttgagtgttgttcccagtttggaacaagagtccactataaaagaacgtggactc

SEQ ID NO: 69063 - DNA, 655 bp, Zea mays
  misc_feature: Ceres CLONE 1546303
  misc_feature: SWISSPROT Homolog: EC 3.2.1.23 Beta-galactosidase
acccgcggtggcggccgctctagaatagtggatcccccgggctgcaggaattcgtctcacccctagaaaaacgcaactgcgacggccgcgtcgacttcggcgagttcaagaacatgatgcaggggatcaccgtgtggggcgcttagctgccgcgcacctgcgttgtcacaccccctctactgcgtggtgtcatgtatgtatccaggcaccgtaggatgcgcttttctacctggcgcttcttcctcctcttgatggcgcagtggattcttcctgttcttggctttgctatctgactctgcttgtagtcttgagaatctggcggcacacagacatagttttctttagtttcttgtgtttgatttactccgtgtttaattgcacagtttatttacatgtaagaacgttgaccttgaccagcttccctacaagtttatctttccttcaaaaaaaaaaaaaacgaactccagaaataatccgccctcgtatcctcacgcccataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgcca

SEQ ID NO: 69064 - DNA, 653 bp, Zea mays
  misc_feature: Ceres CLONE 1546306
  misc_feature: SWISSPROT Homolog: EC 3.2.1.23 Beta-galactosidase
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
gcggtggcggccgctctagaactagtggatcccccgggctgcaggaattcgtctcacccctagaaaaatgcatgcaagcagtccttctttataagcatgcaagcaaactatctgttccattagattacgatccaaccacagatataaccatgatttattagaggagttttttataaagattattgagctggtggtgaaaaggtttaagtgttaaatgtgacctacggttagattacgatctaatgaaccagatggtttgcttgaacgcttgcaaaaaaagactgtttgcataaccgtcgttgcctttagtagccttactggccggccgttttcacgtcagaatatttaacagtgtacactacatctacacgtaattcagggcggcgactctgtacaatcaaagtttatatacaagcgtaaaaacgagtcttttaaaaaaannnnnnnnnnnnnnnaannnnnnnnnnnnnggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgaagcacatccccctttcgccagctggcgtaatagcgaagaagccc

SEQ ID NO: 69065 - DNA, 661 bp, Zea mays
  misc_feature: Ceres CLONE 1546313
  misc_feature: Encodes the peptide sequence at SEQ ID NO. 69066
  misc_feature (632)..(632): n is a, c, t, g, unknown, or other
gcggtggcggccgctctagaactagtggatcccccgggctgcaggaattcgtctcacccctagaaaaacacgtcctgctccgtccgaatcgctactccgccgcgcttctcatcaccgtcaagagatagtcagacagttccagccccctttccacacgcacactcctctcccttcctctcctccgcttccatccctgggctgtgcgctactactccccctgctggccgctgctctgctctcacgcatgttttcacatccaagcgcctgcccctcgccctcgccgccacagtggtaacccgatccatgccgggcggcggccgctgacttgctgctgttggcttcaacggccgcaggcaaagttactgctggtagcgctagcgcggcgcggcggcggcggcgtaggaggaggggtcggcggcggagatgaggatgaagacgctggcgtgctgccggcggcggcctcaagacttcagcatcgatatggaccaagagcccgacagggtggtgacatataatggcctcgagacctgcattatcaacagttccacctatgacgatgacagtggcatcagtgcaacaacagggcgagatggctgtactcacactgattcccttgatgatgaagtctctangtgctctagtaaagatgcttcttgttctt

SEQ ID NO: 69066 - protein, 79 aa, Zea mays
  misc_feature: Ceres CLONE 1546313
  misc_feature (70)..(70): Xaa is any aa, unknown, or other
MRMKTLACCRRRPQDFSIDMDQEPDRVVTYNGLETCIINSSTYDDDSGISATTGRDGCTHTDSLDDEVSXCSSKDASCS

SEQ ID NO: 69067 - DNA, 908 bp, Zea mays
  misc_feature: Ceres CLONE 1546317-R
  misc_feature: SWISSPROT Homolog: EC 3.6.3.44 Xenobiotic-transporting ATPase
  misc_feature (908)..(908): n is a, c, t, g, unknown, or other
ggacctcgagcgtctcgtttttttttttttttttaggaaaggcattcgttttattgcaatgaattgtgtatggaagttttacaaataaaattctcaccaaaatgagatcagctgccggtagaaattcaatctgatgagtaacataaactactgtttttgaagacaaagccccaagcaagcattccttgaaaaggtgggatccagtatgggcatcaacagcactgaatgggtcatcgaacagatagatgtctgcttcttggtacaaagcacgggctatctgaatcctttgcttctgcccgccacttaggttgatccctcgctctccaatgacagtctggtcaccgaaaggcaagatctccaagtctttcttcagtgaacacgactcaaggactctttcatatttgtccctgtccatctccttgccaaacaatatgttgtcctgaattttaccactctgtatccatgctgactggctcaaataacctgtcgtcccggaaaattttaaacctctcctggataacttttgggatcctcacccagaaatgccagaatagcaagcctccatttttcccagagccccacttgttcccacaaaactggcaacaccgcatggccctccccttaaaactttggaaaaattcagggcccctttcaagcggtttgggcaaaattccggggggaaggcgcctccccaaggaaaaaaaaccatcccctttggcttgaaatggccaatttgtgaaacaatttggaaaccttggcccatttttgggcaaaccactttttgaaaacaaaaaattttagtttgggggaaaattctccctccccgagaaccactttggggaaacacaagatgcgtttattctctgttttaacaaaagagaaccacacctcttgtggttctttggggn

SEQ ID NO: 69068 - DNA, 802 bp, Zea mays
  misc_feature: Ceres CLONE 1546320-R2
accagctgtgcttatccgggatgactcgcaacagtgactttctatttaccacttgcgacaatttcgcgattgaaggaaaacaaaaaaaaaaaactttgcaggggccaggggttttacctaagcccttccatttccccctgttacaccttaggatacaaatttcctatctgagcaagtacagtccaaaaggaacagcaaacaaacagagaacactactagctcaaggagctagaaatggcgatccaatgcaattcgaagcaagaaaaatgcttatcaacattgctgaacttcgcttgacaagtccggtcctgctactggtcttggtcctgggcagtccagtacgtcttgacaaccaggaggatcttctccctgacgagcgggccgtcttcgtggtcgacgatctggctctcccacctcatcccgtccgccaggctcttgaccttcaccagcatgtccacgtcttccctgacgatcaccgtgcccctgggcctcaggatcctgtccatctccaggaggatgcggtccatctcacacctgtccttgtacagggtgaacaccgaatccgcatggatgaggtcgtaggtcctcgggtaggtagacatgccctcgcaccagtcctggtagcttccgatgagcccgcgctcgtagatggccccgagcgtggtcgcgttcgccacggtcgggaccatgttcatgacccacagcgggtcgcccgccagcgccagcgccgcggcgaacccgcccaggcgcgcgttcatgtccagcacgttgcggtaccgccccttctgctcgagctggctgt

SEQ ID NO: 69069 - DNA, 824 bp, Zea mays
  misc_feature: Ceres CLONE 1546320-R
gggacctcgagcgtctcgtttttttttttttttttagaacgaacccagctgtgcttatccgggatgactcgcaacagtgactttctatttaccacttgccacaatttcgcaattgaaggaaaacaaaaaaaaaaaactttgcaggggccaggggttttacctaagcccttccatttccccctgttacaccttaggatacaaatttcctatctgagcaagtacagtccaaaaggaacagcaaacaaacagagaacactactagctcaaggagctagaaatggcgatccaatgcaattcgaagcaagaaaaatgcttatcaacattgctgaacttcgcttgacaagtccggtcctgctactggtcttggtcctgggcagtccagtacgtcttgacaaccaggaggatcttctccctgacgagcgggccgtcttcgtggtcgacgatctggctctcccacctcatcccgtccgccaggctcttgaccttcaccagcatgtccacgtcttccctgacgatcaccgtgcccctgggcctcaggatcctgtccatctccaggaggatgcggtccatctcacacctgtccttgtacagggtgaacaccgaatccgcatggatgaggtcgtaggtcctcgggtaggtagacatgccctcgcaccagtcctggtagcttccgatgagcccgcgctcgtagatggcccccgagcgtggtcgcgttcgccacggtcgggaccatgttcatgacccacagcggggtcgcccgccagcgccagcggcgcggcgaacccgcccaggcgcgcgttcatgtccagcacgtttgcggtacc

SEQ ID NO: 69070 - DNA, 672 bp, Zea mays
  misc_feature: Ceres CLONE 1546323
  misc_feature (270)..(270): n is a, c, t, g, unknown, or other
  misc_feature (272)..(272): n is a, c, t, g, unknown, or other
  misc_feature (273)..(273): n is a, c, t, g, unknown, or other
gcggtggcggccgctctagaactagtggatcccccgggctgcaggaattcgtctcacccctagaaaaaatacctttctcggccttttggctaagatcaagtgtagtatctgttcttatcagtttaatatctgatatgtggactatgtgttcattttgatattaaatttattttttgtgggggagggttcaccacagtggcttgccactgggcccctcgagcgtcgctcggccgttgcactactggctgagcctggcgcaccccaacaacntnnttttaaaaacaacaagactgaaaaaaaccctggagttacccaacttaaatggaataaaaaaaaaaaaaccgagacgctcgaggtacccaattcgccctatagtgagccgaattacccgcgctcactggccgccgttttacacgtcgtgactgggaaaaccctggcgttacaaacttattcgccttgaagaaatcccccttttcgccagttggcgtataaccgaaaaagcccgcacaaatccgccttccccaacattgcgcaacctgaaatggcaaatggaaatggtaaaccttaaaatttttggtaaaattcccgttaaattttttgtaaaacccccccattttttttaccaaataggcccaaaatggggaaaacccccttaaaaacaaaaaaaaaaac

SEQ ID NO: 69071 - DNA, 812 bp, Zea mays
  misc_feature: Ceres CLONE 1546324
  misc_feature: Encodes the peptide sequence at SEQ ID NO. 69072
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (731)..(731): n is a, c, t, g, unknown, or other
nnncccccccctccnnnantttaaatatttttcccccccnnnttcttcnnntaatatccctcttccctcggtggcggccgctctagaatagtggatcccccgggctgcaggaattcgtctcacccctagaaaaaaagtagctcccttggcaggatctgttccgcctcccaaatcgcgtgtgtggtacttgtggaaggcttcggggccgaccaggaagatcatgaaacatctaccttcagaggagaaactaattcacaatggtaacggaagtgcaactggagatgatggaaagctcaaggaggcaacggccacttgaagacattttaggtgataaatagtaggtcgataatagaatgggcttattgaattacctgtattttaaattcttgttctgaataccgattattgggaggtattttacccccttgtagcaccgggggggggggcgggttcccaaggggcgtgcacacttccacgcccccttgcccctcggccgtccttaccacatattgtgggatgcttgaatgctgccccggcagcgcaactcccttttggggcgccctttacatcctcgcctcttgtttaaacatctgttgccctcaacttgctcgcggtgctgttttaaatctttgtcttctcagacacgggaaacaaacctcctgtcactctgttacctggtctttagacacgccccttagtcctcccaccatccgccccgcaattcagtaacngcccgttggtgttttgttatctgttgcttctcgttcctcacaggcaccctccttggtagaaagctcctaccagtttctttt

SEQ ID NO: 69072 - protein, 31 aa, Zea mays
  misc_feature: Ceres CLONE 1546324
MKHLPSEEKLIHNGNGSATGDDGKLKEATAT

SEQ ID NO: 69073 - DNA, 648 bp, Zea mays
  misc_feature: Ceres CLONE 1546328
  misc_feature: Translation starting site: 179
  misc_feature (335)..(335): n is a, c, t, g, unknown, or other
ctcaccgcggtggcggccgctctagaactagtggatcccccgggctgcaggaattcgtctcacccctagaaaaaaatctcgttgcccgttgtgctctctctctctattcgttccccgcctcaccccgagccagccgtctcgctagggtttcgccgccgccgccgccgccgccgccgctatgcctcgccgcagctcaggaaggtctgccccacgcccagctacccgtgctgctccagtgaggaacccgccacagccagcacgccaggctcctcctccagctcctgttcgagatggtggtggctccatgtttggaggaattgggtccaccattgctncaggtatggcgtttggcacgggtagtgccatggcacacagggctgttgatgctgtattaggtccccgaaccatcaccatgagactgttgcctcaaaagctgctgctgctgcccctgcccctccaatgatgaatgctgacgcttgccacatccattctaaggctttccaaaattgtctcaacacctatggacccaaatccagcagggcccatttctccctaaacttcttaaccaaatccccccggggtggtgggcccgcccaaaccgcccctgggggtattccggaattttcttccggggaaccctcccaaaaa

SEQ ID NO: 69074 - DNA, 695 bp, Zea mays
  misc_feature: Ceres CLONE 1546331
  misc_feature: Encodes the peptide sequence at SEQ ID NO. 69075
  misc_feature (516)..(516): n is a, c, t, g, unknown, or other
  misc_feature (582)..(582): n is a, c, t, g, unknown, or other
tggagctccccgcggtggcggccgctctagaactagtggatcccccgggctgcaggaattcgtctcacccctagaaaaagacgcgaaccagctgccgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaattgggttgatcgtcgattaatcgtgattagtccgctgatcgcccttctggcgatcagaaacgataaggcaatctgaaaacattggccgccaaacctccagagcgactcccgcgagccgtgaccaccatagccaaatcaacgcaccagaagctttcacggagctgtctcgtccacgagtgttccagctgactcctattccctgcgtcaatggcgagctctggcgatgaagggcgtgtggtgttggacctcggctccgcggcggagtcngtggctgccgacgaagaggcgcacgccacgcctctccacgagattgagtccctttgcatgcgctgncgcgaagacggcatcacgaggcttttgctgacgttgatcccgcactccgggaagttggtctgatgggcttccagtgccacattgtggcgagaggacaacggaattcaggtggt

SEQ ID NO: 69075 - protein, 62 aa, Zea mays
  misc_feature: Ceres CLONE 1546331
  misc_feature (42)..(42): Xaa is any aa, unknown, or other
MASSGDEGRVVLDLGSAAESVAADEEAHATPLHEIESLCMRXREDGITRLLLTLIPHSGKLV

SEQ ID NO: 69076 - DNA, 402 bp, Zea mays
  misc_feature: Ceres CLONE 1546332
  misc_feature: Encodes the peptide sequence at SEQ ID NO. 69077
actggcgaatcgagagggaagcagatcgactactcagctagctcgaggttgaaggcatggctgcatccaaattctacgtcgccagctgcgccctcctcctaatcggcgtggtgctgctggggcagcagggtatagttggcgccgtcgcctgcccccagttctgcctcgacgtggactacgtgacctgcccgtcctccggctccgagaaactcccggcgagctgcaactgctgcatgacgcccaaaggctgcacgctccatctctccgatggcacgcagcagacctgcagctagctctgaaccaaagtgtgcgtgattcgatctggacaaagaccaacctgctggttttcgcaaataaagctttcgcgcctgtatatggccatccgaaaaaaaaaaaaaaaaa

SEQ ID NO: 69077 - protein, 78 aa, Zea mays; identical to SEQ ID NO: 65549
  misc_feature: Ceres CLONE 1546332
  misc_feature (29)..(79): Pfam Name: Prot_inhib_II Pfam Description: Potato type II proteinase inhibitor family

SEQ ID NO: 69078 - DNA, 665 bp, Zea mays
  misc_feature: Ceres CLONE 1546333
  misc_feature: Encodes the peptide sequence at SEQ ID NO. 69079
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (374)..(374): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
ctccccgcggtggcggccgctctagaactagtggatcccccgggctgcaggaattcgtctcacccctagaaaaagattcggttttcttcgtgaattcgcccccagcgagccgagctagaattggaattggaactggacttgcggctgctgcgttcggcgggggctggaattctcgccgcatccccgtgtggtggtgagaggccgtggctcgtgttgcggtcgacgcgcgaggagggtcgacggcctcgcgccattggggtacgaagccggccgagactgagcggtgagttggcccggattcccgcgggtgtgttcgtaccggttgcggtggttgcttcggtgggtggggggnnnnnnnnnnngnnnnncttttnttcttttttttttttttttnnnccccccccccccttccgctcggcgttttgctcccgcgcttctttttgccccccccgtgctgttcgttttcttcgtgtccccgttcccgttttgttttcttgtccgctcgccccccgccttggttgcccccctttttccctcctcgccgctccgggcgggttccgtgctgggcggcgcgttactcccctcctttttttccgcgtcttgtccctcttttctttcctggtgcgacaagttttttccgtctccggcccattcctggctattat

SEQ ID NO: 69079 - protein, 64 aa, Zea mays
  misc_feature: Ceres CLONE 1546333
PRGGGRSRTSGSPGLQEFVSPLEKDSVFFVNSPPASRARIGIGTGLAAAAFGGGWNSRRIPVWW

SEQ ID NO: 69080 - DNA, 675 bp, Zea mays
  misc_feature: Ceres CLONE 1546334
  misc_feature: Translation starting site: 267
  misc_feature: SWISSPROT Homolog: EC 3.2.1.23 Beta-galactosidase
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
ctcaccgcggtggcggccgctctagaactagtggatcccccgggctgcaggaattcgtctcacccctagaaaaagtctaaaatggagttcatttcatgtataccgaccatggaattacaaataggtgtacattgtggcccattgctgagacaattatccacgttccatgttttgtgtgaacgggcacatacaggaagaagcccctctgttgttacatacatgagttttctgaaccttcaaaaaaaaaaaaaaaaactatacgctcgatgtacccaattctccctatagcgagtcttattacgagcgctcactggccgtccttttacaacgtcgtgactggaaaaacactaaccttacccaccttaatcgccttggagcacatcctcctctcgacaactggcgtaatatctgatacgcccgatacgatgcgccgtgccatatgtgcgcagccatgatcgctaatgcaaatctaaagcgtcatcatttcgttaaaaatagcgtaacatttttgttaagtcagctcattttttttaacaaatgaggccgaattcgggcaaaatcccttgacaaatctaaaaaataaaccaaaatggggataaactgttggtccccctttggaaaccggactttaaaannnnnnnnnnnnnnnnnnnnnnnnnnnnnnnnnnnnnnnnn

SEQ ID NO: 69081 - DNA, 632 bp, Zea mays
  misc_feature: Ceres CLONE 1546341
  misc_feature: Encodes the peptide sequence at SEQ ID NO. 69082
gctctagaactagtggatcccccgggctgcaggaattcgtctcacccctagaaaaaaatgccctccgcgagtaggaatccgatccctacgcgccaagccggggccgcatcgaggatgacgaggaggaagacgacccttcggcggcatgtcagaagggactgcctgctgcgtgtacatactgatcgccatcatctctgcgctccgctgggggtgtgcctatcgtacatggtagcgggcaccagtatctggatctggctcctcctcatcttcctcggctacatccccggcatcatctacgccatctacgccatcagcgagaacaactagctagtcatccttgccgacgactagccatgtctctgcatctgcgcctgttcatatgcctgatgccgacttgcgctggctgtagtagcaagcatacagtcgtgttgtgctactgtactgacgcatgtttcatctgtcatcgcgtcgcgttactcattgtactaacaagttcagagattcgtttccgctcagagtacccaattgagcccccttcgagattcctatttccgccctattctggaggccctatttccttccccctcactgggccgggcgattttccccagggccttgacccggggtaaaac

SEQ ID NO: 69082 - protein, 70 aa, Zea mays
  misc_feature: Ceres CLONE 1546341
MTRRKTTLRRHVRRDCLLRVHTDRHHLCAPLGVCLSYMVAGTSIWIWLLLIFLGYIPGIIYAIYAISENN

SEQ ID NO: 69083 - DNA, 659 bp, Zea mays
  misc_feature: Ceres CLONE 1546344
  misc_feature: Translation starting site: 308
  misc_feature (478)..(478): n is a, c, t, g, unknown, or other
  misc_feature (488)..(488): n is a, c, t, g, unknown, or other
  misc_feature (491)..(491): n is a, c, t, g, unknown, or other
  misc_feature (494)..(494): n is a, c, t, g, unknown, or other
  misc_feature (497)..(497): n is a, c, t, g, unknown, or other
  misc_feature (500)..(500): n is a, c, t, g, unknown, or other
  misc_feature (501)..(501): n is a, c, t, g, unknown, or other
  misc_feature (504)..(504): n is a, c, t, g, unknown, or other
  misc_feature (589)..(589): n is a, c, t, g, unknown, or other
  misc_feature (601)..(601): n is a, c, t, g, unknown, or other
  misc_feature (649)..(649): n is a, c, t, g, unknown, or other
agctccccgcggtggcggccgctctagaactagtggatcccccgggctgcaggaattcgtctcacccctagaaaaaacaccgcgcacggcatacccaccactcgatccaccacacgagggcacgagagaagaaccacttccatggccggcgcctcatcgtgagctcctcgcagcatcgctaccgcgcccttgcgttagctctgtcttcctgtcgcacgtacgcttgtgagacaagcgagaaggcacgtacgtttagtttattcattttcttggagcgggatctgaggttccaaccggcaaaagagagatgatggtagggaagagggagcgggactgcaagaacccgatgcggcggacgacgagcatgacggagttcgcgccgcccgacgcgctcgcggcggtgatggaggacgaggagggcccccagctgtccgacgacagcagccgtgacggcgggcagcaggactggctgtccgcnctcggcggcngcngcngcngcnntcnggggcgcccgcgcgcaggaagactggctcgcggcgtaccacgcccgcgcggcgccggcgcgggcggggctcccgcggaactcggncgactactccgncgtcgagaccgccgcgttcctgcgcgcctgcgggctctgccggcgccngctcgggccc

SEQ ID NO: 69084 - DNA, 665 bp, Zea mays
  misc_feature: Ceres CLONE 1546345
  misc_feature: Encodes the peptide sequence at SEQ ID NO. 69085
  misc_feature (353)..(353): n is a, c, t, g, unknown, or other
  misc_feature (361)..(361): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (427)..(427): n is a, c, t, g, unknown, or other
  misc_feature (428)..(428): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
ccccgcggtggcggccgctctagaactagtggatcccccgggctgcaggaattcgtctcacccctagaaaaaccaaccgtgccgcagaagcccttcctatgatccgaaggcaagttggcatcttgccatcgaatagttccattattttctcaaataagttgggatgtttgaagcgattttaggtgtggtgtatagatatattgcttattcttgttgtaaatttgttcatatctggtactggtataatgacaactattaataccacacaattggcaatctcgtggtcggatttgattgtatagtccggatactggtaggttcaggtctttcacaactccctgcatgttgaattnaagctcanaaatgcgagctgtagacattgtattgacactgacatagttcattttcttttttnnnnnnnnaaatnnannntaaaaatttttttaaaatttnnntttaccctttaaaaaaaaaaaacggagccctcgagggccccattcccccataaggggaggcgatttacccgccccccctgggcccccttttttaaacgcctggacggggagaaacccggggtttccccaaattaaacccctttgaaaaaatcccccttttcccaagggggtaaaaaaaaaaaaagcccccccccaaaaatcccttctcca

SEQ ID NO: 69085 - protein, 31 aa, Zea mays
  misc_feature: Ceres CLONE 1546345
MFEAILGVVYRYIAYSCCKFVHIWYWYNDNY

SEQ ID NO: 69086 - DNA, 672 bp, Zea mays
  misc_feature: Ceres CLONE 1546350
  misc_feature: Encodes the peptide sequence at SEQ ID NO. 69087
cagagctggagctccccgcggtggcggccgctctagaactagtggatcccccgggctgcaggaattcgtctcacccctagaaaaagcctccctcctttcacacccatctcgatcctcccaacccaaaccctagcggacgcaccgctgccatggccgaatccggcgagtcgtccccgaactcagccgcggccacggacgacacgcaccacgagatgccggaggccggagcggctgcggcggcagagcgtgcagccgccttcctcctcgccttctcttgcggcgcgccgctgatggccgagtcccttggacgcccacctgtgtgtgggatgatttcttcatttgtcgaggttagaggcaacagcgatagttttgtcgctgaagatggcggtccatgtgaatgacatggcctgtcttctgcctctgcttgtgctgaacagcactggcgaatgcaagcaggcacttgcgacctgcgagtgaactgaggcactgacaagaagtatcacggcacgctggttgcttcaccaccaaacgacaattcacctgagtgtgtgaaccgtcattgtgccatcgaagccactgatctggtgtgggggttcaatatgccatgtggcatcattgctgatcaaggtcgctgcccttgaggcacccctacgagtttctaaagcaagaagc

SEQ ID NO: 69087 - protein, 83 aa, Zea mays
  misc_feature: Ceres CLONE 1546350
MAESGESSPNSAAATDDTHHEMPEAGAAAAAERAAAFLLAFSCGAPLMAESLGRPPVCGMISSFVEVRGNSDSFVAEDGGPCE

SEQ ID NO: 69088 - DNA, 2071 bp, Zea mays
  misc_feature: Ceres CLONE 1546354
  misc_feature: Encodes the peptide sequence at SEQ ID NO. 69089
aaaccccacccccaccaccaagggtccaaagccatgcgtgccgccatggcggcggcggtcctccgacccacggccgccaccctccgcttcctctccaccccaccacaccagcgccgccgcgtcttggtcggacacctcccctttgctcgccgacgccgccactcctccaccgctacggccccagcgctggaggactccagcccccgcagtggcgaaggcaaggccgtgcgccgccgccgcgcccgtgaatctccccagggcctcctccgccaccagctcgacatgtgctcccgcaacgccgacctcaccaccgcgctccgcctctacgacgacgccctctccccggacaaccccatcccgctctccctccaccactacaactgcctgctctacctctgctccaacgccgccgctaccgactctgacagccatatctccgccaccgccgctcagcgcggcttcgacatcttcgccaggatggaggccgacggcgtccagcccaacgaggccaccctcaccagcgtcgcgcgcctcgccgccgccacccgcgaccctgccatggccttctccgtcgtccgccgcatggccgctgcgggcaccccgccgcgcctccgcacctacggccccgccctcttcgcctactgcgatgccaaagacgccgacggcgccaagcaggtcgaggctcacatggacgcatctggcgtcgtgcccgaggagcccgagctcgcagcgttgctccgcgtcaacgcggacacgggcaaggccgatgaggtttacaggctcctgcacaggacgcgcgtcctcgtcaggcaggtctgcgacaccactgcccaggtcgtcgaggcctggttccggtcggacgcagcgtcccaggcgggggtggacagctgggatcccaccaaggtaaaggagggcgtcgtcaagggcggcggcggctggcatggccagggatggcttggcaagggcgcatggagcgttggctggaccgagatgggcaaggatgggacatgccaacgctgtggggagaggcttgtctgcattgacattgatccagccgagactgacaactttgcaaattcgctcaccgaactggccattaagcttgaggccagggaagatttcctcagttttcagagctggctacgccgccatggaccattcgatgctgttatagacgctgctaatgtaggcctttacaaaagtaaagatttctgtttttcacaggttaactctgttgtaaatgctatacagagagtaactaaatcaaagaagttgccactgatcgttttgcataggagccgtgtaaatgttggtcctgcaaaagccccatacaaccagaagattctggacagttggaggaatgctggagctctgtatgcaacccctcctggctccaatgacgattggtattggctgtatgcagctgtcagttgccgatcgttgcttgttacaaatgatgagatgcgagaccacttgttccaactgcttggcactagttttttccctaggtggaaagaaaaacatcaggtcagactaactttctccgggcatggccctacccttcacttgccgcctccttattcaattgttattcaggaatctgaagatggaagctggcatgtaccaacaacaacaggcgatgatattgaaaagccacggcagtggttgtgcactactagaaaatctttgaggtagatgtgatttaattttggcccagtcaagttgacacagaatggtgccaaccttggtgggaactgggaagggtggtggcgtgacgaaccctgaaaccagcaaagcttaaatgcagcaacttgttggcccgaacgaaagaaagctgattggagtacaagtgatgaatatgagcagccatggatatggaaagccttttgttgtaacattgtgagctgtttattgctagcccaggttattctagagtagtttgagaatcgtggtaaggtaatttgcttcatgtgagttttacttctattaaatgacgtgccatgccagtgatttgaaggatgtggcaggcaagtaatcaaagaaagagatgaatgttatccaaaaaaaaaaa

SEQ ID NO: 69089 - protein, 553 aa, Zea mays
  misc_feature: Ceres CLONE 1546354
MRAAMAAAVLRPTAATLRFLSTPPHQRRRVLVGHLPFARRRRHSSTATAPALEDSSPRSGEGKAVRRRRARESPQGLLRHQLDMCSRNADLTTALRLYDDALSPDNPIPLSLHHYNCLLYLCSNAAATDSDSHISATAAQRGFDIFARMEADGVQPNEATLTSVARLAAATRDPAMAFSVVRRMAAAGTPPRLRTYGPALFAYCDAKDADGAKQVEAHMDASGVVPEEPELAALLRVNADTGKADEVYRLLHRTRVLVRQVCDTTAQVVEAWFRSDAASQAGVDSWDPTKVKEGVVKGGGGWHGQGWLGKGAWSVGWTEMGKDGTCQRCGERLVCIDIDPAETDNFANSLTELAIKLEAREDFLSFQSWLRRHGPFDAVIDAANVGLYKSKDFCFSQVNSVVNAIQRVTKSKKLPLIVLHRSRVNVGPAKAPYNQKILDSWRNAGALYATPPGSNDDWYWLYAAVSCRSLLVTNDEMRDHLFQLLGTSFFPRWKEKHQVRLTFSGHGPTLHLPPPYSIVIQESEDGSWHVPTTTGDDIEKPRQWLCTTRKSLR

SEQ ID NO: 69090 - DNA, 668 bp, Zea mays
  misc_feature: Ceres CLONE 1546355
  misc_feature: Encodes the peptide sequence at SEQ ID NO. 69091
tggagctccccgcggtggcggccgctctagaactagtggatcccccgggctgcaggaattcgtctcacccctagaaaaagctccgtttcctctctctcctcctattaaccactctccacccgctcgcctcgccctctcgttgagagagtcgtcccctccgcgtgctctccgcctgcggcatctgtatcccacaacgaaaaactaccaaaaaaattagaaatccccaaatccgcgagatctatcagtatcgagcgatttaccgatccgattgctagggtttagtttcgaaaaagaaactctgaaaaaaaattctggtcgaggggaggagacgatggcagcgcaagtggcggcggtggtggtgccgaatgggagcccgggcgctgtccccgcggtggtgtcgccgggagcggtcggcgtcggactcggcgtggcgcagccgctcccgaccacgtcgctctacgtcggcgacctggaggggtccgtctcggactcgcagctgtacgagctcttcagccaggcggggcaggtggtgtcggtgcgcgtctgcagggacgtcacctcgcgccgctcgctcggatacgcctacgtcaacttcaacaaccccttggatgctgcaagggcattggaagtgctgaactttgctcctcttaacacaaacctatccgggt

SEQ ID NO: 69091 - protein, 112 aa, Zea mays
  misc_feature: Ceres CLONE 1546355
  misc_feature (42)..(112): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQVAAVVVPNGSPGAVPAVVSPGAVGVGLGVAQPLPTTSLYVGDLEGSVSDSQLYELFSQAGQVVSVRVCRDVTSRRSLGYAYVNFNNPLDAARALEVLNFAPLNTNLSG

SEQ ID NO: 69092 - DNA, 615 bp, Zea mays
  misc_feature: Ceres CLONE 1546356
  misc_feature: Encodes the peptide sequence at SEQ ID NO. 69093
  misc_feature (245)..(245): n is a, c, t, g, unknown, or other
  misc_feature (261)..(261): n is a, c, t, g, unknown, or other
  misc_feature (305)..(305): n is a, c, t, g, unknown, or other
ggagctcaccgcggtggcggccgctctagaactagtggatcccccgggctgcaggaattcgtctcacccctagaaaaactcccgactctctggcctctcctgactctgccccgcctcatcactcccattccaccgacacgcggacgcggcgtgtcgcgcgcctccgctaaaaccgtagcccgaggcccgatggccgccccgccgcaaccgcaccacaggcagcggaggagagggccgcgccggcngttcccctgcccactngccccggcgggtccgcgccgtacaacgtggcggtcgccgcggcngaagctccgccggtagactgcgacctccgcccgctctgtgaccacgtccaagccgaaggggttccgggttggggggcttcttccgactccttctgggaaggcccggggggcaacctaacgccttcattggcctaatcttttttcggaaaggccatttttaggaaattgccccagggggcccttgggaagagggggggagcacccccacaggggtttttcccccaaaagaagtccccaggttggttttcaaacacaattgcaattgcgccttgcaaattttttttggggggagcccccccaactttatgaa

SEQ ID NO: 69093 - protein, 43 aa, Zea mays
  misc_feature: Ceres CLONE 1546356
  misc_feature (19)..(19): Xaa is any aa, unknown, or other
  misc_feature (39)..(39): Xaa is any aa, unknown, or other
MAAPPQPHHRQRRRGPRRXFPCPLAPAGPRRTTWRSPRXKLRR

SEQ ID NO: 69094 - DNA, 604 bp, Zea mays
  misc_feature: Ceres CLONE 1546358
  misc_feature: Encodes the peptide sequence at SEQ ID NO. 69095
  misc_feature (502)..(502): n is a, c, t, g, unknown, or other
  misc_feature (514)..(514): n is a, c, t, g, unknown, or other
  misc_feature (555)..(555): n is a, c, t, g, unknown, or other
  misc_feature (582)..(582): n is a, c, t, g, unknown, or other
ggagctcaccgcggtggcggccgctctagaactagtggatcccccgggctgcaggaattcgtctcacccctagaaaaagaactagcagagctaaaacccttgcggcggctacctttccctcaccccctttctcgcctcgcggcggctacctttccccccttctcgcctctcgcctcgcggccgccgcaggcgaccccttgtcgcctcgtgctgtccaccgccgaatcttccccaggttagggagggtatctgttgtttcagctcagttttaccgggggactggttgtgggcggagatgttggtgctctttgagacccccgcgggcttcgccctattcaaggtgctcgacgagggtaagctcgacaaggtcgaggatctatggaaggagttcacgacgtcggactcagcaagaaaggtggttgagctgaaggctttcaataagtttgagaacacatctgatgctctatctgcggcaacccttattattgatagcaagcctagncagggtctgcgncagtttctacagaaacattgtgagggggtgaacatagcggntgctgatttctagctaggaaatgctantaaagaaagctgaaaattgctg

SEQ ID NO: 69095 - protein, 90 aa, Zea mays
  misc_feature: Ceres CLONE 1546358
  misc_feature (1)..(66): Pfam Name: NOP5NT Pfam Description: NOP5NT (NUC127) domain
  misc_feature (69)..(69): Xaa is any aa, unknown, or other
  misc_feature (87)..(87): Xaa is any aa, unknown, or other
MLVLFETPAGFALFKVLDEGKLDKVEDLWKEFTTSDSARKVVELKAFNKFENTSDALSAATLIIDSKPXQGLRQFLQKHCEGVNIAXADF

SEQ ID NO: 69096 - DNA, 686 bp, Zea mays
  misc_feature: Ceres CLONE 1546361
  misc_feature: Encodes the peptide sequence at SEQ ID NO. 69097
aagctggagctccccgcggtggcggccgctctagaactagtggatcccccgggctgcaggaattcgtctcacccctagaaaaagacaaggcggtgcagcgggcacgactggggtcctcgtacggcacgccgggcgccgccgacgcccccgaagacagcatggtgatgtccatggccagtactctgatctcctgaggctatttgattatggtggctatccgcctcaggccaactaccttttcttgggtgattatatggatcgtggaaagcaaagcctagaaacaatgtcttcttttggcttacaaggtcaagtacccggagaacttctttcttctaaggggcaaccatgaatgcgcatcagtaaatcgcatctatggtttttatgatgagtgcaaacgcagattcagtgtaaagctgtggaaaacattcacagactgttttaactgcttgctagtgtcagcattgatagatgaaaagattctctgtatgcatggtggtctatctctggagttgaacaagcttgagcaaatactcaacctgaatcgccccacagacatgcctgatactggattgctctgtgatcttctttggtctcatccttccaatgaagcaacgggctggaaccatcaatgatcgaggtgtttcattcacatttggtcctgataaagtttcagaatttcttgagaa

SEQ ID NO: 69097 - protein, 48 aa, Zea mays
  misc_feature: Ceres CLONE 1546361
  misc_feature: SWISSPROT Homolog: EC 3.1.3.16 Phosphoprotein phosphatase
MHGGLSLELNKLEQILNLNRPTDMPDTGLLCDLLWSHPSNEATGWNHQ

SEQ ID NO: 69098 - DNA, 619 bp, Zea mays
  misc_feature: Ceres CLONE 1546364
  misc_feature: Encodes the peptide sequence at SEQ ID NO. 69099
tggcggccgctctagaactagtggatcccccgggctgcaggaattcgtctcacccctagaaaaacccagctggtttggtttggtttcgttttggttttggttgggttttcacaggcaccgacgcgcgcgccggcgatcgagatggccgactggggccccgtggtggtggcggtggtgctgttcgtgctgctgtcgccgggcctgctgctgcagctgccggccaagggcgggcgcttcgtggagttcggcaacttccagaccagcggcgcctccatcttcggccacgccatcatcttcttcgccctcgccgccgtcttcctcatcgccatcggggtgcacatcaccacggactagccgtctagccccgtagccgggaccgggatctttcttcgccacagtctgcctgtatatacatatatacatacatgctcagtacgtacgctttaccactctgtcagtgagtatctctttgtatcagcaccctgctgtgtgcgtacctaccaagtgtttatatgggctctggtctgggctgttatcattcagcggcgcacccagagacgcgatcgtgtgcttctagttacagacttgccgtgtggcgtgtggccatccatcgtcgatc

SEQ ID NO: 69099 - protein, 70 aa, Zea mays
  misc_feature: Ceres CLONE 1546364
MADWGPVVVAVVLFVLLSPGLLLQLPAKGGRFVEFGNFQTSGASIFGHAIIFFALAAVFLIAIGVHITTD

SEQ ID NO: 69100 - DNA, 702 bp, Zea mays
  misc_feature: Ceres CLONE 1546369
  misc_feature (399)..(399): n is a, c, t, g, unknown, or other
  misc_feature (440)..(440): n is a, c, t, g, unknown, or other
  misc_feature (469)..(469): n is a, c, t, g, unknown, or other
  misc_feature (486)..(486): n is a, c, t, g, unknown, or other
  misc_feature (511)..(511): n is a, c, t, g, unknown, or other
  misc_feature (528)..(528): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (577)..(577): n is a, c, t, g, unknown, or other
  misc_feature (606)..(606): n is a, c, t, g, unknown, or other
  misc_feature (650)..(650): n is a, c, t, g, unknown, or other
  misc_feature (653)..(653): n is a, c, t, g, unknown, or other
  misc_feature (654)..(654): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
cgcggtggcggccgctctagaactagtggatcccccgggctgcaggaattcgtctcacccctagaaaaaagtacggaggacgggaggagtgatctccacgcccgctcgctcgcgtcctgtcgccttgtcggcgtccgccactccgccccctccagccagatccctcctattcccccacttcactcccaatccgaatccagatccgcgaatgctggggcgggcggcggcactgtccgcgccacggtgggcgcggcggggtgccagaccttcgcgccgcgctgcggtcggggggcaacctcctcttcgcgctcttcgtggcggccgtgctcgcattcacgctccctcgcggcgttccacagcccccgacgatccgctccctccacccgtcctctcaccagnctcacccgatttccctcacctccgccactttccacctccanccttcctcactggacgactccgtgctgcngcaccggggaggacttncaacttcctcgtccacccggcgccngccggcgaggtcgccgnctggnnnggtggtcgaaagtcgtcgcggagggccgtcccgttcatcagncttctccaaagttgggcgcgaaggccganaagacggagccccgagacgggagcggggccctcaccgttcgacnctnnttgcgccaccgcaggggcggcnnnnnnnnnnngccgaaggaacccgcc

SEQ ID NO: 69101 - DNA, 521 bp, Zea mays
  misc_feature: Ceres CLONE 1546373
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (141)..(141): n is a, c, t, g, unknown, or other
  misc_feature (145)..(145): n is a, c, t, g, unknown, or other
  misc_feature (156)..(156): n is a, c, t, g, unknown, or other
  misc_feature (180)..(180): n is a, c, t, g, unknown, or other
  misc_feature (299)..(299): n is a, c, t, g, unknown, or other
  misc_feature (328)..(328): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcaaagctggggactccaccncggntggcgggccgnctcttaaaactagtggaatccccncgggctgcaggaaattcgtctcacccctagaaaaagcaagcctgtggacgcgagtgagtgaacaccagccgtattgtcccgactcctgacccctaccgatcctcgcctgctgcagccantggcgacctccgcggcgctcttccaccgnccgccaatcccaccccaagctctaccggtcccgcgcttcgctgggcaagcccggtgaaagggcttggcctgagcatgggcccgcgagcgcgcccagcggagcattgggttgccaaggcggcgaacacaatttccgccgaacgggttccccgaaaatggaaaaaacggaaaacctaattaaacctccccccctc

SEQ ID NO: 69102 - DNA, 642 bp, Zea mays
  misc_feature: Ceres CLONE 1546381
  misc_feature (642)..(642): n is a, c, t, g, unknown, or other
ggagctccccgcggtggcggccgctctagaactagtggatcccccgggctgcaggaattcgtctcacccctagaaaaaacacgactatcctagaaatccgaagggagaaggtgctcactgccgttggagtacacacggcgatatctattgcacaacctacttcccagatacaggaggagggtgataaccacactgggaatcaagaaatcataccaaggtcaaatagaatgggcaggcaacttgaatcgttaagcagaggactgggaatcaagattccaacccaaatcactgaagggaacaaaagccagagccacctattcaagctactaagtttgcattagagggatggtcgccaaggccagggatttactgtcgaggtgtacaagtccatggcagtggctgtttgtgcagattagaagctgatgagggagtctcgtagcagaacttcaatgttgagatatggaaaagctacctatgtatcaagatatgtgaagactgcccgcctcaaacaagaggaatattttggtggagcgaagtttatgaagggcatggaggtactgctggtaacaagttctgaatgtcattaggtctaccattgatagctactgtgaattgtgctggtaacactggagccaagaaccn

SEQ ID NO: 69103 - DNA, 646 bp, Zea mays
  misc_feature: Ceres CLONE 1546382
  misc_feature: Encodes the peptide sequence at SEQ ID NO. 69104
tccccgcggtggcggccgctctagaactagtggatcccccgggctgcaggaattcgtctcacccctagaaaaagccatgacctccgcccctaattaaatcccggcgcggccgccgccgtctccccgggccagtaatctccgctccccaattccctcgcctccacacttgaaatccccaccaccaccaaacctccctagcccggcaaatcccgtatccaaatccaatagggtaaacctagccgcccatctgcccgccatgaaggcgtcgatcaagttccgcgacgacgaccgcccgctgctgcgcgccaaggtgccggtcggcgtgctggggctgcctttcttctcgggcctcgtggcggggggagacgccaaggacctccgcttcgacctctccaccgccttcacctccggcccggcgctccgcctctcgtaccgccccaacgaaccgctccagccctttgccctctccatccgcacggggctggggccgctggggtcccctgtccgagcccccttcgccctcgccgccgaattcaacctcacctcctcgaacccgcccgccttctcgctcgttttcaagccccggatcggagacttcgccgtcgccagctccgtccgctccccgccgccgccgccgcccgcatca

SEQ ID NO: 69104 - protein, 130 aa, Zea mays
  misc_feature: Ceres CLONE 1546382
MKASIKFRDDDRPLLRAKVPVGVLGLPFFSGLVAGGDAKDLRFDLSTAFTSGPALRLSYRPNEPLQPFALSIRTGLGPLGSPVRAPFALAAEFNLTSSNPPAFSLVFKPRIGDFAVASSVRSPPPPPPAS

SEQ ID NO: 69105 - DNA, 642 bp, Zea mays
  misc_feature: Ceres CLONE 1546383
  misc_feature: Encodes the peptide sequence at SEQ ID NO. 69106
  misc_feature (620)..(620): n is a, c, t, g, unknown, or other
agctccccgcggtggcggccgctctagaactagtggatcccccgggctgcaggaattcgtctcacccctagaaaaaataaagacgctgcgggggacgcattccctctccgtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacggtggtggtggcggcggctacngcggtggcaaccgtggcggcgg

SEQ ID NO: 69106 - protein, 144 aa, Zea mays
  misc_feature: Ceres CLONE 1546383
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
  misc_feature (138)..(138): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYGGGGGGYXGGNRGG

SEQ ID NO: 69107 - DNA, 647 bp, Zea mays
  misc_feature: Ceres CLONE 1546393
  misc_feature: Encodes the peptide sequence at SEQ ID NO. 69108
tccccgcggtggcggccgctctagaactagtggatcccccgggctgcaggaattcgtctcacccctagaaaaaggctttgcgcccacaccaagccaccctctgttctcctcttccgtggcggactagcggcgcactggtgtggtgctcctccaagctctggtctgctccgcgcccacgcctccccgtccacgggcaactttggccccggcccccgtgcgctaggaagcccagttcaccggtggatccgcgcgctgtacctccctgttacctgcgggtcgccccagccgggaacacgcggcccccgcaacctactgacttgggcttgctgtatagcacggaccagatcaagggtcttcctccaccacgtttgacgcttggccatgccttcaaatgttgatattgatccgttcgagctggatattgatgagctgatagctgattattacaaggagaacgtgtacatcactctctgaattgcaacgagtctggatgggaaaaagattttctgatctctgtgagggcacacctactactagctcaggtttattctctgcagtcactctttccgcattgcattggtcaattgacttctccaaggtcgctgcgcccaatattggctgggctatactgccgttactgactgtag

SEQ ID NO: 69108 - protein, 30 aa, Zea mays
  misc_feature: Ceres CLONE 1546393
MPSNVDIDPFELDIDELIADYYKENVYITL

SEQ ID NO: 69109 - DNA, 657 bp, Zea mays
  misc_feature: Ceres CLONE 1546395
  misc_feature: Encodes the peptide sequence at SEQ ID NO. 69110
ggagctccccgcggtggcggccgctctagaactagtggatcccccgggctgcaggaattcgtctcacccctagaaaaaagggtctggggccggtcagtgttgtgccgtccgttgaaaccaccacgtaacgtctcggacggctagacgcggtccacgctagctcctcgctatctccgtcctactcctcctcatactttaccgcaaagcgcgcaccacgaattgcacctacccatttcgctaatctccctccacgagccgaccaaatcgaatcgattcgcgcgcagcgcgcccgcgcagcgattgccggcgatggcgagcctcaccctgccgccggcgatggcgaacccacggcaggacgccatcgacctccaaaaggccttcaaagggtttggctgtgacagtacaacagtgataaacatacttactcatcgcgattcagtgcagcgtggactcattcaacaggaatacagggctatgtatcatgaggaactctcccatcgcatttcatctgaactcaatggaaaccacaagaaagctatgttgctgtggattcttgatcctgctggacgtgatgcaactgttttgagagaagctctaagtggtgacactatggatatgagagcagccactggatattatatgttccaggacaccatt

SEQ ID NO: 69110 - protein, 116 aa, Zea mays
  misc_feature: Ceres CLONE 1546395
  misc_feature (15)..(80): Pfam Name: Annexin Pfam Description: Annexin
MASLTLPPAMANPRQDAIDLQKAFKGFGCDSTTVINILTHRDSVQRGLIQQEYRAMYHEELSHRISSELNGNHKKAMLLWILDPAGRDATVLREALSGDTMDMRAATGYYMFQDTI

SEQ ID NO: 69111 - DNA, 761 bp, Zea mays
  misc_feature: Ceres CLONE 1546399
  misc_feature: Encodes the peptide sequence at SEQ ID NO. 69112
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
nnnnnnnnnnnnnnnnnnnnnnnccctttcctaaattttatttttcacgagaatcggaaaaaacttgggctccccgaggtggcggcagctctagaactagtggatcccccgggctgcaggaattcgtctcacccctagaaaaaggggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaactcgctcatgatgcacgggcgcaacaacggcaagaaggtcatggctgtccgcatcatcaagcataccctggaagacatccacctgctcaccgatgccaaccccatccaggtcgtcgtcgacgcgatcatcaacagtggaaccccgtgaggatgccaccccgtattggttcccaccggtggttgtggaggagggcacggccgcgtgatatctgcacaccctggaggcaggggtgaacccagagccatcctagccttccctcacaccaccagggtggctcaagggaaaaaaaggagcttgtttcccgggtaaaacctccttatataccg

SEQ ID NO: 69112 - protein, 117 aa, Zea mays
  misc_feature: Ceres CLONE 1546399
  misc_feature (44)..(116): Pfam Name: Ribosomal_S7 Pfam Description: Ribosomal protein S7p/S5e
MAEVEQQQDTPKLFNRWTFDDVQVNDISLNDYLAVNATKHAMYLPHTAGRYSKKRFRKAQCPIVERLTNSLMMHGRNNGKKVMAVRIIKHTLEDIHLLTDANPIQVVVDAIINSGTP

SEQ ID NO: 69113 - DNA, 611 bp, Zea mays
  misc_feature: Ceres CLONE 1546406
  misc_feature: Encodes the peptide sequence at SEQ ID NO. 69114
  misc_feature (576)..(576): n is a, c, t, g, unknown, or other
agctccccgcggtggcggccgctctagaactagtggatcccccgggctgcaggaattcgtctcacccctagaaaaaaagctattcgcgggaccgtatccgagcaggacagcaggttgttcagcgatcactcgagcggtcgagccctcgcgccgcggagagtgtctccagtctcaagtacagcggaggatggagagcggcttgcttgacaccgccgcggctgccggtctctgcccggtggcgtgccgggcgccgccgcgtcgggagcacgggcacggcgaggtgcttcctcagctgctcctgcgcttccagagactgcagggtgagcgcgtcctactcccactccatcagccggatgctgagcggggtgcggtcggcggcgcgcaagaggctcttcaggagcgacccggccgagctgctgggcgtcgccaactggtcggagacgggcggcggcggcgccgggggccaccagcactggtggacggcgctggagaacaacttcgtgctggaggccaccgacgacgagtacgggggggggtcgtcgtcgacgccgatcggctgccggccgacaggggcgncttcgcgcgctccctcgcggggtccccccatgggt

SEQ ID NO: 69114 - protein, 86 aa, Zea mays
  misc_feature: Ceres CLONE 1546406
  misc_feature (75)..(75): Xaa is any aa, unknown, or other
MLSGVRSAARKRLFRSDPAELLGVANWSETGGGGAGGHQHWWTALENNFVLEATDDEYGGGSSSTPIGCRPTGAXSRAPSRGPPMG

SEQ ID NO: 69115 - DNA, 675 bp, Zea mays
  misc_feature: Ceres CLONE 1546410
  misc_feature: Encodes the peptide sequence at SEQ ID NO. 69116
  misc_feature (609)..(609): n is a, c, t, g, unknown, or other
tccccgcggtggcggccgctctagaactagtggatcccccgggctgcaggaattcgtctcacccctagaaaaagttttgcgtctcaccacttatcattcatcactgctacttcgttcgagagggatacggataccccattgccggcccactggcgagagagattttggtgcgactacagagtcccaatcctataccccggccccaaaactcttctctgctaccagtgaccgttccttccgccggaatcgattttctgagggggcgagttccgccaccgtgggcgtatcaatatcggcgaacgctcgagttctcgtggcgaaaaacaacgcgttctgcgaggattccgtggtgaaagaccggggccttttttctgcggattccagctgccaaacagagatgtcggctctcctcgacctactgatggggatcttccgccagcagaccctcggcggcgccgccctggagctggccgcgctggcggcgcccctctggctcgccgctctcgtcggcctcctcatcgggtgggcgtggcgcccgaggtgggcaggggtcgtcgtcggcgaccacaatgctcagcaggcggggcagctccctccgccgcccgccgnttgcgggggtggtccctcgcaacgaggcgccccgcgtcgtaccgaggactgggggtggtcctgcac

SEQ ID NO: 69116 - protein, 92 aa, Zea mays
  misc_feature: Ceres CLONE 1546410
  misc_feature (71)..(71): Xaa is any aa, unknown, or other
MSALLDLLMGIFRQQTLGGAALELAALAAPLWLAALVGLLIGWAWRPRWAGVVVGDHNAQQAGQLPPPPAXCGGGPSQRGAPRRTEDWGWSC

SEQ ID NO: 69117 - DNA, 624 bp, Zea mays
  misc_feature: Ceres CLONE 1546411
  misc_feature: Translation starting site: 220
  misc_feature: SWISSPROT Homolog: EC 2.7.11.1 Non-specific serine/threonine protein kinase
cggtggcggccgctctagaactagtggatcccccgggctgcaggaattcgtctcgcccctagaaaaagttgcagacagctacagccgtatgtccgtgtgacattctgctcagtcggccaatcctcaccaaattctccatcaaatccaaccaacccctcaccgcctatgccgccgcgggccgcctagggttccggcggccgccgctccctcgccggcgcaatggggaacacctgcatgggtcccagcgccccctcggaccgccacagcttcttcaacaacctctccctggacgtgctctggcgacccccggccgccgctgacggcggcgagccttccccgaccgctgaaacccagatcatccactccctgctctcccgcgctccagggcccctaaccccgccaccatatccgactccgagcacccgccacactccacctacaccgccttaggccccgccgcccgcccaatcctaacggcaagcccaagcccaagcccaaggtgaagcgcgtgcagagcgccggcctcctcgccggctccgtgctgaagcgcgactcccagcggctcaaggacgtctacaccctgcgcaagaagctcgggcaggggcagttcggcacctcctaccg

SEQ ID NO: 69118 - DNA, 662 bp, Zea mays
  misc_feature: Ceres CLONE 1546412
  misc_feature: Encodes the peptide sequence at SEQ ID NO. 69119
gcggtggcggccgctctagaactagtggatcccccgggctgcaggaattcgtctcacccctagaaaaaacggcgaaatcaccgctcgctacctagtactcgtcactcgtgtacacgtgtagcaagcacgaagcagcaaaggcgggatcggcagccatggcgatgatggacaagtggacaggcctgggctcggcgctggcaagcatgctcttcctctggtccatggtgcagaaccacctccccgccgccttcggctaccgcctcagcacctgggggaacaagctcgcctctctcttcagcccttacctggagatcaccatctccgagtacggcgccgagcgcttccgccgcacccacttcgtcgggggcggggagggctacctctccgacgcctgctcccgccgcgcggcgcagctccgggccgacctcggcaaggacagccagaacctccgggtctccgtcgaccaacacgacgaagtcaccgacgccttctccggggcccccatcctggtggtccccgtccaagcacctgggccggtcccagggcattcacctccaccccggggaaggaccaacgcccccttctacccgggccgtcttccaaagggcgcccccgggacccccttttcaaaaaaagacccggcccccggttcttcgaggaag

SEQ ID NO: 69119 - protein, 169 aa, Zea mays
  misc_feature: Ceres CLONE 1546412
MAMMDKWTGLGSALASMLFLWSMVQNHLPAAFGYRLSTWGNKLASLFSPYLEITISEYGAERFRRTHFVGGGEGYLSDACSRRAAQLRADLGKDSQNLRVSVDQHDEVTDAFSGAPILVVPVQAPGPVPGHSPPPRGRTNAPFYPGRLPKGAPGTPFSKKDPAPGSSRK

SEQ ID NO: 69120 - DNA, 1117 bp, Zea mays
  misc_feature: Ceres CLONE 1546414-R
  misc_feature: SWISSPROT Homolog: EC 4.3.1.5 Phenylalanine ammonia-lyase
  misc_feature (1)..(1): n is a, c, t, g, unknown, or other
  misc_feature (696)..(696): n is a, c, t, g, unknown, or other
naaaaatagagaccgggccccccctcgaggtcgacggtatcgataagcttttttttttttttttttatacggatcgatcaatacaaccaaaaatcaacaacgaagagcgatcgacggcacgatctggacagacacgtgtacaggttttattttttttcacgtatttcctcccctccctcctcttctccttggcgttcttttacttgatgttgatgggcagcggcttgccatcccactccttgaggcactcgagcatggggtccacgagcttgccctggctgatgccgacgaacaccttgttgcactcctcgccgggggacttgagcctatcgccggtcaggaacacacaaccgagctcctcgcgcacgaagcggtacagcgggaacgacccgttgtcagtggggccccctttttattgggggcggggcccctctggtaaccgcccaccgcgggcaggcgcgtccacctcctgggggaagccaccggcgtcggaggttcccttcctcgaaaaaccgggttgattctttgggaaaaaacacgggggagggggttttccgagtctcccgtgagttacaaacccttgttttaaaaaggggcggtgtggtctcgaaacccggacagtgagaatgtcgcccggagaatttgttgggcccaaatttcaccgcggcaaaaagagcctgggtgtgcctcttttgngaaccgtcaacttatctctcctctcccataagagattgatctctgggaggaagaaatagtgcggagaccaccgagtgcggagaccacctagatgagagacgcatctcatcagatagcaatgcccatacttactttattctgccttgttgataaaataacacgggacgctccctgtttgaaaagaaactccttatgacctctcgaaagagaggttgtgtataggaggtgtgggcgcgctagacttttttctttcggctccccccctatgtgactctctccgcggttgattttacaattctccactaatacaagttcgggggactttatactccgcataaagggtaaatatgtaccagtgtatataggtcttgtgtgtagggcgacatgcataacggaggtgggtggcgataaaagagctcgg

SEQ ID NO: 69121 - DNA, 680 bp, Zea mays
  misc_feature: Ceres CLONE 1546417
  misc_feature: Encodes the peptide sequence at SEQ ID NO. 69122
  misc_feature (416)..(416): n is a, c, t, g, unknown, or other
ctggagctccccgcggtggcggccgctctagaactagtggatcccccgggctgcaggaattcgtctcacccctagaaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacacccntatgaggttttgagtgatccagagaaacgtgagatttatgatcagtatggtgaagatgccccttaaggaaggatggggcgtggaggatcccatggtgaaccctttgacatcctctcctcattttttgggaccctcctttggaagagggggtggaaagccccggggaagaaaggcaaaggagggggaaaaaaatgtatttccccccccttaaagtttccccggaaagatctttaacaagggccccctcaaaaaaaccctccccct

SEQ ID NO: 69122 - protein, 78 aa, Zea mays
  misc_feature: Ceres CLONE 1546417
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAHPYEVLSDPEKREIYDQYGEDAP

SEQ ID NO: 69123 - DNA, 683 bp, Zea mays
  misc_feature: Ceres CLONE 1546419
  misc_feature: Translation starting site: 158
  misc_feature: Pfam Name: PGI Pfam Description: Phosphoglucose isomerase
  misc_feature: SWISSPROT Homolog: EC 5.3.1.9 Glucose-6-phosphate isomerase
  misc_feature (293)..(293): n is a, c, t, g, unknown, or other
  misc_feature (296)..(296): n is a, c, t, g, unknown, or other
  misc_feature (378)..(378): n is a, c, t, g, unknown, or other
ggcggccgctctagaactagtggatctcttgggctgcaggaattcgtctcacccctagaaaaaagcccgcaatacaaaatccggaggaactcccaggaggcgaaaagcagatccgtctcccccgaccggcgatcgctatcgacttgtagcggaagccatggcgtcggcagcgctaatctgcggcacggagcagtggaaggccctccaggcgcacgtcggcgcgattcagaagacgcacctgcgcgacctgatggccgacgccgaccgatgcaaggcaatgacggctgagtatnaanggatctttctggattactcgagacagcaggcgactggtgaaaccttgtagaacctccttaaatggggggagggggggggaanctcagggagaaaatttcaaaaatgtttaaaggtgaaaagataaatagcccggagaacagggcgggggcttctgtagcctctaagggctccaggagatgcaccctttacccgtgatggggtgaaacggggtcccctgaggttttgaattgttaaacataaaattccaggcgttttccaaaaacttttaaaaaacggaccccgggggttggaggtaccgtgcaaaaccctgtgaccaacgtcgcgttccatttgggaataggggggctgtctttcttggcgccctctgcgttgggcatctcccggcc

SEQ ID NO: 69124 - DNA, 658 bp, Zea mays
  misc_feature: Ceres CLONE 1546429
  misc_feature: Encodes the peptide sequence at SEQ ID NO. 69125
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (410)..(410): n is a, c, t, g, unknown, or other
  misc_feature (422)..(422): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaaaactggaactccccgcggtggcgtgccgctctagaactagtggaatcccccgggctgcaggaattcgtctcacccctagaaaaacagcatttcaagccaccatcgaccttcaagtctcgctacgtagcagtgcaataaaaaaagcagccgcaatggcgagcagcaccatggccctctccctcacggcctttcgcggcaaggccgtgaacgtgccgtcgtcgtccgcctttcgcgaaggccgcgtgacgatgcgcaagaccgcggggaagggcaaagcgggcngcggcgtccggnaagcccgtgggtacgggccccgaccgcgtgcttgtacctgggccccaatgttccggcgaagccccccaagctaacctgacggggcaagttcccgggcggaactacgggttgggaaaaccccggggggtttttcggcgggaaccccgaaaaaattttccccaaaaacccgggagctggggggggggatccccacccccccctgggccaattttggggggaccccccgggtggcttct

SEQ ID NO: 69125 - protein, 71 aa, Zea mays
  misc_feature: Ceres CLONE 1546429
  misc_feature (44)..(44): Xaa is any aa, unknown, or other
  misc_feature (48)..(48): Xaa is any aa, unknown, or other
MASSTMALSLTAFRGKAVNVPSSSAFREGRVTMRKTAGKGKAGXGVRXARGYGPRPRACTWAPMFRRSPPS

SEQ ID NO: 69126 - DNA, 648 bp, Zea mays
  misc_feature: Ceres CLONE 1546433
  misc_feature: Encodes the peptide sequence at SEQ ID NO. 69127
ctccccgcggtggcggccgctctagaactagtggatcccccgggctgcaggaattcgtctcacccctagaaaaaaaggaaggagaagaagacgagtgtcaagtgaacctgaaacttgcggtgtcactggctggtagcctgagtgtgagtgagtgatcgagctagctgagctccgatcctcgctagctaggataccgccataccacaagtcttcttcacaagtttaggagtgacagcaacaagagatcgatggcctctgccaccgtgctcaagtcctccttccttcccaagaagtccgaatggggcgccaccaggcaggccgccgcgcccaggccgcccaccgtctccatggtcgtccgcgcctccgcctacgccgatgagctcgtgaagaccgcggtacgtactatacgctccatcaatcgtacttaggttaatctcttcatcttcctcctccggctgtcgaactcaagtgtgcgtgtgtgcatgctgtgtatacgtacgtacgtacgtatgtgtggacagaaaacgatcgcgtcgccggggcggggcatcctggcgatggacgagtcgaacgcgacgtgcgggaagcggctggcgtccatcgggctggagaacacggaggccaaccggcaggcgtaccgcacgctgc

SEQ ID NO: 69127 - protein, 55 aa, Zea mays
  misc_feature: Ceres CLONE 1546433
  misc_feature: SWISSPROT Homolog: EC 4.1.2.13 Fructose-bisphosphate aldolase
MLCIRTYVRMCGQKTIASPGRGILAMDESNATCGKRLASIGLENTEANRQAYRTL

SEQ ID NO: 69128 - DNA, 469 bp, Zea mays
  misc_feature: Ceres CLONE 1546437
  misc_feature (70)..(70): n is a, c, t, g, unknown, or other
  misc_feature (150)..(150): n is a, c, t, g, unknown, or other
  misc_feature (151)..(151): n is a, c, t, g, unknown, or other
  misc_feature (195)..(195): n is a, c, t, g, unknown, or other
agctccccgcggtggcggacgctctagaactagtggatcccccgggctgcaggaattcgtctcacccctnagaaaaaatgatccgcatacccccattccccgaaggccgagctcatccaatccagtcgcctgattgcattgggatcccanntggccaagctcgccgtccctccctcttcctctcgccgtgggccncgttccccacatgccgtgcacgccccatacccgactgaatcaggtaaccgttgccggccgtccttaatgcgttcttgaatgatcccctgtggggtcctccatggggggatcgtattccctggctggccttcgggtttttaaaggaccggacccccccccccggggggggaaacacccccttggggggggggtttacccagggtttttttccccggagggggggttatatccttaaaggggggggggggggactccaaaaatttccctctgtggg

SEQ ID NO: 69129 - DNA, 651 bp, Zea mays
  misc_feature: Ceres CLONE 1546443
  misc_feature: Encodes the peptide sequence at SEQ ID NO. 69130
  misc_feature (534)..(534): n is a, c, t, g, unknown, or other
  misc_feature (550)..(550): n is a, c, t, g, unknown, or other
  misc_feature (616)..(616): n is a, c, t, g, unknown, or other
ctccccgcggtggcggccgctctagaactagtggatcccccgggctgcaggaattcgtctcacccctagaaaaacacttgatccgctcccttcgccgcgacgacgttcctacgcagctgcggtcgacgcgcgcacggcagctcgctcgctagctgatcacgacagctcgctcggctcgaccgaatggcgccgcggctgctggcgtgcttcgggcgcggcgtcgcggcggcgccggacgacgctactggcgagggccagctggaggcgccccccgctggcccggtgctggtggagctgttcgggtcgcaggggtgcggggcgtcgcccgaggcggacgccgtggcggcgcggctggcgcaggactccgggtccggggacggcgccgtcgtggtgctggcgttccacgtcgactactgggactaccgcgggtggaaggaccccttcgcgtccagcgcctggaccgtgcgccagaaggcctacgtggaggcgctccgcctcgacacgctcttcacgccgcaggtcgtcctgcagggncgcgcgcactgcgtcngcaccgaccaggacgcgctcgcgctgggccgtcgcgacgccccgggctaccccggggccggcattnaaggtcacgtttccagcggccgagcccccgaaact

SEQ ID NO: 69130 - protein, 156 aa, Zea mays
  misc_feature: Ceres CLONE 1546443
  misc_feature (14)..(156): Pfam Name: DUF1223 Pfam Description: Protein of unknown function (DUF1223)
  misc_feature (123)..(123): Xaa is any aa, unknown, or other
  misc_feature (145)..(145): Xaa is any aa, unknown, or other
MAPRLLACFGRGVAAAPDDATGEGQLEAPPAGPVLVELFGSQGCGASPEADAVAARLAQDSGSGDGAVVVLAFHVDYWDYRGWKDPFASSAWTVRQKAYVEALRLDTLFTPQVVLQGRAHCVXTDQDALALGRRDAPGYPGAGIXGHVSSGRAPET

SEQ ID NO: 69131 - DNA, 688 bp, Zea mays
  misc_feature: Ceres CLONE 1546445
  misc_feature: Encodes the peptide sequence at SEQ ID NO. 69132
  misc_feature (283)..(283): n is a, c, t, g, unknown, or other
  misc_feature (284)..(284): n is a, c, t, g, unknown, or other
  misc_feature (655)..(655): n is a, c, t, g, unknown, or other
tggagctccccgcggtggcggccgctctagaactagtggatcccccgggctgcaggaattcgtctcacccctagaaaaaatccctaatttttactccacaccagtgaaacacgacccgctggccgctggccgctgccacgctcccacgcccgagcccgagcccgggaccacgaggcagccagaagacgcgcgcgcccctctcgggtctcggccgcgccgtcgcgctcaccaggtctccaccatcaccagagtggcggcgctctctcctatcgcggcgagcacnngcggcgatgggaggaggggagatggcggggtggctgaaggcactggcgtacagcgccgggggcgtagcggtggccggcctagcggcgttggttgcgctgcaggagcgcctcgtctacgtgcccgtgctcccgggtctggcgcgctcgtaccccatcacgcccgcccgcctcggcctcatctacgaggatgtctggctccgtgccgcggacggcgtgcggctccactcctggttcatccgtcactcccccagctaccgaggtccaaccattctgttcttccaagaaaatgctggcaacatcgctcaccgtttggaatttgttcgactaatgatgcagcgactacagtgcaatgtttttatgctttcttatanaggtatggtgagagtgatggttatccttctcaa

SEQ ID NO: 69132 - protein, 127 aa, Zea mays
  misc_feature: Ceres CLONE 1546445
  misc_feature (117)..(117): Xaa is any aa, unknown, or other
MAGWLKALAYSAGGVAVAGLAALVALQERLVYVPVLPGLARSYPITPARLGLIYEDVWLRAADGVRLHSWFIRHSPSYRGPTILFFQENAGNIAHRLEFVRLMMQRLQCNVFMLSYXGMVRVMVILL

SEQ ID NO: 69133 - DNA, 616 bp, Zea mays
  misc_feature: Ceres CLONE 1546449
  misc_feature: Encodes the peptide sequence at SEQ ID NO. 69134
gagctccccgcggtggcggccgctctagaactagtggatcccccgggctgcaggaattcgtctcacccctagaaaaaaaaaaaagagcaggaagcggaaagccttccgcgcttttcaaagatcgtaggccgcacgcctgcagcagccgccgactcagggcgagcgttgagaggaggacgaagaagaactgaagaagagcagaccgaagtgaggccgaaggaagggatcgggccttgcgggattcggcagtccatcacgaggtaaatgcggcgctaggagctgcagcgatggcgtcgctggtacccggggtcctcctcaagctcctgcagcacatgaacagcgacgtcaaggtcgcgggcgaccacgggtcgtcgctgctccaggtcgtcagcatcgtgcccccgctccccggggagcgacctgttccccacccaggggttctacctcaaggtggccgactcctcgaacgcccccctactgtcgctgcccggacgaacagcacgaccccatcctgggcgacgtcctccaggtggggcagttcgccccggtccattcgcccgggggggccccccccggtgccttccccaggggggtcaggccgggtcccgggccccct

SEQ ID NO: 69134 - protein, 109 aa, Zea mays
  misc_feature: Ceres CLONE 1546449
MASLVPGVLLKLLQHMNSDVKVAGDHGSSLLQVVSIVPPLPGERPVPHPGVLPQGGRLLERPPTVAARTNSTTPSWATSSRWGSSPRSIRPGGPPPVPSPGGSGRVPGP

SEQ ID NO: 69135 - DNA, 650 bp, Zea mays
  misc_feature: Ceres CLONE 1546451
  misc_feature (650)..(650): n is a, c, t, g, unknown, or other
ccgctctagaactagtggatcccccgggctgcaggaattcgtctcacccctagaaaaagttcggttgttccttcccacttcctctctctcgcgcgcctgtactacttttgaagccgcaaggtcagaagagaggatccacctctcagttcgattttcggtggctgaagtccttctacctcggggggtttgagcgttttccttgataaatttgtgtttcttcgagagtttattttttgtgttttctcttgagagattcgtgcgaaggacgtcgtcttcggtccattttcttgggtagtcgaattgctcttatacagcgtcaaagcatccaactttgacttctccgtggtggcttcttctactactctgtgttgtcgaggagacaatttaatctttatttaattgggttggatgcttgttcaagttgcagttgaaaaggtagcagaagacaccataaatcctggtgattttgggtgcttatctgctgaataattgagggtcaaaggaaaccatttgcagtttcttacttcctcgttttcctggggaagatttgggtgaaatttcgttgcccggaaaagaacttcccttcaatcccttccctccttgggtttttatggcatttgggggggttgggggaaattctttcacttttn

SEQ ID NO: 69136 - DNA, 658 bp, Zea mays
  misc_feature: Ceres CLONE 1546457
  misc_feature: Encodes the peptide sequence at SEQ ID NO. 69137
  misc_feature (348)..(348): n is a, c, t, g, unknown, or other
tccccgcggtggcggccgctctagtactagtggatcccccgggctgcaggaattcgtctcacccctagaaaaaaaaaaaatagcgtcttttatcatatccgttgctcgcaaaacgcccccacacgccgccggcgaatcggcgactccccttgcgacgggaggaagcagccacgccgccgtctcggcgcctccctgacgactgcctctccggtctcgaacgcgatctggcccatggtggctctggcgccgttggttcgtgagatctagggttgtcgagcgccgcggagtgggagcggatggggcgccggaagatgtccgcagcggcgccgccgtcccggagctggtccnacgttggcgggagcgtaatccccgaactacgggcaaaacacaaaatggacttggaaaatttgacgctgacaaaacattccatcagaacataactttttttcctgttagccatgttacaatacttgaaaagattagcaccatattcctgaaaaagagtggtttgtccttcccctaaatgttttggggggaagctcccggaatcttcctcccatttcagatggcccgcttaaaagcatggtgcggagttccctaatgtgcaaaatccgggtggggggggattcacttgggggggggtccccaatgggacaga

SEQ ID NO: 69137 - protein, 47 aa, Zea mays
  misc_feature: Ceres CLONE 1546457
  misc_feature (18)..(18): Xaa is any aa, unknown, or other
MGRRKMSAAAPPSRSWSXVGGSVIPELRAKHKMDLENLTLTKHSIRT

SEQ ID NO: 69138 - DNA, 651 bp, Zea mays
  misc_feature: Ceres CLONE 1546459
  misc_feature: Encodes the peptide sequence at SEQ ID NO. 69139
  misc_feature (597)..(597): n is a, c, t, g, unknown, or other
gctccccgcggtggcggccgctctagaactagtggatcccccgggctgcaggaattcgtctcacccctagaaaaaaaatgcctgcgcattagcgatcctcctcgctctccttccccttccgctgagccgtgctgccgcggccccggcacgccatggcgtccacggcgtactcgcggtcgtcgtccaacaagctgccgggcggcgagcggcggctgcccccgcgcctcatgcggggcctcacgtccaaattcgagcccaagaagctgggcgtcggcctcgtcgccggctgctgcctggcgctcctcacctacgtctccctcgccaagctcttcgcggtctactcccctgtattcccagcccggccaacaggggcgcgctgatgcagcggaacgcgccgctggccctcctccaagccgtccgtgccggagacggagaccatacctccggaggaaaccctggaacaaccgcgaccggcccgaatacccgccaatcttgcgtgggaacgaaccccgccttgccggaaaactgcccccctgaaggaacaacctgggcagcggggggcccaaaaagcccgggttgcccacccaagaaggaggngcgcccggaaaccccgagcccaaacccccccaaaaaaaccccccggagggaggg

SEQ ID NO: 69139 - protein, 75 aa, Zea mays
  misc_feature: Ceres CLONE 1546459
MASTAYSRSSSNKLPGGERRLPPRLMRGLTSKFEPKKLGVGLVAGCCLALLTYVSLAKLFAVYSPVFPARPTGAR

SEQ ID NO: 69140 - DNA, 716 bp, Zea mays
  misc_feature: Ceres CLONE 1546460
  misc_feature: Encodes the peptide sequence at SEQ ID NO. 69141
  misc_feature (466)..(466): n is a, c, t, g, unknown, or other
  misc_feature (472)..(472): n is a, c, t, g, unknown, or other
ctggagctccccgcggtggcggccgctctagaactagtggatcccccgggctgcaggaattcgtctcacccctagaaaaaacagcccaagaccaccgcaccgcacctgcacaccgccagggatggcggcaaccgcgcacctcaccggtgtcctcggcgtgtcgtcgccgcctctcgctccgtcccactgcagctgcagcggcgccaagaagcagagctgctctctgcgtcaggggcggcagcagaggaggcgcctccgcgtcgcccgcgccgtcgaggtggacgcgccttccgccggcgcaccggagccggaggaggcggaggagccgtccgtcgacttcgctttcgtcagcccgcggctgctgccggacgggacgccggacgtgcactaccggacggcgcgcggcgggcagaagctcagggacatcatgctcgacggctacatcgacctctacgggccctacgantaaggntctctcactgctcagggggcggcctgtgccgggaccctgcatcctcccaaggtggtttgagcgcaaggaaatgctgtccccaaaactgatggggaaaaaggagttgctcaaaagaaaccccaaacctggaaaatgggcgtgccaagaaaaggggggcacaccaaaattcccctgggcacaataaacttttcaactgttgcccggagggaaaaaaccccagatggggaacaaaggggggtttcct

SEQ ID NO: 69141 - protein, 114 aa, Zea mays
  misc_feature: Ceres CLONE 1546460
MAATAHLTGVLGVSSPPLAPSHCSCSGAKKQSCSLRQGRQQRRRLRVARAVEVDAPSAGAPEPEEAEEPSVDFAFVSPRLLPDGTPDVHYRTARGGQKLRDIMLDGYIDLYGPY

SEQ ID NO: 69142 - DNA, 589 bp, Zea mays
  misc_feature: Ceres CLONE 1546465
  misc_feature: Encodes the peptide sequence at SEQ ID NO. 69143
  misc_feature (269)..(269): n is a, c, t, g, unknown, or other
  misc_feature (275)..(275): n is a, c, t, g, unknown, or other
  misc_feature (302)..(302): n is a, c, t, g, unknown, or other
  misc_feature (512)..(512): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
tggagctccccgcggtggcggccgctctagaactagtggatcccccgggctgcaggaattcgtctcacccctagaaaaagttttctccccagctccaagccggacgacgcagcgtagcagcagagagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttnctccgncccgcgcctggggggccctgtccctcngggtgggttgggtgtttttgggggaaattacccttgggcccgggggcccaaaattacggggggggttaacccccccgtggggggggggttccaaagggggttctccccaaaagggggggggaaaaaagaatcccctccacaaaaaaaacccccctccccccccccccccttaaaaaaaaaaaaaaaaagcccccccgccaaaaagaaaancccccccacccccgcggggnnnnnnnnnnnnnnnnnnnccccccccccccctcccttaaaaaaaaaaaaacaaaccg

SEQ ID NO: 69143 - protein, 76 aa, Zea mays
  misc_feature: Ceres CLONE 1546465
  misc_feature (43)..(43): Xaa is any aa, unknown, or other
MAALAAASTAAFAAKPRARLSVACSAATGDSSSVSLASSVKTXLRPAPGGPCPSGWVGCFWGKLPLGPGAQNYGGG

SEQ ID NO: 69144 - DNA, 706 bp, Zea mays
  misc_feature: Ceres CLONE 1546470
  misc_feature: Translation starting site: 535
  misc_feature (341)..(341): n is a, c, t, g, unknown, or other
  misc_feature (386)..(386): n is a, c, t, g, unknown, or other
  misc_feature (398)..(398): n is a, c, t, g, unknown, or other
  misc_feature (399)..(399): n is a, c, t, g, unknown, or other
  misc_feature (408)..(408): n is a, c, t, g, unknown, or other
  misc_feature (418)..(418): n is a, c, t, g, unknown, or other
  misc_feature (467)..(467): n is a, c, t, g, unknown, or other
  misc_feature (468)..(468): n is a, c, t, g, unknown, or other
  misc_feature (510)..(510): n is a, c, t, g, unknown, or other
  misc_feature (517)..(517): n is a, c, t, g, unknown, or other
  misc_feature (564)..(564): n is a, c, t, g, unknown, or other
  misc_feature (565)..(565): n is a, c, t, g, unknown, or other
  misc_feature (578)..(578): n is a, c, t, g, unknown, or other
  misc_feature (588)..(588): n is a, c, t, g, unknown, or other
  misc_feature (589)..(589): n is a, c, t, g, unknown, or other
  misc_feature (612)..(612): n is a, c, t, g, unknown, or other
  misc_feature (613)..(613): n is a, c, t, g, unknown, or other
  misc_feature (626)..(626): n is a, c, t, g, unknown, or other
  misc_feature (627)..(627): n is a, c, t, g, unknown, or other
  misc_feature (662)..(662): n is a, c, t, g, unknown, or other
  misc_feature (680)..(680): n is a, c, t, g, unknown, or other
tggagctccccgcggtggcggccgctctagaactagtggatcccccgggctgcaggaattcgtctcacccctagaaaaatatttccatcctccattcacgcatcacaagctggaaggcactgtgggcaataatggctctgctcacgctccagcagccagcgatacccttcctcctgctcctcctcctgctccccgccgcgtccgctaggctgcccggtggccggacactggtcttcatcctggctgggcagtccaacatgagcggccgcggcggcgccaccaacggcacctgggacggcatcgtcccccgccggagtgcgcgccctcggaaccgcatcgtnccgtctctcccccgggcgcttcggctgggagcaggcgcgcgagcnctgtcaccccgnngcgtcacgntgggcaacgnttttctcggctcggggccccggcatgccccttcggcgcacgccgtgctnncgccagcgagggcgcagccgcagagcccccccccgtcgtcgntcggggnctcgtgcccgtgcgcgcatggcgttgcacgccgaatcgccaactggnntcccggggggacngagctgtacnnaagcggatggtgacgcgcgccanngggggcggccccnntggcccaaaatgcagcggaaacgcgtcaacctggncgcccttggctttgttanccaagggggaaggcggacaccccatg

SEQ ID NO: 69145 - DNA, 654 bp, Zea mays
  misc_feature: Ceres CLONE 1546472
  misc_feature: Encodes the peptide sequence at SEQ ID NO. 69146
  misc_feature (276)..(276): n is a, c, t, g, unknown, or other
  misc_feature (398)..(398): n is a, c, t, g, unknown, or other
aacctggagctccccgcggtggcggccgctctagaactagtggatcccccgggctgcaggaattcgtctcacccctagaaaaaagataagaagccgggcttaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaanaagagggtgttccacttcggcaagggcaagagcgagggcaacaagaccatgaaggaactgctgggcggcaagggcgcgaacctggcggagatggcgagcatcgggctgtcgtgccgcggggntcacggtgtcgacggagcgtgcagcagtacaggacgcgggtgcgcctccccgcgggctctgggccggatcgtcaacgctgcagtgggtggaggatacatgggcccccccttggggaatcccaggggcggttctggtttccgtcccttcgggccccccctgtccatgccccggaataaggaacccggcccaacctggggcaaaaacaaaaatgggcccccggggttgggggcaaaaacggggaaccccttcccccac

SEQ ID NO: 69146 - protein, 110 aa, Zea mays
  misc_feature: Ceres CLONE 1546472
  misc_feature: SWISSPROT Homolog: EC 2.7.9.1 Pyruvate, phosphate dikinase
  misc_feature (25)..(25): Xaa is any aa, unknown, or other
MKELLGGKGANLAEMASIGLSCRGXHGVDGACSSTGRGCASPRALGRIVNAAVGGGYMGPPLGNPRGGSGFRPFGPPLSMPRNKEPGPTWGKNKNGPPGLGAKTGNPFPH

SEQ ID NO: 69147 - DNA, 653 bp, Zea mays
  misc_feature: Ceres CLONE 1546474
  misc_feature: Encodes the peptide sequence at SEQ ID NO. 69148
ggagctccccgcggtggcggccgctctagaactagtggatcccccgggctgcaggaattcgtctcacccctagaaaaaccaatgagggtggcaggaaggagctggagcagtacgaggctgcagccatgggagccacaggaacaggggtgaaggaggttgatccagatgatgagtatgacgatggcatcgatacacaggatgaaatggaggatgctcacctgcattcatctgatggtgagaggaagcttggtggtggcagccatgagggtgctgagaaggacagggtcgctactgagaggcacacagaagcaggtggagggattgcgggtagtcatgatattagcagcccagacaaaaagaaggtttcaggtactggagacaagaagcatgggcccaagaagaaaccgacacgcaagaagtctggttcaatttgtcaaatgaagttttcttactcaactgctcagcttgtggagcctgcgaggaatgagaaatttgctagttttaagttggagtatgtagaaagtgaagaaagacctatgggatcagaattttgggaaccgagatttgccgggccaccaaacctgccagaaaaaaggagtcctacaaagcccatgaccaaacattgacatgccctttcctttaagggtccaaag

SEQ ID NO: 69148 - protein, 166 aa, Zea mays
  misc_feature: Ceres CLONE 1546474
MGATGTGVKEVDPDDEYDDGIDTQDEMEDAHLHSSDGERKLGGGSHEGAEKDRVATERHTEAGGGIAGSHDISSPDKKKVSGTGDKKHGPKKKPTRKKSGSICQMKFSYSTAQLVEPARNEKFASFKLEYVESEERPMGSEFWEPRFAGPPNLPEKRSPTKPMTKH

SEQ ID NO: 69149 - DNA, 677 bp, Zea mays
  misc_feature: Ceres CLONE 1546475
  misc_feature: Encodes the peptide sequence at SEQ ID NO. 69150
  misc_feature (265)..(265): n is a, c, t, g, unknown, or other
  misc_feature (389)..(389): n is a, c, t, g, unknown, or other
tccccgcggtggcggccgctctagaactagtggatcccccgggctgcaggaattcgtctcacccctagaaaaaaccatcaccaccagccagcaccacccctcctgcccctctgcgctggcgggccgagcgccgcgagcgagctgggccgcgggcggaggaggagtcgaggctgaccgaccccgcggccggcggcgacgagcggacgcagattcggcagccgtgcgcggaatgcccgtggaaggaggggagagagggagggcgcangcgcagctgagctgagctgagcccgcgaggttcgcggtctgcggtgcggcggcagaggtctcgccagcgcgatggccagcggcggctcctccaggtacagctcgtacaaggcgccggggctgcncggcgcgctgctggaggcggcgcacgtgtcgtgcctcgaggacgggtacgcgctgggcccgcagctggggtggggccagttcggcgtgatccggtcctgctccgacctggtcaccggcgaggcgctggcctgcaagtccctcgccaggggcggcctcgtgtcccccgaccacgttgcgcggggtcaggctggaaaatcgacctcctggccccgccccgggcgggcaccccccacctcctgggggcctcagggccctggtccgaggacccccaactccgggcgccctcc

SEQ ID NO: 69150 - protein, 113 aa, Zea mays
  misc_feature: Ceres CLONE 1546475
  misc_feature: SWISSPROT Homolog: EC 2.7.11.1 Non-specific serine/threonine protein kinase
  misc_feature (18)..(18): Xaa is any aa, unknown, or other
MASGGSSRYSSYKAPGLXGALLEAAHVSCLEDGYALGPQLGWGQFGVIRSCSDLVTGEALACKSLARGGLVSPDHVARGQAGKSTSWPRPGRAPPTSWGPQGPGPRTPNSGRP

SEQ ID NO: 69151 - DNA, 681 bp, Zea mays
  misc_feature: Ceres CLONE 1546484
  misc_feature: Encodes the peptide sequence at SEQ ID NO. 69152
  misc_feature (304)..(304): n is a, c, t, g, unknown, or other
  misc_feature (383)..(383): n is a, c, t, g, unknown, or other
  misc_feature (387)..(387): n is a, c, t, g, unknown, or other
ggatcccccgggctgcaggaagtcgtctcacccctagaaaaaacacaccaccactccttccctgccctctcactcccgatccctcctccaccaccgcttcctccgcgtcacccctctcgtcgtcgcctcacgaggcgaccagcggcggaccctccgcggcgcaaccatggggctcttcactgtgacgaagaaggccaccacgcccttcgacggccagaagcccggcacctccggcctccgcaagaaggttactgtattcgagcagccccattatctgcagaactttgtccagtcgacattcaantgcccttcctgtggatcaagtcacacgtgcaacaattgttgtctctggtgatggctgtttttggccccccaccccccgntcanatcatcacaaaaatgggtgctgccattggaataaaaaacctcgttggggttggaaaaaacagtccgagggtgaaccccgggctgaatctggtggtcttcccgtctaaaaagttgggggcaaatgggaacaaagggctactggggccctttttatttggaagaggaagcaaataaccaaagtgggtctccaaagggaggacctttccggataaaaaaacaaacaagtgaggacaatggtggggccccccgcccccaaaaacccgatcacacccccacaagtattttctcccttag

SEQ ID NO: 69152 - protein, 62 aa, Zea mays
  misc_feature: Ceres CLONE 1546484
  misc_feature: SWISSPROT Homolog: EC 5.4.2.2 Phosphoglucomutase
  misc_feature (46)..(46): Xaa is any aa, unknown, or other
MGLFTVTKKATTPFDGQKPGTSGLRKKVTVFEQPHYLQNFVQSTFXCPSCGSSHTCNNCCLW

SEQ ID NO: 69153 - DNA, 698 bp, Zea mays
  misc_feature: Ceres CLONE 1546486
  misc_feature: Encodes the peptide sequence at SEQ ID NO. 69154
ggagctccccgcggtggcggccgctctagaactagtggatcccccgggctgcaggaattcgtctcacccctagaaaaaacacaaccaagctcgatccatctcactctccgctggtcgctcactcttgcagctccacccttcactcagtcttagtctcttattagctctaggctctagctagccgcgccactccttcgtgtagccatcagccttctcatcgccaccaatggccactgccgaggtccagaccccgaccgtcgtggcggccgaggaagcgcccgtggtggagaccccgccgccggccgtcgtgcccgaggagtctgcccccgccgaggccgaggccgaggccgaggctgctgctcctgctgatcccgaggagcttcccgcggccgagcagcaggcagccgccgaggcggaggccgcggctcctgctggtgccgaggagcccgtcgcggccgaaccggccgccgaggcggaggctgctgctcctgctggtcccgaggagactcctgcggtcgagcaggaggcagccgccgaggaggaggctgctgctgctcctcctgctggtgccgaggagcccgccgcggccgagcctgtcgccgaggcagaggctgctgctcccgaggagctcgccgcggacgagccggaggctcctgctcctgctcctgctggtccccaggagccggccgccgaggcgg

SEQ ID NO: 69154 - protein, 157 aa, Zea mays
  misc_feature: Ceres CLONE 1546486
MATAEVQTPTVVAAEEAPVVETPPPAVVPEESAPAEAEAEAEAAAPADPEELPAAEQQAAAEAEAAAPAGAEEPVAAEPAAEAEAAAPAGPEETPAVEQEAAAEEEAAAAPPAGAEEPAAAEPVAEAEAAAPEELAADEPEAPAPAPAGPQEPAAEA

SEQ ID NO: 69155 - DNA, 705 bp, Zea mays
  misc_feature: Ceres CLONE 1546490
  misc_feature: Encodes the peptide sequence at SEQ ID NO. 69156
tggagctcaccgcggtggcggccgctctagactagtggatcccccgggctgcaggaattcgtctcacccctagaaaaaaaatctctgtctcaaaacgtgaactagaaccaccagccaccatttcatacgatctcatcacacttcttagttaccatctccagcgaccttcctcgggggtactaagccagatccgcgctcgtcgaaatcccgactcccgaggtcctccccaagcccgagggccggtcgtctccatggcggggatcctggcgtgggcggctgacgtggtcggggggggccggcggcagcgacgacgaggcggacgatgacgcgcgcgccgcggcgtcggccgccatgaccccggcccagcggctccgcgccgccgacctggacgcgcgggcggcttcgctgcgccgcgccatccaggacctccgcctccgggtgcccccgccgcacgtcgcgcagcgcctgccccacctccacgccgactcactcgcgtcgtccgccgcgctcgcgctccagctcaacgcgcactcctccaccaaggagcagacccaacaaagagaagtaactctccaagaagaaaatgcagcctatgagaaagctatatcagagtgtaaacagaaaattcaggaaaagcagatggaggccactcagcttctgagtaatctggaggaaatggaagtaacagagcataatttaaagaca

SEQ ID NO: 69156 - protein, 118 aa, Zea mays
  misc_feature: Ceres CLONE 1546490
MTPAQRLRAADLDARAASLRRAIQDLRLRVPPPHVAQRLPHLHADSLASSAALALQLNAHSSTKEQTQQREVTLQEENAAYEKAISECKQKIQEKQMEATQLLSNLEEMEVTEHNLKT

SEQ ID NO: 69157 - DNA, 709 bp, Zea mays
  misc_feature: Ceres CLONE 1546503
  misc_feature (255)..(255): n is a, c, t, g, unknown, or other
  misc_feature (256)..(256): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (296)..(296): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (302)..(302): n is a, c, t, g, unknown, or other
  misc_feature (303)..(303): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (318)..(318): n is a, c, t, g, unknown, or other
  misc_feature (320)..(320): n is a, c, t, g, unknown, or other
  misc_feature (321)..(321): n is a, c, t, g, unknown, or other
  misc_feature (325)..(325): n is a, c, t, g, unknown, or other
  misc_feature (327)..(327): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (396)..(396): n is a, c, t, g, unknown, or other
ctggagctcaccgcggtggcggccgctctagactagtggatcccccgggctgcaggaattcgtctcacccctagaaaaattcagcagctgacccgagccgcagatggtctcacccggccgcagaggcttagcgttgagagccacatgttgagtgaacagacggcggctagcactagcagcggcgagcatcaggagaggagcgtcgtcgaggacaggcggctacagccggtgggggaacacaagaagcgggggaannannnnnannnnnnnnnngnnnnnnnnnnannnnnnnnganannngnngnnnnnntggnnntntnnaaantnaaagatgagatagtnnnggtgccaaaaaagattgttgatcctaaaattggggaggagaaggaatttgtnaaaacacctgattgatgggattagggcagggaaaacaagatctggattggggaaacttcaaccccgtttttagaaaaccctgggcctcatcacctccggggaatttccattcaagtagcgctgggcctgaactttgtcctcccttaaaagatctggtgcctccaaaaaaggggttcccccttctttgggttttttaggccccggggggggggttcctcttttaaagcaaaaaaacccccggggaaaaaaaatcaaaattttgggtttgcccccctgtgtttggaaattaaaaggggggaaccacctttttttt

SEQ ID NO: 69158 - DNA, 588 bp, Zea mays
  misc_feature: Ceres CLONE 1546504
  misc_feature: Encodes the peptide sequence at SEQ ID NO. 69159
  misc_feature (39)..(39): n is a, c, t, g, unknown, or other
  misc_feature (48)..(48): n is a, c, t, g, unknown, or other
  misc_feature (68)..(68): n is a, c, t, g, unknown, or other
  misc_feature (274)..(274): n is a, c, t, g, unknown, or other
  misc_feature (468)..(468): n is a, c, t, g, unknown, or other
tcccgcggtggcggccgctctagactagtggatcccccngggctgcanggaattcgtctcacccctangaaaaagtctatcgcaggggggcattaagctgcctgcctccgctgccggccgtgctacctaatcgccgcgcttgttttcccaccgcccgatggccgccatcacgccgccgacgcagtcggagccgtcgccgcagacggggcgcccggcctcgtctgccgccgccgcggccaagcgtggagggggcggggctggtgcccgctgcggnccgctgatggggaagtacgagctggggcgcctcctggggcacggcaacctcgcgaaggtgtacaacgcgcggcacgtcgacacgggggacaacgttgccatccaggtgctcgaccaggagaatgcccctgaaaacgggctcgtcccgcacatcaagggcgaaatccctttggctcccccccggggggccacccnaaaattggtgccctgttcaaaggttttgggcccacaaaaacaaaaaaatctccttcccccagggaggctcctccccccggggggagaagttctttttccccgggttcccaaaggggccaa

SEQ ID NO: 69159 - protein, 143 aa, Zea mays
  misc_feature: Ceres CLONE 1546504
  misc_feature: SWISSPROT Homolog: EC 2.7.11.1 Non-specific serine/threonine protein kinase
  misc_feature (104)..(104): Xaa is any aa, unknown, or other
MAAITPPTQSEPSPQTGRPASSAAAAAKRGGGGAGARCGPLMGKYELGRLLGHGNLAKVYNARHVDTGDNVAIQVLDQENAPENGLVPHIKGEIPLAPPRGATXKLVPCSKVLGPQKQKNLLPPGRLLPPGGEVLFPRVPKGA

SEQ ID NO: 69160 - DNA, 668 bp, Zea mays
  misc_feature: Ceres CLONE 1546515
  misc_feature: Encodes the peptide sequence at SEQ ID NO. 69161
ctccccgcggtggcggccgctctagaactagtggatcccccgggctgcaggaattcgtctcacccctagaaaaactactccggccgcctctcttccagcaaatccctcccacctcctccccgccgtctcacgaggagctagaggaaggggaggctctgtaccagcctgttggaagggggcgagatgagcatgtacgggagggatccctggggcggcccgctggagatatgccacgactcggccacggacgacgaccgcagccgcaacctggacatcgaccgggccgcgctgtcgcggacgctcgacgagacgcagcagagctggctgctggcggggaccgccgaccagccccgcaagaagaacaagtacgtcgacatcggctgcctcctcgtcagccccaagctcttcgtctggacgctcggcgtgctcctcgccgcccgccgtgttcccgggggccgtggccgggaatcccagggcatccccaggggggacccgccgcttgccaccgcccgaagaactccccggtcgcgcttgcaaaaggcgctcatggttcttccatgccccaaaaattcggggaaagcttcccaaagccaaaccatttatcacttgggcgccggaaacccttttgttgagagggaaggggttttttttaacccctggcaataaag

SEQ ID NO: 69161 - protein, 160 aa, Zea mays
  misc_feature: Ceres CLONE 1546515
  misc_feature: SWISSPROT Homolog: EC 3.2.1.4 Cellulase
MSMYGRDPWGGPLEICHDSATDDDRSRNLDIDRAALSRTLDETQQSWLLAGTADQPRKKNKYVDIGCLLVSPKLFVWTLGVLLAARRVPGGRGRESQGIPRGDPPLATARRTPRSRLQKALMVLPCPKNSGKASQSQTIYHLGAGNPFVEREGVFFNPWQ

SEQ ID NO: 69162 - DNA, 672 bp, Zea mays
  misc_feature: Ceres CLONE 1546517
  misc_feature: Encodes the peptide sequence at SEQ ID NO. 69163
ccgcggtggcggccgctctagaactagtggatcccccgggctgcaggaattcgtctcacccctagaaaaagtccggcaccacccagagcttgtccctctcgcgtgttgcttcctcggttcctccccagttccaacttccaagaacccgtgaagtgaagtgaggaggtcggcggaaccggaacccaggcgatacgagatgatcgcaaacggcctccgcaaatccagtgctgcctcctcccaggttagcaagctggtgaaatacattgctagtgctggaagcttgcagggggggcacagtttatcagagccgtctgccagacattacagctctgaaccttcacttcaggcgacagaagaaaatgggtttaaggggcacagcatgctgggctcatttcacagcgggatgggcagagcactgatgtacacccattgggttataaagagatcagaggtttcctatgtctttgacgccagggggaagaagttttttgtccccttgcaggactggggggccaacctttaggggggatggaccccccactttgcaaaagggggcccggaccattaaaaaaaattcccggttccccctttccctttttggaaccgctaaaacccaaccctcgggtggttctcccaaaagaaattttttccccgagttttcccccccggggg

SEQ ID NO: 69163 - protein, 108 aa, Zea mays
  misc_feature: Ceres CLONE 1546517
MIANGLRKSSAASSQVSKLVKYIASAGSLQGGHSLSEPSARHYSSEPSLQATEENGFKGHSMLGSFHSGMGRALMYTHWVIKRSEVSYVFDARGKKFFVPLQDWGANL

SEQ ID NO: 69164 - DNA, 773 bp, Zea mays
  misc_feature: Ceres CLONE 1546519
  misc_feature (358)..(358): n is a, c, t, g, unknown, or other
  misc_feature (418)..(418): n is a, c, t, g, unknown, or other
  misc_feature (535)..(535): n is a, c, t, g, unknown, or other
  misc_feature (596)..(596): n is a, c, t, g, unknown, or other
  misc_feature (716)..(716): n is a, c, t, g, unknown, or other
ctggagctccccgcggtggcggccgctctttaactagtggatcccccgggctgcaggaattcgtctcacccctagaaaactccctccattccctcggctgcgcttcccctcccctcgttccccggctgcttcctccaggccccggcctgatccgcgcgcccgcggggaagagggcctcctctcctccctcctcccttgactcgcgctctggtcgaggaggccgaggccggtgccggcgggagggcggggaggtagttagctgcttgcagttgcgcgagggaaactgcgcgcgctaggctgccatgggggtggagaagacggtgcccggtgcgagtgcggggaggaccgtgctggtcangggcggggcgggctagatcgagagccgcgacgtgtttcatctcctcctcgctgtctaccncggcgtcgacatctatcacctctaaaactactcctagctgggatttccgcggcgtcgactgccttcgggggcgtaccagtacccgcaagctcctcgttccacaagaaagaatatttntgcccaagcgcccacctggaaaacggtgctcccgcttcccccaacaatttgacgctctgcnttgcacttcccctggcctggcgaacctgcgggggtaaaagccctaacggcaacgccaggccctttttttatggaacgacacccgccggtttgtccccccttttatcccctcgcttcatanttattgtcctgtttctgagcgttgaggagtaaaccttacggtggcgcgggctttctg

SEQ ID NO: 69165 - DNA, 685 bp, Zea mays
  misc_feature: Ceres CLONE 1546520
  misc_feature: Translation starting site: 140
  misc_feature (250)..(250): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (291)..(291): n is a, c, t, g, unknown, or other
  misc_feature (292)..(292): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
  misc_feature (298)..(298): n is a, c, t, g, unknown, or other
  misc_feature (299)..(299): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (677)..(677): n is a, c, t, g, unknown, or other
  misc_feature (678)..(678): n is a, c, t, g, unknown, or other
  misc_feature (679)..(679): n is a, c, t, g, unknown, or other
  misc_feature (680)..(680): n is a, c, t, g, unknown, or other
  misc_feature (681)..(681): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
ctccccgcggtggcggccgctctagaactagtggatcccccgggctgcaggaattcgtctcacccctagaaaaattcagcagctgacccgagccgcagatggtctcacccggccgcagaggcttagcgttgagagccacatgttgagtgaacagacggcggctagcactagcagcggcgagcatcaggagaggagcgtcgtcgaggacaggcggctacagccggtggggaacgcagagaagccggggaanannnnnnnnnnncannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncnnnnnnnnnnnnnnnnnnnnnnnnt

SEQ ID NO: 69166 - DNA, 677 bp, Zea mays
  misc_feature: Ceres CLONE 1546521
  misc_feature: Encodes the peptide sequence at SEQ ID NO. 69167
  misc_feature (484)..(484): n is a, c, t, g, unknown, or other
  misc_feature (505)..(505): n is a, c, t, g, unknown, or other
ctccccgcggtggcggccgctctagaactagtggatcccccgggctgcaggaattcgtctcacccctagaaaaagtcgaagccgcagcagctagctagctagcatggccgggaaagagcttacgctgctggggttatgggcgagcccgttcgtgctccgggcgcgcatcgcgctcagcctcaaaggcctcacctacgcatactccgaggagaacctcgacgacaagagcgagcttctcctcagctccaaccccgtgctcaagaaggtgcccgtgctcatccaccacggcaagcccgtctgcgagtcccagatcatcgtgcagtacgtcgacgaggctttccccgccgccgcacctaatttccttccatccgacccctacgaccgcgccattgctcgcttctggggctcctacgtcgacgacaagttctacagcgcgtggatacccgtgttcaggggcaggacggcggaggaaatggccgaggcngcaaggcaggccctcccggcnctggaaacgctggaacaggcgttcagggagtgctccaaggggaggccttccttcgaagggaaggcgtgggggctcctcaacctcttgcccggggggccttgtgggggggttttacccccaccgaagccatttggcggggggaagcccctccaacccccggaggacccccccg

SEQ ID NO: 69167 - protein, 191 aa, Zea mays
  misc_feature: Ceres CLONE 1546521
  misc_feature (4)..(77): Pfam Name: GST_N Pfam Description: Glutathione S-transferase, N-terminal domain
  misc_feature: SWISSPROT Homolog: EC 4.4.1.5 Lactoylglutathione lyase
MAGKELTLLGLWASPFVLRARIALSLKGLTYAYSEENLDDKSELLLSSNPVLKKVPVLIHHGKPVCESQIIVQYVDEAFPAAAPNFLPSDPYDRAIARFWGSYVDDKFYSAWIPVFRGRTAEEMAEAARQALPALETLEQAFRECSKGRPSFEGKAWGLLNLLPGGPCGGVLPPPKPFGGGKPLQPPEDPP

SEQ ID NO: 69168 - DNA, 647 bp, Zea mays
  misc_feature: Ceres CLONE 1546525
  misc_feature: Encodes the peptide sequence at SEQ ID NO. 69169
tggagctccccgcggtggcggccgctctagaactagtggatcccccgggctgcaggaattcgtctcacccctagaaaaagctccgtttcctctctctcctcctattaaccactctccacccgctcgcctcgccctctcgttgagagagtcgtcccctccgcgtgctctccgcctgcggcatctgtatcccacaacgaaaaactaccaaaaaaattagaaatccccaaatccgcgagatctatcagtatcgagcgatttaccgatccgattgctagggtttagtttcgaaaaagaaactctgaaaaaaaattctggtcgaggggaggagacgatggcagcgcaagtggcggcggtggtggtgccgaatgggagcccgggcgctgtccccgcggtggtgtcgccgggagcggtcggcgtcggactcggcgtggcgcagccgctcccgaccacgtcgctctacgtcggcgacctggaggggtccgtctcggactcgcagctgtacgagctcttcagccaggcggggcaggtggtgtcggtgcgcgtctgcagggacgtcacctcgcgccgctcgctcggatacgcctacgtcaacttcaacaaccccttggatgctgcaagggcattggaagtgctgaactttgctcctc

SEQ ID NO: 69169 - protein, 105 aa, Zea mays
  misc_feature: Ceres CLONE 1546525
  misc_feature (42)..(103): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAQVAAVVVPNGSPGAVPAVVSPGAVGVGLGVAQPLPTTSLYVGDLEGSVSDSQLYELFSQAGQVVSVRVCRDVTSRRSLGYAYVNFNNPLDAARALEVLNFAP

SEQ ID NO: 69170 - DNA, 646 bp, Zea mays
  misc_feature: Ceres CLONE 1546529
  misc_feature: Encodes the peptide sequence at SEQ ID NO. 69171
aagctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggctgggacaccgccgggctgtccgcggacccggaaggcgtcgcgcggaacagggcgctgggaggtgattcaccgggccggtggggccattcctggggtgcgcttgggggttgaattcacccccggaaaggggcccgggaaaaaatggggggggggcccctggggaattctcagggggaaaccccccgttggggttgtttaaaagggggccgggggggggcccccaaaaattttttt

SEQ ID NO: 69171 - protein, 119 aa, Zea mays
  misc_feature: Ceres CLONE 1546529
MASTIMAATSRIVAAKTPFLGQGRAAAAAANASPLRDVAAAAAGGRITMGNDLWYGPDRVKYLGPFSAQTPSYLTGEFPGDYGWDTAGLSADPEGVARNRALGGDSPGRWGHSWGALGG

SEQ ID NO: 69172 - DNA, 609 bp, Zea mays
  misc_feature: Ceres CLONE 1546530
  misc_feature: Encodes the peptide sequence at SEQ ID NO. 69173
  misc_feature (184)..(184): n is a, c, t, g, unknown, or other
tggcggccgctctagaactagtggatcccccgggctgcaggaattcgtctcacccctagaaaaaacacaagtctgaacgcttgaacctgaacctccaaagcagcaaccccagcagctttagctccctctcatcgcagccgcagcgccgtcccctactctttctgcgaacaactgctgtctctcnggcgacggcagaaacgtctctgcaagtgcagggaaggacccggggagatgattttgggggtgcttaaaaaaaaagggaaccaccttttttcccgaaggcccaaaaacctctgggaatcccccccgttcctcccgccttaaggcaccccggggggcctgggggttttggggcccgaaggcccaggggaaaacccccccaaaagggggccccgggggctgggaaaccctccctactttcttaaaaagggggggggaaaaaaaccgggggggggttaaaaaaaaaggccccggggggcctttgggtttaaaaaaaaggaaaaaacccccggggggggggttcctttttttcccccgggggggggggaggaaataaaaaaaaatcccccccccccccccccctggggttgggtaaaaaccggggcccct

SEQ ID NO: 69173 - protein, 30 aa, Zea mays
  misc_feature: Ceres CLONE 1546530
MILGVLKKKGNHLFSRRPKNLWESPPFLPP

SEQ ID NO: 69174 - DNA, 880 bp, Zea mays
  misc_feature: Ceres CLONE 1546531-R
  misc_feature (24)..(24): n is a, c, t, g, unknown, or other
aattgggtacctcgagcgtctcgnttttttttttttttttttttttttttttttttttttttttttttttttttttttttgatcggaagtagcatgataaaaattaagctcgagaaaccaaagaatattaacgtgaaatataatacaaatctttacaatgtatctcacaagctatacaagtatgaaactggaaggtctacttaggcttgacctccaagtagggcatgtagtccgacccgttgtccccgtacaaacctctcgtgatctcaacgtccctgtacgggtgcgacctcgctccggcgccggcgccgtcaaaatccttggcggaggaacccgcggaactggtggtcccgtcgggcccggagacctcgttctgcacatggcctcgatgtccttcaccacctcgcccatggccggccgcgccgccgccgaatcgtccacgcacagaatcgccagctgcacgaaaccgctgaaccacgcggtgcgcgctttgtccccgatctcccggtccaggaagccccgcaacccctaatggtcccggcccttggggtccaagaccaactttacctcccccaccaattactttgccgcttctaatgggttggccccccgttacccagttccaggattcccacccccaaaagttttaaaagttgcttttttttccgaaaaagggtttggtttttgtaatatctcccgaaaccaaaaaaaccccaggtttcctttttctttggggggaaaaaatgggccccttcttggggttcccccaaaaaaactttgaaaaaggcccaaaaatcgcgcaaccctttggtcttttaaagggggccccccagagaaaaaaatattgtggggaaaaataaccccccccccggggataaaa

SEQ ID NO: 69175 - DNA, 868 bp, Zea mays
  misc_feature: Ceres CLONE 1546533
  misc_feature: Encodes the peptide sequence at SEQ ID NO. 69176
  misc_feature (1)..(1): n is a, c, t, g, unknown, or other
  misc_feature (18)..(18): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (354)..(354): n is a, c, t, g, unknown, or other
  misc_feature (370)..(370): n is a, c, t, g, unknown, or other
ncgggggggcgggtgggngggttgactggttttnnnaaacccnntnnnnnnnnaaagctggagctccccgcggtggcggccgctctagactagtggatcccccgggctgcaggaattcgtctcacccctagaaaaaatttcccccctcgtgctctctctcgaaccttcttccaaagcacccgaaccctagtgatctcggaaccctagccgcgcgcggatctcggcttttccccttcctccacgccagccatggacgaggacttcgagatgcctcccgccggcgccgatgagatgatgggcgacgacgagatgggcgacttccgcggctacgagggcccggtgatgaaggtgggnagagaaaaggaagtcngcaaggaggggcttcaagaaaaaactgcctcaaggaggggcgagggggtggggagattctcgaaggtctggcaacgaggttttaattgtttttttttttttcccccccgctccttgattggtataaaaatttcctatttcaaggtcggggattccttgtggaagaaccccttttcgaggttgaagcgcttggggacataaggtgccatgctggattgacaggggtgtttggggaattcctagaggttatttctacagccccctggttatggggaggggggggaatagtggcttttttgttttggccccgttaccgaccaacgaagcctgggcgcttattggggaagacatatttggggtgtacccctttccggaactttttctgaatcctaggtggtgccgccccggggcccggtttgcgttcttctcctaccgtctcttttccgtgggcgtccctgggtggcgggggcgcaggtgtttggcgacaacatcggccgcg

SEQ ID NO: 69176 - protein, 106 aa, Zea mays
  misc_feature: Ceres CLONE 1546533
  misc_feature: SWISSPROT Homolog: EC 5.2.1.8 Peptidylprolyl isomerase
  misc_feature (41)..(41): Xaa is any aa, unknown, or other
MDEDFEMPPAGADEMMGDDEMGDFRGYEGPVMKVGREKEVXKEGLQEKTASRRGEGVGRFSKVWQRGFNCFFFFPPRSLIGIKISYFKVGDSLWKNPFSRLKRLGT

SEQ ID NO: 69177 - DNA, 659 bp, Zea mays
  misc_feature: Ceres CLONE 1546534
  misc_feature: Translation starting site: 206
  misc_feature (268)..(268): n is a, c, t, g, unknown, or other
  misc_feature (270)..(270): n is a, c, t, g, unknown, or other
  misc_feature (273)..(273): n is a, c, t, g, unknown, or other
  misc_feature (300)..(300): n is a, c, t, g, unknown, or other
  misc_feature (302)..(302): n is a, c, t, g, unknown, or other
  misc_feature (303)..(303): n is a, c, t, g, unknown, or other
  misc_feature (307)..(307): n is a, c, t, g, unknown, or other
  misc_feature (315)..(315): n is a, c, t, g, unknown, or other
  misc_feature (321)..(321): n is a, c, t, g, unknown, or other
  misc_feature (327)..(327): n is a, c, t, g, unknown, or other
  misc_feature (328)..(328): n is a, c, t, g, unknown, or other
  misc_feature (331)..(331): n is a, c, t, g, unknown, or other
  misc_feature (338)..(338): n is a, c, t, g, unknown, or other
ggcggccgctctagaactagtggatcccccgggctgcaggaattcgtctcacccctagaaaaagatctggccgcccgggcacggtcaaaaaggcgctatccctgcgcttcaccggagggagtatcacagcctgcgcgtcgctcatcctgtgactgctcctccgggtgggaatctgcggtgcggcgtcttgcatgccccctacctgatgctgacggctgggtgcggcctcctctcgtgcgttctcctctacaagcggggcgacgcgagncnaantaacccccgcgtcctggacgaggcctncnngtcnctcgtctnggccancgggtnntcngcctggnagttcgtgagggtcgagatcgagtgagtcgcggcgggcttctcttccggcgtcaaccggccatagagattctacaccgtctaactgacatgccttttatactcacgcttcgtgtccgtcaaggtgccgccgcatgatggagcgcctgcaccggtggattccgccaggagctcacggtgcgccttcatagatccggccacccgcaccatcgtcctacctttgttcggattacctgcaacgaaccaaaaacgaagggggggtttgatcctttgtaagcccccacccaaaagagggaaatgtctacggagaagggctccctcgg

SEQ ID NO: 69178 - DNA, 556 bp, Zea mays
  misc_feature: Ceres CLONE 1546540
aagctggagctccccgcggtggcggccgctctagaactagtggatcccccgggctgcaggaattcgtctcacccctagaaaaatcacatgccattgccaacctctcactgctcgtaccggctctccactccacctgctgcccctgcgccctgaccgcgaggggagggctctgacctaccaaggaagccaaccggcgcggaccgggtcggtcaacgcttgctgtgcacccgaccgaggaagctaggacgatcgagcacggaacatgttggcctcggcgtctgtgccggccgtctaggaaaagctcgcccccacaggtatggatggccgagaagggccgccgacctatgacgggctgctgctgcttctcccccgctgggcacggcccgggcgggctcatgggaacggggggcgggcctggcctttaagacccggccccccgggaattcgggggaacccctcccccccccccaaagttttcccaaaaaaacccccccgggatttttccaaccaaaattggccccctttttcccccccaaaaaggaaaaggggacacttt

SEQ ID NO: 69179 - DNA, 621 bp, Zea mays
  misc_feature: Ceres CLONE 1546542
  misc_feature: Encodes the peptide sequence at SEQ ID NO. 69180
ccccgcggtggcggccgctctagaactagtggatcccccgggctgcaggaattcgtctcacccctagaaaaagagggatagataggtccagtgcaagcgagcaggagcaggcatcttcatccagggagagggtgggtggcccgtggcccacatcgatgcgatgccggttcacgttgcgctcctcgccgtgccggcggtggccgctgggttcctgcaggcgttccagttcgcgttcctgctgtggcccttcaacctggcgctgccgctggcgcgccacctgccgcaggcgtgcatcgcgttccgcggggtcgcgtccttgtacggagcagagctgcggcggtacgcgggcgccgccgcccgggccgccgtgcccgtgctgcagccgccgagccaccaccggtacgcctcgctccgcggcgtgcagcagcgggcgcacggggatgccgtcgtcgcgcacgccatggtcgcgctcgtcgacatctcctactgatgccggccgcttgcatcgcgactccgggcgcactgcagagcgattcctcagccttttagcatgccgtcccgagtgtaaataaaacatatatacctgttcttcctccctacatcgtcagctgaggtgtgtaa

SEQ ID NO: 69180 - protein, 109 aa, Zea mays
  misc_feature: Ceres CLONE 1546542
MPVHVALLAVPAVAAGFLQAFQFAFLLWPFNLALPLARHLPQACIAFRGVASLYGAELRRYAGAAARAAVPVLQPPSHHRYASLRGVQQRAHGDAVVAHAMVALVDISY

SEQ ID NO: 69181 - DNA, 656 bp, Zea mays
  misc_feature: Ceres CLONE 1546543
  misc_feature: Encodes the peptide sequence at SEQ ID NO. 69182
aagctggagctccccgcggtggcggccgctctagaactagtggatcccccgggctgcaggaattcgtctcacccctagaaaaagccgctcgcgcgcgacgccgcatctctccctcgccactcgcgcgcccgggctccttcccgccacgctcacgacgatgccgtccccgacgtcctgatcttctgcctgaatccctccaaaccctcctccttccgccgactctcggccccgcgcctgagccggttccatgtctcctgctacgcgccacggggcggcgggaggcgcgaggtcatccccgccggtgccagcaaggccaagaaacagatcgtattcttcgacgccgccccgccggtgtcccaggagggtggacgcaccttggaagaaggcggcgagctagaagctgtacgcagtgggcaggtgcaacgcagcgctggcgttgttgaggagggcaccgagaggacactctcggtgctgtccaacctcccgctcgctatctccgagatgttcgccattgccgccctcatggctctaggaacggtgattgaccagggagaagcacccagctactacttcgagaaggtccccgagacaacccggtcttcggcttcatcacggggagtggatcctcccccccgggttcgaccacatgtccccct

SEQ ID NO: 69182 - protein, 51 aa, Zea mays
  misc_feature: Ceres CLONE 1546543
MFAIAALMALGTVIDQGEAPSYYFEKVPETTRSSASSRGVDPPPRVRPHVP

SEQ ID NO: 69183 - DNA, 704 bp, Zea mays
  misc_feature: Ceres CLONE 1546548
  misc_feature (560)..(560): n is a, c, t, g, unknown, or other
  misc_feature (570)..(570): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (603)..(603): n is a, c, t, g, unknown, or other
  misc_feature (604)..(604): n is a, c, t, g, unknown, or other
  misc_feature (609)..(609): n is a, c, t, g, unknown, or other
  misc_feature (614)..(614): n is a, c, t, g, unknown, or other
  misc_feature (615)..(615): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (657)..(657): n is a, c, t, g, unknown, or other
  misc_feature (658)..(658): n is a, c, t, g, unknown, or other
  misc_feature (661)..(661): n is a, c, t, g, unknown, or other
  misc_feature (662)..(662): n is a, c, t, g, unknown, or other
  misc_feature (672)..(672): n is a, c, t, g, unknown, or other
  misc_feature (674)..(674): n is a, c, t, g, unknown, or other
  misc_feature (678)..(678): n is a, c, t, g, unknown, or other
  misc_feature (682)..(682): n is a, c, t, g, unknown, or other
  misc_feature (691)..(691): n is a, c, t, g, unknown, or other
  misc_feature (692)..(692): n is a, c, t, g, unknown, or other
  misc_feature (701)..(701): n is a, c, t, g, unknown, or other
  misc_feature (702)..(702): n is a, c, t, g, unknown, or other
  misc_feature (704)..(704): n is a, c, t, g, unknown, or other
gctctagaactagtggatcccccgggctgcaggaattcgtctcacccctagaaaaacccgtcgcattccgcaacacctgctcctcgcccccttctctcagaggcgacgcctcgggcgctcctaccctgccccgtctccggtccccccgcgccgtcggcgaggcagccggccgtcacagaagcccgatccggaccccgcgagaaatccttgttatacctgatgggctatgattgatgagcctctttatccaagtgctggtcctggttgacgagctccgggaatgaagacatccacttgcgtctaaactccatggggaagactttcaacaatttaccccggactccttctcacaccaaaagaaaccgggagggacaagaatcccattccataacgggaaaactcacaatgaaccaagacacagtttggcgtcaggccgaacggcagcagggggagtggggcgcgtccggcggtgagaacattagtcagaccagacccgcgggtctcgactgtggagccgatttgggggtcgagggacaagcagccgcgggggggatggtttngcgaggttgngtnnnnnnttcggggtggagtgtggaaaagaannagggnatgtnntggggnnnnnaaaagagaagaggaccccccttttnnnagaannaannagctcaattnantatnactnattattttnnatacaagannan

SEQ ID NO: 69184 - DNA, 683 bp, Zea mays
  misc_feature: Ceres CLONE 1546551
  misc_feature (387)..(387): n is a, c, t, g, unknown, or other
agctccccgcggtggcggccgctctagaactagtggatcccccgggctgcaggaattcgtctcacccctagaaaaattccaccgccgcacacctcctgtcttccttcaccttcgcgctccgccgccgccgtcgattcgtgctgctctcacccctaacctgtccaacatcgccggggagggaagcagcagaagaagctccccttacctccggctatcgcctgaggataaagtggggtctgtaggggagtcttaggggggagcaaaagggataggatagggagagatgaagcaatcaatttcttcgtccgccttcgcccctgcttacgtccccgctactaaccctaggatcattctgtcttccctcctttctgagggggggggggttcnttttatgcctatcaattatgaggttgaacgccttcagaagcttctctactagattagtggaaatagtagacttgttccagtttaacttggctggaaaatttagtctccgggtccgtgtttttattctgctagccataaagggctgccaagaaacggagagggattgggggggaaggtggaaaggaacataaaatagtttccaagaagaaaagcggggagaaccccccgctccatatggctggctgggccggtttctgccacctctcgaaattgtgctcagggttaactggcaaaag

SEQ ID NO: 69185 - DNA, 665 bp, Zea mays
  misc_feature: Ceres CLONE 1546552
  misc_feature: Encodes the peptide sequence at SEQ ID NO. 69186
  misc_feature (76)..(76): n is a, c, t, g, unknown, or other
ctggagctccccgcggtggcggccgctctagaactagtggatcccccgggctgcaggaattcgtctcacccctagnaaatcccagtatcgcctttgcccgcacacacggctcccattccatttccgctgcctgcctctgacgcgcacccacaccacctcgcctccatcagacctccgcagctcggtctctgcttgcgttgcgttgcgtgtgtatgtagaggccgcaacacagaaatcaagagacgtgtatgtatatgctacccccaacagccaacgaccgtgctccaagcggtaggggatggaggagcagcagctggtgcatgtgcagcagcaggggacgacgacttcgccttctactgctcctacctgcatgacgccgacgcttgtcgcgcctcagcgacgtcgaccctcgccctcgccgtcgaggaccccaacccaaaccccagcgccccagggatgactaaccgccggcgaccggagcaacccgggggaaaagaccccgaaacccccggggaaggggaagaggaggccaaaaagggccggcaagaaaggggccattcccaaggtgcctcccccccccaaggggggaccttggaagcggagagaaacaaccccaaacccccggggggccccgggaaaccctccaaggagggaaatgggccctc

SEQ ID NO: 69186 - protein, 69 aa, Zea mays
  misc_feature: Ceres CLONE 1546552
MTNRRRPEQPGGKDPETPGEGEEEAKKGRQERGHSQGASPPQGGTLEAERNNPKPPGGPGKPSKEGNGP

SEQ ID NO: 69187 - DNA, 595 bp, Zea mays
  misc_feature: Ceres CLONE 1546556
  misc_feature: Encodes the peptide sequence at SEQ ID NO. 69188
ctccccgcggtggcggccgctctagaactagtggatcccccgggctgcaggaattcgtctcacccctagaaaaaccgcatcgcctcgccgctgttccccgcaacctatcgacccaatctcgtccgacccggcgcgtcgtcccctccagatctccgtcgccctctcccagtagcagaaactgttctgctgcagtctgacaaaagtggagggcttaagagcttctgcctccttttatgtctgaacatctttggctttttttggggatggttgggaaaagtaccctccgtgcacttggaaaagggccaaggttcgttccccctgcatgctttaaaaaaattgcccgggttttctttgggcccgaattttcctttttggggggggccaaagcgggttttgttcccccaggggaccccccccccctcttttttggggatttttgcccccccaaataaccccttaaaaattttttccccaagggggccccaaaaaattgtggggtttaaaaagggggagggtcccttttcggggggaaaaagcccccccatttttttccccaattatgggcgcggggggttgtttttttaaaaccaaatgt

SEQ ID NO: 69188 - protein, 72 aa, Zea mays
  misc_feature: Ceres CLONE 1546556
MSEHLWLFLGMVGKSTLRALGKGPRFVPPACFKKIARVFFGPEFSFLGGAKAGFVPPGDPPPLFFGDFCPPK

SEQ ID NO: 69189 - DNA, 641 bp, Zea mays
  misc_feature: Ceres CLONE 1546557
  misc_feature: Encodes the peptide sequence at SEQ ID NO. 69190
ctccccgcggtggcggccgctctagaactagtggatcccccgggctgcaggaattcgtctcacccctagaaaaacagccccgcgccggcgctccccccactcgcgctcggcgcagcgcccccgcaacttgcgctcggtcgctccagcgcgggcacgcggcagcgcccctcctccgcggcacggctccgccggccgtccgcccgtgacccgcgcaacggccgcccggtaaggccaggcgcttagtcttgcaggccatccggcagccgctcggccgcccgcccctcgcctctcctctgcaggccttgtcccccaatagctcgatccaggagcaaaagaccgaacctgtggaggtgaggttgattttaagaagtacacgccaccatagaacgaaatttcataatgctttggcaaacgagttgtagactatggcaacccgaatcctgtcgcgtcaaaatctgagaaagttggcttcgttcacgctccagaatatatcccagaggcaactagttccgccttatcctccagctctcagatccactattgtttcccccagcaaattcctgagccccctttacctgtctgggcattcattggctgtgagatgggcaacctatggatcagtgaatctagttttgtccgat

SEQ ID NO: 69190 - protein, 72 aa, Zea mays
  misc_feature: Ceres CLONE 1546557
MATRILSRQNLRKLASFTLQNISQRQLVPPYPPALRSTIVSPSKFLSPLYLSGHSLAVRWATYGSVNLVLSD

SEQ ID NO: 69191 - DNA, 663 bp, Zea mays
  misc_feature: Ceres CLONE 1546558
  misc_feature: SWISSPROT Homolog: EC 3.2.1.4 Cellulase
ctggagctccccgcggtggcggccgctctagaactagtggatcccccgggctgcaggaattcgtctcacccctagaaaaaatatagaaaaaaccttcccccaccgtcccggcgcccgccatgtattcaggcaagcgctggggcggctcgttacgagatcgtcgatggggcggcagatgatgacctcagtcgtcacgtggacctggactgtcgagttttgtgcgcacagttacagccgctgctggactagacattgctgacctgggtgctaggcctggcggtcggctgctcgaggacctgtacgtggaccgcggcctgtgtaccggcgacctcaagctcctctggtggcgcttgtggtgcgctccgtccactgtcgtctcgtcagcctccccatcatcgtcgccaagtcgatcccgcagctgaagccagtccgccgccgcctgatcctacacaaagacgctgcagaagggggctctcttctttacgcccatagatccggccaccttcccaagaacaatagcatctagtggtgcgcgaactctggcctgtcagaccgctccgaggccaaggacgtcaagggtggactccttggcggatactacgacgctcgccagcacatgcagttccactggccgatggccttctccatgacgctactgagctg

SEQ ID NO: 69192 - DNA, 743 bp, Zea mays
  misc_feature: Ceres CLONE 1546559
  misc_feature (1)..(1): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (343)..(343): n is a, c, t, g, unknown, or other
  misc_feature (743)..(743): n is a, c, t, g, unknown, or other
ntttttttttttaaannnnntcctctcgaaatagttttacgccccgcacaaaaaaaagctggagctccccgcggtggcggccgctctatactagtggatcccccgggctgcaggatattcgtctcacccctagaaaaacgagctccgatcccaccccgctcccaaccgcgcggccctgtccatggcgcgcgcggtgcggcggcgagcacccatgcattcccgccgccggagcgcggcctgctaagcgacgacaattcctctccctctcctaaatccactcccccacgtgtcttcatgggccctccggcctacaccgcctccccctgcacggggtctgccctcnttctccaacaccccgagcggccggccggccgccaaccgccggccttccttattcccaaatggggggccccggggggcccccccgttttcgggcccttgggggggaaggccaccagaaaagcccgccgttaaaactccctattcccaaggaaaaaagaggcgagggcccccccccccccgccccacaggggaaaaggggcctcaaaaacccctctccaggtttccagggaaaaagggcccccccccccccctgcggaatatttttctgttcccggtttattccacccaatttctcagtgtaacaggataagagcccgccccttataaaaatgatgggttggaaaaatatttcccccgggagggacccccccgccccccaaaagggggaagaagagagaggn

SEQ ID NO: 69193 - DNA, 684 bp, Zea mays
  misc_feature: Ceres CLONE 1546574
  misc_feature: Translation starting site: 111
  misc_feature: Pfam Name: Nodulin-like Pfam Description: Nodulin-like
ctccccgcggtggcggccgctctagaactagtggatcccccgggctgcaggaattcgtctcacccctagaaaaaggcattcctgagcaaaaatcccctgcaacccgacccatggccatgggcaagctcgaggagaggacgcgtgcgttctggacgaaccgatggcttgtgttcgttggggccatgtggatgcagtccatggcacggcaccacttacttcttcggcgccatctcaccggtggtcaaggccaggctgggctacgaccagccgcaagtggccgcgctgggtgtcgccaagaacctcagcggctgcctcggcctcctcgtcggtgcgctctctgcgacgtgaccgccgtgagcgctgctggccatctgctgcgcgcataactccctacgatacggctggctctggctcgtcgtctcctggaacgtgacagcgctgcccctcaggcagatgtcagctggtatctttcatgaaacgatgcccgaacctatttcaccccggcttccattgttacaagcttccaggatttcccatcatgccggggccccaacgggtggcttcccttaagggattttggggacttaatagccccatttttgacacagtttttttccggggtggcgacccccaaaactgggggagcctattcccaagggtccctttaagacccaaacccggttc

SEQ ID NO: 69194 - DNA, 816 bp, Zea mays
  misc_feature: Ceres CLONE 1546579
  misc_feature: Encodes the peptide sequence at SEQ ID NO. 69195
  misc_feature (1)..(1): n is a, c, t, g, unknown, or other
  misc_feature (6)..(6): n is a, c, t, g, unknown, or other
  misc_feature (13)..(13): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (21)..(21): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (49)..(49): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (149)..(149): n is a, c, t, g, unknown, or other
  misc_feature (816)..(816): n is a, c, t, g, unknown, or other
nttttnttttttntnnnnngnggccctctcccacctnnnnnnnttcttntnnntaacgctggagctccccgcggtggcggccgctctagaactagtggatcccccgggctgcaggaattcgtctcacccctagaaaaactctttccagncacctcactcttcactagcctctgctcctctgaaatggcggcggggacttcctcttccacctacatcgccatcggacgcaaaaccctaaaccccgccccctccgtagccacagccgccacctccgtctccttccccgccacgcagtacccatgcctcgtcggcgcctccgcggaccgccgccgcgccgtggctgcgaaggtctcgtcgccgtcggtcatcggcaccgccatgccgtcgctcgacttcgagacctccgtcttcattaaggaaacggtgtcccgtggggcggggatgaaggagtctatctgggagggggaggaaccgcatcccgtcccccgctagttacccgtaagccctctcaaggggaatcagaacaccacccggtggtaacccacccccggggccctcgcaagggttcctagccccacagctcaaaaaaattcgaagaggaagtcattttgtttgaacgcgggcagaccgcgagacttggtgtggtttagaaatgggggcgcccccggaaaggggcgccctaaaatcttctctggggagtaatggcccctaataacggccggcctatgcaaccgccagaacaaagaagtgcggcaaaagtactgaagctacaaatcaccctctcttgcacacagcggtgatccaaacaccgcgggn

SEQ ID NO: 69195 - protein, 102 aa, Zea mays
  misc_feature: Ceres CLONE 1546579
MAAGTSSSTYIAIGRKTLNPAPSVATAATSVSFPATQYPCLVGASADRRRAVAAKVSSPSVIGTAMPSLDFETSVFIKETVSRGAGMKESIWEGEEPHPVPR

SEQ ID NO: 69196 - DNA, 625 bp, Zea mays
  misc_feature: Ceres CLONE 1546580
  misc_feature: Translation starting site: 231
  misc_feature: SWISSPROT Homolog: EC 3.4.24.35 Gelatinase B
tccccgcggtggcggccgctctagaactagtggatcccccgggctgcaggaattcgtctcacccctagaaaaaatcccacccctcgcccaatgcgtagttgtatctgcatctccaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtctccggcaccggcaggacgcggagcaggcggcggcccctctgcgcggcggcgctcgtgctctccgccgcgctgctcctagccgtggccgcgctcgtcggcgtcagtagccggcccggcgcggtggggatgacagagtcggccgcctcgtcgccgacgccgagcaggaacaggggccccgagcccggcgtgtcccaaaagacctccggcgcgtctgacgacggcgggcagctccgtggaaccggccgggacgccctccccgggaaacaatgcaatgcctgccaggggcaccccccgggaattcacctcccccc

SEQ ID NO: 69197 - DNA, 609 bp, Zea mays
  misc_feature: Ceres CLONE 1546581
  misc_feature: Translation starting site: 224
  misc_feature (48)..(48): n is a, c, t, g, unknown, or other
ctggagctccccgcggtggcggccgctctagaactagtggatcccccngggctgcaggaattcgtctcacccctagaaaaaaaaaaaaaaaaaaaaaaaaaaaaaaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcacccgactccgagcgcctcatcggagatgccgccaagaaccaggtcgccctggaccccattcacacccgtctttgatgccaagcgtctcattggcaggaggtttagtgatgcctctgtccagagagatattaaactgtggcccttccaaggcattcccggggcccgggaagaacccaatgaaaatgttcaacacaagggggaggaaaaacagtttgcaaccaaaaaatctcccccctggttctcc

SEQ ID NO: 69198 - DNA, 2612 bp, Zea mays
  misc_feature: Ceres CLONE 1546591
  misc_feature: Encodes the peptide sequence at SEQ ID NO. 69199
aacgggaggagagaagtcgcgtccggaggcaagagccttccgcgccgaacgcggctcgccgctcttcctcctcctccccctctcccgtaggcgtcctcgccgtcctagcgtctgcctttcgacgctgctgccgtggagcgcagatcaaccctgactctgcccgatttcttctctcgttgatgctgaaggtcatttcttacatgttgcagagtgtggaaaaaccttgcaatgaaatggaaaaatgttttgaaggaaatggcaccgctgaggtccacaggcagattctttcaacgccatccttcagctatctgcttattgattttcctacttgtgttgtacaagtacttcttcggctggttcaccctcatcgtcaccacatcacctatcttcctaatcgctggcgtctttcttggaatcgtcctggtgtacggtgaaccgaacaaccctgaaaaagatcatgtctacaaaaaaattgataatactcggagtttgaatatccatgatagcagcaaatctattaggggtgtatatcttcctagaattccgtctggtgaagagagagcgccgaagcacaaaaacagtgttaagaaaattaggaagcagtctcgtggtgtagcctcttcttctgaaccaggatcaagtgaatcaggtggttcagatactgatattgctccaatgttccatgcatttcatcatcttaggtcgggcagcaattcgtcaaattcctctcaagatggtgactctgacagtagcaccgaagatacaacagagaatcaacagggcaacgacggcaggatatcccgcgaggggaaacaacatgttaaagttgttgcatggactgctgatgaccagaagaacataataaaaatcgggtgcttggagattgagcgtaaccaaaggttggagaccctaattgctaggcgtcgggcaaggaaatacgcagacaggaacttggtagagtttggcagcactgaatccttacccactattgaagagctatcaaagttcaatgttcaaattcctgctgtttttgctcctaggaaaaatcctttcgatcttccttacaatgaagataacttcccagattctgctccatctgcactgttggaaacgagatacccatttgatctaccaagtgagcaagcaaacgagagcagctcttatggaggagccaactcaagccatgatgaacctattcccgtagcatgtcatttacagagtgcactgttgaggaggcatgagagcttcactgaaggagcaccattccttagtgactttttgcaagatacacagccttcccgattcagaccatacttcatgactgaaaaaatggctaacgaggaaatgacagatccagttcttgaaggagaaactagtgaaaagagcaactctaaggccagctctgctcaagactcggatagtacttcttcagttgctgaccaagaaagccagaaggatgttctagaggattgctcaaaccaaggacaacaatcttctttcagtcaaacagaggaacatgcacatatagctcggcatgcaagggaggtttctctttcccttgacatggaaccacctgtcttaattagtgattcctctgatgatgacatatcactgtctggtgaacatataaatgattgggaggaagcacaacagagtgaaaattttagtttgtcccagaatacatggcaagaggatcctaatgtcatgcaacaccatcaagaaatagatatcacaagcaatggattgaatcaaatgtcaccacattcgaatgatcttgagttgacgtcgtcatcaactgaaactactgatgatccttttgaagtgaatgacattgaaccaccagctaaggaagtggtggtcgttgatgatacccacgttgtggatcctgtatatgattcaagtccttcgggaagcgagaggcctgcacctactggtttagtaattaacggacctgtcctaaaagatggtcatgcttgtactcttgttgttgaagcaaccatcgaagaagggggttcatcatcaagaatggaggtttcttccagtgaggtagctggacctagtttgagttctgtggagcaaagcgaatccccagagaaagaagcctctgagataagagagcagtccatggttggccatgacgaagcacatggaggttctgtcagccatgctgatccttcagtatctgatataagttctcagccgagtactgaaagttcaacaaatggtgattctggcagtggtgtaacaccatccttcacaaacgcagttctttagtttcttcataaaaaaaatgacagcggcaccgatcgagcatcatcaggttggtcgtcttcagcagtacttcgagctaggcgacttttgtgtggggcgagttcattgctgaggaaaccactgggagggtatatgtttgttgcaggaaatttcttagtgcttcaaagggactaggcaacattagcattattagcactgcactgtaaaaatggctagatatggttgttgcttaatttggccagcactctcgtttgtgaataccttgtggatccgacagtcaattttgtgccgtaaattaattgttaatttgctgcttcgagtaccaaaaaaaaaaaaaaaaa

SEQ ID NO: 69199 - protein, 681 aa, Zea mays
  misc_feature: Ceres CLONE 1546591
MKWKNVLKEMAPLRSTGRFFQRHPSAICLLIFLLVLYKYFFGWFTLIVTTSPIFLIAGVFLGIVLVYGEPNNPEKDHVYKKIDNTRSLNIHDSSKSIRGVYLPRIPSGEERAPKHKNSVKKIRKQSRGVASSSEPGSSESGGSDTDIAPMFHAFHHLRSGSNSSNSSQDGDSDSSTEDTTENQQGNDGRISREGKQHVKVVAWTADDQKNIIKIGCLEIERNQRLETLIARRRARKYADRNLVEFGSTESLPTIEELSKFNVQIPAVFAPRKNPFDLPYNEDNFPDSAPSALLETRYPFDLPSEQANESSSYGGANSSHDEPIPVACHLQSALLRRHESFTEGAPFLSDFLQDTQPSRFRPYFMTEKMANEEMTDPVLEGETSEKSNSKASSAQDSDSTSSVADQESQKDVLEDCSNQGQQSSFSQTEEHAHIARHAREVSLSLDMEPPVLISDSSDDDISLSGEHINDWEEAQQSENFSLSQNTWQEDPNVMQHHQEIDITSNGLNQMSPHSNDLELTSSSTETTDDPFEVNDIEPPAKEVVVVDDTHVVDPVYDSSPSGSERPAPTGLVINGPVLKDGHACTLVVEATIEEGGSSSRMEVSSSEVAGPSLSSVEQSESPEKEASEIREQSMVGHDEAHGGSVSHADPSVSDISSQPSTESSTNGDSGSGVTPSFTNAVL

SEQ ID NO: 69200 - DNA, 639 bp, Zea mays
  misc_feature: Ceres CLONE 1546594
  misc_feature: Encodes the peptide sequence at SEQ ID NO. 69201
ggagctccccgcggtggcggccgctctagaactagtggatcccccgggctgcaggaattcgtctcacccctagaaaaaaccccagtccccacctcttctcttcctcctcctcgtccgccgttgctgtctgtctactcctcctccgccgccgcctagctgcttactacgggcttccaccgcaacaagcacagagtgcgagcaaagacagaaagccatgggcgccctgttgctcttcgacgtctgcctgctggcgccgatcgtgctggcctgcgccgtccgtggcaggaagcggcgggccgccgcgccggcgtccggcaagaaggcgctgccgctgccgctgccgccggggtcgatggggtggccgtacgtgggggagacgctgcacctctactcgtccaagaaccccaacgtgttcttcgcccggaagcagaaccggtacgggccgatcttcaagacccacatcctgtgctgcccctgcgtgatggcgtccagcccggagtcggcgcgcttcgtgctcgtcacgcaggctcagctcttcaagcccaccttcacggcgagcaaggagcgcatgctgggcccgcaggccatcttcttccagcatggcgactaccacgcccgcctccgccggcctcgtatcct

SEQ ID NO: 69201 - protein, 141 aa, Zea mays
  misc_feature: Ceres CLONE 1546594
  misc_feature: SWISSPROT Homolog: EC 1.14.13.93 (+)-abscisic acid 8'-hydroxylase
MGALLLFDVCLLAPIVLACAVRGRKRRAAAPASGKKALPLPLPPGSMGWPYVGETLHLYSSKNPNVFFARKQNRYGPIFKTHILCCPCVMASSPESARFVLVTQAQLFKPTFTASKERMLGPQAIFFQHGDYHARLRRPRI

SEQ ID NO: 69202 - DNA, 657 bp, Zea mays
  misc_feature: Ceres CLONE 1546603
ggagctcaccgcggtggcggccgctctagaactagtggatcccccgggctgcaggaattcgtctcacccctagaaaaaaaacccagctcaggtgcaacccctacgcaccgccgccgctcgcctggcctcacctcgccggagaagagttataagacaggagaaccccgtccccggggcgcacgcctctgcagcttccgtgacccaccgcccaatcctgccacagctgccctccctcctcccctctgggcgtggccgagttgtaggcatcacggctagcgttgcagccccccggcgcggccccgcagctgcgcatgtggagcccactggcaccatcgcctccgatgtcgagtccagacccgctccgcacagcggccgcggggcgctgccctctgccggaggaagaccccccaatgtcctattcttcgccggccgcggtcgcctctgatccggttctgtctctcacgttctgcctttcctagcaattagtcccttctgcataccccccagatcccgacgagttctcaccgagagagtaactgacggacctacgggcatggagatgaagctgaccatcaggagggtgcccaccgtcgtctcaaactacaggaggacgccgacaagctgcgcgcgggctgccggaggaaactgctcggcaat

SEQ ID NO: 69203 - DNA, 696 bp, Zea mays
  misc_feature: Ceres CLONE 1546982
  misc_feature: Encodes the peptide sequence at SEQ ID NO. 69204
cgcggtggcggccgctctagaactagtggatcccccgggctgcaggaattcgtctcacccctagaaaaactccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctgcaccggttcgtcaagtggcccaaggtcgtgcgtatccagcggcagcgccgcatcctcaagcagcgcctcaaggtaccattggcgctcccccagttcggccggggcctcgacaagaacctccctacgaacctgtttaagatgcttctcaagtaccggcctgaaaaccaggctgcctataaggagaggcttctgaagagggccccagctgaaaatgatggaaaaactgttgagtccaaaaaaccaatttgttgtgatgtttggcccttaaccttgtgactttcctctcttggacagaattacgcgtcaacgttgtttgtatcccttcacgagtgtggtaatccaaccagacctgttttagggctttctctcccttatgccataaacatgatcatcctctaatttgcctttctaaatggataactgaattctatg

SEQ ID NO: 69204 - protein, 135 aa, Zea mays
  misc_feature: Ceres CLONE 1546982
MAPKRGGRAPVPAKKKTDKVTNPLFEKRPKQFGIGGALPPKKDLHRFVKWPKVVRIQRQRRILKQRLKVPLALPQFGRGLDKNLPTNLFKMLLKYRPENQAAYKERLLKRAPAENDGKTVESKKPICCDVWPLTL

SEQ ID NO: 69205 - DNA, 694 bp, Zea mays
  misc_feature: Ceres CLONE 1546985
  misc_feature: Encodes the peptide sequence at SEQ ID NO. 69206
  misc_feature (532)..(532): n is a, c, t, g, unknown, or other
ccgcggtggcggccgctctagaactagtggatcccccgggctgcaggaattcgtctcacccctagaaaaaatctctctcctccctggctctcgtcccccccaccgagtcgtcgccccctcgctttcaccccacgcggaagcaagaattcgtcgtcaaattcccagcttgcgcgtgtttctgtggatttcttcccgcttccctgctcctgcctcctatgggcctttgatccggggcttcgtggatcttgggaagaggaggtgtggtgggcgcctcggcggcgatctggcggggaggatatggccagcgggaaagagcccatcgaggtcaggtttcgtctcttcgacggcacggatatcgggcctacgaagtacgatccctccaccacggtctcctcgctcaaggagttcatcctcgctcggtggccgcaagataaggatatagctccaaaaactgttaatgacttgaagcttatcaatggtggaaggatattggagaataaccggacacttgcagagtcccgtgttccagtangagagatcccaggtgggtgtaattacatgcatgtggtagtgcgacctccacaagctgacaaaacagtgagaagcagcttggccaatcccccagcagaacagatgggatgcaccatctctgataagcgtctgcttggggctgtacatctgtgtgtaccataag

SEQ ID NO: 69206 - protein, 131 aa, Zea mays
  misc_feature: Ceres CLONE 1546985
  misc_feature (79)..(79): Xaa is any aa, unknown, or other
MASGKEPIEVRFRLFDGTDIGPTKYDPSTTVSSLKEFILARWPQDKDIAPKTVNDLKLINGGRILENNRTLAESRVPVXEIPGGCNYMHVVVRPPQADKTVRSSLANPPAEQMGCTISDKRLLGAVHLCVP

SEQ ID NO: 69207 - DNA, 730 bp, Zea mays
  misc_feature: Ceres CLONE 1546987
  misc_feature: Encodes the peptide sequence at SEQ ID NO. 69208
  misc_feature (389)..(389): n is a, c, t, g, unknown, or other
tccccgcggtggcggccgctctagaactagtggatcccccgggctgcaggaattcgtctcacccctagaaaaaaagcgttccagatcgtactggaccaatctgccaccacactttgatcacacacagacacaggaagttgagatcagaaaaatgcaggctgccgctactgccgccgggttctcggccgtgctgcccgccaagggcaggccggcggcgaggagcagggtggtggcccgtgtccccgccacaaggaggagcgtccgcgcagctgccgtcgtcgcgaccgaggccgcgcaaatcgactacagctcaagcgtctcggtgttcccgatggaggcctgcgacctgcttggtggcgacgcgtgcgacgggcccatgttcccggaanccaagcccccctcggcggcggcggcggcgagcaggagtgtggtctgggtggacagggactacctgtcctaccacgagccaaagacggtgttcccgggcgaggcgtgcgacaacctcggccgcgagttctgcgaggcgccgtaccaggacggcgtctccagggagcttgcccacccctgaaaaacccggatccacccatgcctgtcccccacgctaaggacgtaggggaacccaagggtttacttccccgggtaaaccacctccagtagcactccgcatggcgactccggaatcccaatttggggggaccctacctcctcatttcatcagccccgcaggttc

SEQ ID NO: 69208 - protein, 138 aa, Zea mays
  misc_feature: Ceres CLONE 1546987
  misc_feature (1)..(126): Pfam Name: Lir1 Pfam Description: Light regulated protein Lir1
  misc_feature (80)..(80): Xaa is any aa, unknown, or other
MQAAATAAGFSAVLPAKGRPAARSRVVARVPATRRSVRAAAVVATEAAQIDYSSSVSVFPMEACDLLGGDACDGPMFPEXKPPSAAAAASRSVVWVDRDYLSYHEPKTVFPGEACDNLGREFCEAPYQDGVSRELAHP

SEQ ID NO: 69209 - DNA, 762 bp, Zea mays
  misc_feature: Ceres CLONE 1546988
  misc_feature: Encodes the peptide sequence at SEQ ID NO. 69210
  misc_feature (762)..(762): n is a, c, t, g, unknown, or other
agctccccgcggtggcggccgctctagattctcgtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggagagttccccggcgactacgggggggacaccgcgggcctctcggccgacccacacacattcgtgtgtaaccggtagctggaggtgatccattcccggtgggcgatgctgggcaacgctggcctgctagttcccggaaaccctggtcctaaacgtcgtcaagttcggcgaggcggggaggtacaaaggcctgcccgccaattctccccaaacggagggccaggacgacctgggggaaccccaaatcgggggagcccaatggaagtagatgggccatccggggtgtccctcatgtggggtcacatgggcttccatgaagagcctaaaaaggcctaaggtcgctgacccggttgggtactagggtattcgaatataccttaccccccggtgatgatcacgtagcgagcgtttn

SEQ ID NO: 69210 - protein, 90 aa, Zea mays
  misc_feature: Ceres CLONE 1546988
MAASALHQTTSFLGQALVSRAAGVDAGGRITMRRTVKSVPQSIWYGPDRPKYLGPFSEQTPSYLTGEFPGDYGGDTAGLSADPHTFVCNR

SEQ ID NO: 69211 - DNA, 829 bp, Zea mays
  misc_feature: Ceres CLONE 1546990
  misc_feature: Encodes the peptide sequence at SEQ ID NO. 69212
gacggagtgtatataattttttacgtagtatttaataatgatgaaaaaaacagagaataccaaagtagggggccgctctagactagtggatcccccgggctgcaggaattcgtctcacccctagaaaagatcgtctctctcacgagccacagcccacaggctagctctctagccagtccagtccacgcagcgcatggatggcgtcgttcgccgtggcaacggccccgtcactagcggccccggcagccaagaggaggcccgccgccggcgtcacgtacgtggagggcatgaaagcctacagcggcctcaaggggctcaacaaggtgaccatgctcggggtgcgcaagaccgccgactactccttcgccaagggcgaggcatcgctcagcctcgcaggcaggaagcggcgcggaggagcgttcggcgcccaaatgaggttttaacgcttacacagtggtgactgttgcaccacgtagaacgagcgcagcgaagccaacacaactgccggcggacaagtgtctccatacacgagatccatggcaggtacgcccggaagagcggtctcctccggggctagattgtttcgagcctgcgctcgggaggggataagtggccgcatcgatgctcggtactctgattctggccccttcgcgtccgctgaaggcgctctactggttgagtgcgcgctgcttaacaactaagtattctgaatatataaatgaagactataagcgactcacgaagttccccccagctcccttcctcaaggtaagtgggctgtgttgccacaacactctcccaggctgccatcctggtggaccagtcgaaa

SEQ ID NO: 69212 - protein, 81 aa, Zea mays
  misc_feature: Ceres CLONE 1546990
MASFAVATAPSLAAPAAKRRPAAGVTYVEGMKAYSGLKGLNKVTMLGVRKTADYSFAKGEASLSLAGRKRRGGAFGAQMRF

SEQ ID NO: 69213 - DNA, 679 bp, Zea mays
  misc_feature: Ceres CLONE 1546993
  misc_feature: Encodes the peptide sequence at SEQ ID NO. 69214
  misc_feature (98)..(98): n is a, c, t, g, unknown, or other
  misc_feature (483)..(483): n is a, c, t, g, unknown, or other
ggtggcggccgctctagaactagtggatccccccgggctgcaggaattcgtctcacccctagaaaaagccatcctacgcctcgcgccgccgccacagnaacccttgcagccccaatcccccacggcgaccatggccggcgcgcaggagtccctctccctggtgggcacgatgcgcggccataacggcgaggtgacggcaatcgcgaccccgatcgacaactcgcctttcatcgtctcctcctcccgggacaagtccgtgctggtgtgggacctgagccaaccggtccactccaccccggattccggcgtcaccgccgattacggcgtcccctttttttccccccccccccggggaaagttaggggggaaatttttccttatttccaacccccagtttggcaccccgggatcccgggaagggggaggtggggcgtttgggacctcctccccgggcttcaccgcccggccctctatttggctaanaaaattaccctcacccccccccgccgtgtccgttgaggacgtgggagatagtcgcccccgccacccatgatgagcctctgaccccttgaaccccccctgccgagttgcccactttgccctcccggcgctctcctcgggcgggcaagcccgtgcaccctctgcgtgagtctcccaagcgttctccccccacggccag

SEQ ID NO: 69214 - protein, 140 aa, Zea mays
  misc_feature: Ceres CLONE 1546993
  misc_feature (8)..(47): Pfam Name: WD40 Pfam Description: WD domain, G-beta repeat
  misc_feature (118)..(118): Xaa is any aa, unknown, or other
MAGAQESLSLVGTMRGHNGEVTAIATPIDNSPFIVSSSRDKSVLVWDLSQPVHSTPDSGVTADYGVPFFSPPPRGKLGGKFFLISNPQFGTPGSREGGGGAFGTSSPGFTARPSIWLXKLPSPPPAVSVEDVGDSRPRHP

SEQ ID NO: 69215 - DNA, 654 bp, Zea mays
  misc_feature: Ceres CLONE 1546997
  misc_feature: Encodes the peptide sequence at SEQ ID NO. 69216
  misc_feature (654)..(654): n is a, c, t, g, unknown, or other
ggatcccccgggctgcaggaattcgtctcacccctagaaaaactactcgtctccacggaatcgatcgatcggtgctttgatctctgagcctgagcaagcggtcgagctcaccaaccgccacgctcaagacaggtcgagtagctagctagctgccggagtggaaaaggaggcggtgcagtggcatggggaggccgccgtgctgcgacaagatgggggtgaagaaaggcccgtggacccccgaggaggacctcatgctcgtctcctatgtccaggagcacggccccgggaactggcgcgccgtgccgaccaacaccggtgtgtgatgaatcatctggtgatgcagggcttgatgacgcgcgcggcggatggaattgcctttcaagatccaagctccgagcttacttgatttttttgtttgtttgttggtttggtcggcacgtgtgcgcgtgtgtgcagggctgatgcggtgcagcaagagctgccgattgcggtggacaaactacctccggccgggaatcaagcgcggcaactttaccgagcaggaggagaagctcatcgtccacctccaggctctccttggcaacaggtgatggtcactcgcctgtcgtcgtcttaaagcttttgttcccgttttgttttttccgctgtaacaan

SEQ ID NO: 69216 - protein, 46 aa, Zea mays; identical to SEQ ID NO: 63423
  misc_feature: Ceres CLONE 1546997

SEQ ID NO: 69217 - DNA, 926 bp, Zea mays
  misc_feature: Ceres CLONE 1546998
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (926)..(926): n is a, c, t, g, unknown, or other
gtttttgtttaaatataatgtttagcatcactccntnnctctcttttatttcatactggtgctccccgcggtggcggccgctctagactagtggatcccccgggctgcaggaattcctctcacccctagaaaaaggcctctccctccgcgccgtgctccgcctgtcggccacgcccccgcccggctcctcctcctcggagtccggagcgggctacctctacgatgacgctgactaacagattctcgccttccgcgtcagcccatggctattctggcgtcaaccagaatacaaacagttacacatctggtgacctacctattcgaacttggtgtggtattctttttcgagagagctttcaccggacatacccggtcaccacaagaccatcatcaggcattcaaacaaacaagaacaacaacataacagacaaaatagtacctaacacggataggggaaaattgcaattgtatattcgaccccccccccacaaggaatctcggctgcaccttgccaccctactatatgaccacagcgatacccgggaaccacccttacaaaccatggtctcggtaaaaaatatattctctccccccactcccactaacacccatcaactgacccttgactcataatagaaacttcatgactctcgacacccttccctgagattaacaacatttcctcatcgtacctctacttcaccgtcaatcaaatcccttctagaaggaatcaatcacacgactttcagtagcaaatctcgcactatggacaaataagaacttgcagtcctttttcatcatcctcaatcactataatggaactccatccacttaatgtcaagcgtagaggagcgcacaagctataactgccccacccaccatacggtgtgtcaccgctcgcgcgcatcccagcattctgttagatn

SEQ ID NO: 69218 - DNA, 662 bp, Zea mays
  misc_feature: Ceres CLONE 1547000
  misc_feature: Encodes the peptide sequence at SEQ ID NO. 69219
tggcggccgctctagaactagtggatcccccgggctgcaggaattcgtctcacccctagaaaaaagtctcacccacaagagacacaaacctagcgcaacaagcaatcgaaaaagagatttggctacaaccaattaaccatattggccagcagtgtacgtgggaacgatggccctcatgcaggagagtagtagccaggatttgctccagctcacgacgagctcttgcaccattccctgtgcttcgccaaatcgctcgcgctcgccgtggcgctaacctccgcatccccgacgcgatccaccaccacggggccggcggcgccacccttctccagatcctcgccgagactgcgctccacccaagcaagcttcgcgcccttcgccgcctcatgcgcgtgctcaccgtcacgggcatcttcagcgtcgtcgagcaaccaccagcaggtggtggtgatgattcaaccggtcacacgtcggacgacgaagctgtcgtcgtccacaggttgacggcagcctcccgcttcctcgtcagcgacgacgtgagcacggcgaccttggctccctttgggagtctggcggtccagcctatccctgcctgtccgcacggcctggggaatctcgccgggtttcgggcgggacaacacgaacccgccccgtatgggctg

SEQ ID NO: 69219 - protein, 92 aa, Zea mays
  misc_feature: Ceres CLONE 1547000
MRVLTVTGIFSVVEQPPAGGGDDSTGHTSDDEAVVVHRLTAASRFLVSDDVSTATLAPFGSLAVQPIPACPHGLGNLAGFRAGQHEPAPYGL

SEQ ID NO: 69220 - DNA, 688 bp, Zea mays
  misc_feature: Ceres CLONE 1547002
  misc_feature: Encodes the peptide sequence at SEQ ID NO. 69221
  misc_feature (688)..(688): n is a, c, t, g, unknown, or other
agtggatcccccgggctgcaggaattcgtctcacccctagaaaaagtctcccagtccccactccccaggtcctcatcggcctccggtcttctggtctccccagatctcccaccggggaaccctacccgagcatcagccatggcgatcgcggcgcgcgtcctgcgccgcctcccgctccacctctacccctcgctcgctcgctctttctgcgcagtttccccggccgccgcctcggccgccccggcgtccgccaaggtcgccgatcgcatcgtgcgcgttctcgccatcgatctcgagggggggcgccgcgaggtcgtcggcctctccgggaagacactcctccgcgcgctcgccaacgcggagctcatccagccggcctcccaccgcctcgaggatatcgacgcgtgctccgccgagtgcgaggtccacatcgcgcaggagtggctcgacaagctgccgccaccgtcctacgaggagcggtacgtgctcacgcgcgcgtccaggaaccgcgagctcaacaagcacgcgcgcctgtgctgccaggtcgtcctcacgccggagctgcatggcatggtcgtcgctcgtcccgaacctaagccgtgggacatcccgtaaatgcctgccgcgacgaatggcaatgtgcggctttcgacgctgggaagctttccacattcccctggctcgggcn

SEQ ID NO: 69221 - protein, 158 aa, Zea mays
  misc_feature: Ceres CLONE 1547002
MAIAARVLRRLPLHLYPSLARSFCAVSPAAASAAPASAKVADRIVRVLAIDLEGGRREVVGLSGKTLLRALANAELIQPASHRLEDIDACSAECEVHIAQEWLDKLPPPSYEERYVLTRASRNRELNKHARLCCQVVLTPELHGMVVARPEPKPWDIP

SEQ ID NO: 69222 - DNA, 681 bp, Zea mays
  misc_feature: Ceres CLONE 1547006
  misc_feature: Encodes the peptide sequence at SEQ ID NO. 69223
  misc_feature (421)..(421): n is a, c, t, g, unknown, or other
  misc_feature (497)..(497): n is a, c, t, g, unknown, or other
tccccgcggtggcggccgctctagaactagtggatcccccgggctgcaggaattcgtctcacccctagaaaaaaagcaattctccaaattagggtttctttccgcttgctttccagtttgcggcatcagtcggtggcgcctgcgatggagtctctgttcggccaatcgcagcggaggaggagggcgggcggcagcggcttcgaatcgctcaagcgtctgggtcacatctcacccgctgtgcagtcccacctcaaacatgtgtacctcaccctatgctccgcgctggccttctctgcactcggcgcgtacctccacatcctccctcacgtcggaggcgccctcacgaccgtgggatgcgtggcctccatcgccttcctcatctccctggccgcttcacgggaccaggagaggaactgctggncgctgctcatgtctgccgcgctccttcagggggcgtcgttgggccgctcctcgaccctggtattgactgggattcnaggattctcgtccctgggttcgccgggaccgcatttgctttgcatggtttccgggggctgccattttgccccaaggaagggaatccctgtacctcggggggtggttttcattgggctctcccttctttcctgggggggattggaatttaatttttggggcccccaggggactttcgggttggag

SEQ ID NO: 69223 - protein, 179 aa, Zea mays
  misc_feature: Ceres CLONE 1547006
  misc_feature (93)..(93): Xaa is any aa, unknown, or other
  misc_feature (118)..(118): Xaa is any aa, unknown, or other
MESLFGQSQRRRRAGGSGFESLKRLGHISPAVQSHLKHVYLTLCSALAFSALGAYLHILPHVGGALTTVGCVASIAFLISLAASRDQERNCWXLLMSAALLQGASLGRSSTLVLTGIXGFSSLGSPGPHLLCMVSGGCHFAPRKGIPVPRGVVFIGLSLLSWGGLEFNFWGPQGTFGLE

SEQ ID NO: 69224 - DNA, 651 bp, Zea mays
  misc_feature: Ceres CLONE 1547007
  misc_feature (197)..(197): n is a, c, t, g, unknown, or other
  misc_feature (458)..(458): n is a, c, t, g, unknown, or other
  misc_feature (459)..(459): n is a, c, t, g, unknown, or other
tggcggccgctctagaactagtgggatccccctgggctgcaggaattcgtctcacccctagaaaaactccacagcgcccgcgcaggctcgctgcaagcgcaaagcagccacagcaccccctgcacctgcagactgcaaccgcaatggtcggctcctcgggacgctctcccggcggcgctggccgggtgtctccgggncttccttcggccttcggccggcgggggcctccccaaacccccccgcaaatccggggggccccttttcccccccccccccctttgggacccctaaattggggggcccccggtcccaaaaccccccccatattttggggggggtttattttccccccggggcctctcccctcccggggggggtttccctcccttttggccccccccccccgaaaaaaaaaaattttttggtccccccccccccttgtttccccaaaaaaaaannggggggggggaccccccttttttggtgtttttttttctaaagaaaaaaaaacccaccccccgcctcgctgctacacactttttttttttttttttttttgtgggggggggggtgccccccccccccccgacttttttttttcttcccctcctcccccccccataaaaacagtaaattttttttcctcttctg

SEQ ID NO: 69225 - DNA, 730 bp, Zea mays
  misc_feature: Ceres CLONE 1547008
  misc_feature: Encodes the peptide sequence at SEQ ID NO. 69226
  misc_feature (367)..(367): n is a, c, t, g, unknown, or other
gcggtggcggccgctctagaactagtggatcccccgggctgcaggaattcgtctcacccctagaaaaatgaccaaatttccgcaaactgcttctggggatacacttcgtgtcttctactgaagactcatgaaggaccccaagaatctctccaatcttgatcaggatatcccgaatgatgcccaacatacggtggctatatgctctcttcctcaatactggctgtggtgtgaatcttggtgtggaaatgccacaaacgccagagcaaagaccattgatctatgcaacaatccaatgacacacgatcccaagcttcagggtgctagaagaatagatcctgagtggactggtcttgacagtgaatcaccncagttcactgcacgaatcttggaagacacaccccaccctgtagatgtcagacctccgccatccgacgcaccgaagcctgaaaatgatcacgatgtcaaaaatgagctatgatcgcagtatgtttccaggcttggtcttactgaatgaaagattggtgactcgaaagtcctcagttcagaacacaagctcccagcttgtcggagcgcatagggaatacttaacgacaagtgcaaattttgttcaaatcacttacccctggaaatccttggagtaactttaacttacaggaaattttgttctaccgctagtagtttttctaaaacctcttaagcccaattcgtagtgggctgggaaagactggga

SEQ ID NO: 69226 - protein, 116 aa, Zea mays
  misc_feature: Ceres CLONE 1547008
MKDPKNLSNLDQDIPNDAQHTVAICSLPQYWLWCESWCGNATNARAKTIDLCNNPMTHDPKLQGARRIDPEWTGLDSESPQFTARILEDTPHPVDVRPPPSDAPKPENDHDVKNEL

SEQ ID NO: 69227 - DNA, 707 bp, Zea mays
  misc_feature: Ceres CLONE 1547010
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (374)..(374): n is a, c, t, g, unknown, or other
  misc_feature (375)..(375): n is a, c, t, g, unknown, or other
  misc_feature (379)..(379): n is a, c, t, g, unknown, or other
  misc_feature (380)..(380): n is a, c, t, g, unknown, or other
  misc_feature (653)..(653): n is a, c, t, g, unknown, or other
  misc_feature (707)..(707): n is a, c, t, g, unknown, or other
ggcggccgctctagaactagtggatcccccgggctgcaggaattcgtctcacccctagaaaaagtcgataaccaagaacaaaccattgttggacgcgttcccctcctgcacgcaacctcatctcgtcctccagatcctggatggccgtcctccttgataccttgcctcgcgagtgctctcggtgagctactttgttttgatttatcaggaaatccgtttgcttcatgttatgcaggctcaaatctgattgctggattcggcatcttacggggttggataaaactaggacctggaaaaaaacaacaaacccccgttggatcctggatccaatctggaaaaatttcccacaaccggcggggggggggggggnnntnngaanncaaaacccaaatttaaaagcccccccaacgcgtttgggaggggcgggggggatttctttttgggttgtggggggccctcggtttttatccctctgtgggggggggaaatggcaccccccccgcccgcctgtaaaaaaaagatgtctgggaggagagatgttctcttgtaaacccataccaggtgcccggggcagccggcatgatgagggtggaacgtatatgcctctccgcttcttgaagagggacgaggggggttgggggttggagcagttntacggcgttttgtggcgccccgtcccttgctgatactgggggagcctgcccctn

SEQ ID NO: 69228 - DNA, 559 bp, Zea mays
  misc_feature: Ceres CLONE 1547011
  misc_feature (68)..(68): n is a, c, t, g, unknown, or other
  misc_feature (69)..(69): n is a, c, t, g, unknown, or other
  misc_feature (185)..(185): n is a, c, t, g, unknown, or other
  misc_feature (401)..(401): n is a, c, t, g, unknown, or other
ggcggccgctctagaactagtggatcccccgggctgcaggaattcgtctcacccctagaaaaaagcanngccagctcccactcgcaccgcccgtccgcccagaactatctcgctcgtccgcgttcagctcagctactccaattttcgcaacaagttgcaagcaataacccgaccaaggacgacgnacggggttcgatgggccacgctcttcctcctggagcccgctggataaggaaccggggcccggccaaccaccgggaccggcccgggctggaacctccccctcgtaccctgggggggaatgtcttccggaaacgttccggcccaaaaccttttccagggggggggggcccggggcccaaaaaaatcccaaaaaaggggggggtcccctcccccccccnggggaaattttaacccccgggggggccccgtttttttggaaaaaaaaaaaggggctccccccccccccccggggggaggggggaaaccttttttataaccccgggggggaaaaaaagagcccccccaaaagggggtggccgggggggggtaaaaacgg

SEQ ID NO: 69229 - DNA, 552 bp, Zea mays
  misc_feature: Ceres CLONE 1547012
  misc_feature (120)..(120): n is a, c, t, g, unknown, or other
  misc_feature (421)..(421): n is a, c, t, g, unknown, or other
  misc_feature (422)..(422): n is a, c, t, g, unknown, or other
cgcgggtggcggccgctctagaactagtggatcccccgggctgcaggaattcgtctcaccccctagaaaaaaccccagcgcggcgcgagtggagacgccgctgctccgtgcttcgccgcngcctacctaacccaagacctgctagacctgagtggctgagtgttcgtgttcggtcaaaacccaccgcgcgagcgcctccagagtccaaacccgctacaaatctcgcgctgcgcattctccccgtacgatacggcggcacggccccacgaagccaggcgggtggccgccagctagcttagctggcggagtagcaacccgcccacccgaaagggaaatggggccgcgcgccaatggggggaaccaaacccgcgaaacgggagagggcggaagaaaaataccccccccctcccgaggggggggnnccactttccccaaaacccccgggggggaaaaaaaaattgggtgtcccctctttacgccgaaaaaaatttcccccccccccctcccgggggccccccttggggggggggggttcccccaccccacaaaaag

SEQ ID NO: 69230 - DNA, 647 bp, Zea mays
  misc_feature: Ceres CLONE 1547013
  misc_feature: Translation starting site: 192
  misc_feature: SWISSPROT Homolog: EC 1.1.1.37 Malate dehydrogenase
  misc_feature (378)..(378): n is a, c, t, g, unknown, or other
cacccgcggtggcggccgctctagaactagtggatcccccggggctgcaggaattcgtctcacccctagaaaaaaaaaaaaaaaaaaaaaaaaaagctatcccttgggttgccgcagcctccaaagccactcccaaacccccgcttccagaaccttctcgaagctccccgccgcctcctccactcgcaccgatggcgaaggaaccaatgcgcgtgctcgtcactggcgccgcaggacaaattggatatgccctggttcccatgattgctaggggtgttatgcttggtgcagaccagcctgttattctgcacatgcttgacattccgccagcagctgaagcccttaatggtgttaacatggagttggttggatgctgcntttcccccttcggaagggagttgttgctacaactgatgttgtggaaacctgcccctgggtccatggggccgtcatggtggggggattccccaggaaggagggaaagggaaaggaaaaatgttattgcccaaaaagggtttcaatctacaaaatcccaagcatctggcctttgaaacccatggcacctcctcaaaggggaaagggtttcgggggggtttccccacccccaccaaaaaccccatggggcctttaatcttggaaaaaaaaat

SEQ ID NO: 69231 - DNA, 684 bp, Zea mays
  misc_feature: Ceres CLONE 1547016
  misc_feature: Encodes the peptide sequence at SEQ ID NO. 69232
ccgcggtggcggccgctctagaactagtggatcccccgggctgcaggaattcgtctcacccctagaaaaatccaaacctgcaactccgagtcgtctcccgccaacccaatttcgcttcccgccgctccccatctcatcccacaccgtcaaaccgcccgaaaggccgctagaaatccgatcccgagccgccgcgtctcgctcgcgtcttttcccctctgctcgagcacgcgcggctgctcccggcggcggcggcgatgagcgcggtgaacatcaccaacgtggcggtgctggacaaccccaccgccttcatcaacccgttccagttcgagatatcctacgagtgcctcgtgcccctcgacgacgatctggagtggaagcttatatatgttggatcagctgaagatgaaaactacgaccaacagcttgagagtgtgcttgttggccctgtcaatgttgggacctaccgttttgtcctccaggctgatccaccggatccctcaaagatccgtgaggaagacataattggtgtgactgtgctgctattgatgtgctcttacatgggccaggagttcatgagagtaggctactatgtgaacaatgattatgacgatgaacagttgagagaggagcctccagcaaaggtgctaatcgatcgggtgcagagaaatatcctggccgacaagc

SEQ ID NO: 69232 - protein, 143 aa, Zea mays
  misc_feature: Ceres CLONE 1547016
  misc_feature (1)..(143): Pfam Name: Anti-silence Pfam Description: Anti-silencing protein, ASF1-like
MSAVNITNVAVLDNPTAFINPFQFEISYECLVPLDDDLEWKLIYVGSAEDENYDQQLESVLVGPVNVGTYRFVLQADPPDPSKIREEDIIGVTVLLLMCSYMGQEFMRVGYYVNNDYDDEQLREEPPAKVLIDRVQRNILADK

SEQ ID NO: 69233 - DNA, 709 bp, Zea mays
  misc_feature: Ceres CLONE 1547018
  misc_feature: Encodes the peptide sequence at SEQ ID NO. 69234
gcggtggcggccgctctagaactagtggatcccccgggctgcaggaattcgtctcacccctagaaaaagcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggggacgagccggtcgccgtctttggcatcaggaaccctgaggaaatcccgtggggtgaggctggcgctgaatatgtcgtggagtccaccggcgtcttcactgacaaggacaaggctgctgcacatctcaagggtggtgccaagaaagttgttatctctgccccaagcaaagatgcacccatgtttgttgttggggtcaaatgaagacaagtacccctccggatgttaacaattgtttcccaatgctagctgcaccccaaaactggcttggctccccttgctaaagggcatttcctgaacaccttcggcatttggtgaagggttatgaagaaccccctggttcatgcccatccccgg

SEQ ID NO: 69234 - protein, 138 aa, Zea mays
  misc_feature: Ceres CLONE 1547018
  misc_feature (4)..(139): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDEPVAVFGIRNPEEIPWGEAGAEYVVESTGVFTDKDKAAAHLKGGAKKVVISAPSKDAPMFVVGVK

SEQ ID NO: 69235 - DNA, 724 bp, Zea mays
  misc_feature: Ceres CLONE 1547043
  misc_feature: Encodes the peptide sequence at SEQ ID NO. 69236
ggagctccccgcggtggcggccgctctagaactagtggatcccccgggctgcaggaattcgtctcacccctagaaaaacacaagcaccagaccaattaactagcttcttctagctctagctaggctcgtttgctgcaagaaggtaacagctaacaagcatggaggggaaggatgaggacgtccgcctgggcgccaacaagttctcggagcgccagcccatcggcacggcggcgcagggcacggacgacaaggactacaatgagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaacgtcggcatacagggcatcgcctggtccttcggcggcatgatcttcgccctcgtctactgcaccgccggcatctccggcgggcacatcaacccggcggtgaccttcgggctgttcctggcgaggaagttgtccctcaccaaggcggtgttttacatcatcatgcaatgcctgtgcgccatctgcggcgcgggcgtcgtctagggattccagcatgagctgtacatggacaacggcggcggcgccaacgtcgtcgcgcacggctacaccaagggcgacagcctcggcgccgagatcttcggcaccttcat

SEQ ID NO: 69236 - protein, 152 aa, Zea mays
  misc_feature: Ceres CLONE 1547043
  misc_feature (46)..(153): Pfam Name: MIP Pfam Description: Major intrinsic protein
MEGKDEDVRLGANKFSERQPIGTAAQGTDDKDYNEPPPAPLFEPGELKSWSFYRAGIAEFVATFLFLYISILTVMGVSKSTSKCANVGIQGIAWSFGGMIFALVYCTAGISGGHINPAVTFGLFLARKLSLTKAVFYIIMQCLCAICGAGVV

SEQ ID NO: 69237 - DNA, 733 bp, Zea mays
  misc_feature: Ceres CLONE 1547046
tccccgcggtggcggccgctctagaactagtggatcccccgggctgcaggaattcgtctcacccctagaaaaaatcgcttcagctcggcgtcttcacaaacgccggcgcaaactctcgcccgagcccgacagatcttcaattccccattccgcccaccgatcgaccttcacgccagtctcggtctcttccgaaagcgtcgcgcgcggttgttttgagaggagaggatgaagatgacggagtgcatctccgtccacatcgggcaaggccggcattccaagttcgggcaaacgcggtgccctgggggaaattttaattggcttaggacggcattcctgccctggaagggccaaatgcctggaaaataaaacccggggggaaatccccagaaaaggcttttaacaccctttgtttagcccaaaccccccgtggggggaaaacctttcccccggggaaaattttgggttttaatcctagaaaacccccctgtggttaccctaaaaggggggggcctgtggtcagaaaaccgcgggtttttttcttacctctgtagggagccttttcttttggggagagagggagaccgcctcataaaaatttttcccccggggccccccaccccaaatttgggcaacagaaaattgttgttattttggctctttaaccccgatccctccgccgggtggggggaaactacaccaccccgccccccctcggtgggtctctttggttgtt

SEQ ID NO: 69238 - DNA, 712 bp, Zea mays
  misc_feature: Ceres CLONE 1547053
  misc_feature: Translation starting site: 82
  misc_feature (657)..(657): n is a, c, t, g, unknown, or other
acccgcggtggcggccgctctagaactagtggatcccccgggctgcaggaattcgtctcacccctagaaaaagcggcagcaatggagaccctcctctccccctccacattgttcacgctatcactccgtggctccagcaggagaccgtctctggctgctagcgtctcgtccagacccaccgtgtcatgctccagcgcgctcaagaggccacaggccggcgccgtcgctgcctcctcccatggagacggcgtcggcaggaactggatgtcgttcctgcaccacggcctggcggcggccgcgctgtcgctggccatcggcctggccccggcgccggcgccggcggtggcgtcggagttcgacgtgctgaacgacggggcccccgaggactcctacgtggtggacgacgcaggcgtgctgagccgcgtcaccaagtccgacgtcaagcggcttgcccgcgacctggaggcccgcaagaacatccgcctcaacttcatcactgtccgcaagctcacgagcaaggctgacgcgttcgagtacgcggaccaagtcctggagaagtggtaccccacgatcgaggagggcaacaacaagggcatcgtggtgctcgtcacaagccagaaagagggcgccgtcaccggggggcccgccttcatccangccgtcggcgaccgattctcgacgccaccgtgtctgagaacctccagtcctcgcg

SEQ ID NO: 69239 - DNA, 726 bp, Zea mays
  misc_feature: Ceres CLONE 1547055
  misc_feature: Encodes the peptide sequence at SEQ ID NO. 69240
aaagctggagctccccgcggtggcggccgctctagaactagtggatcccccgggctgcaggaattcgtctcacccctagaaaaaccctagaaaaaagccgcacaatccatccatccatctattctccagtccacccattccattccactaccgacgcccagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggagtcgcctcgccgtccgctggcgccgcgtgcagggccgcgggcaaggggaaggaggtgctcaacggggtcgtgttccggcccttcgaggaaatcaagggggagctcgccctcgtgccccagtccccagacaagtcgctcgcgcgccacaagttcgtcgatgactgcgaggccgccctcaacgagcagatcaacgtggagtacaacgcctcgtatgcataccactccctcttcgcctatttcgaccgcgacaacgtggctctcaaaggatttgcccaattcttcaaggatcccgcgacgaggaaaggagcacgctgaaaagctcctgaagaacaaaaacaacgtgggaggagggggaggctccaatcaattgtgacgccttttaccaagtttgacccccggaaaaaggagagctctggaccc

SEQ ID NO: 69240 - protein, 139 aa, Zea mays
  misc_feature: Ceres CLONE 1547055
  misc_feature: SWISSPROT Homolog: EC 1.16.3.1 Ferroxidase
MMLRVSPSPAAAVPTQLSGAPATPAPVVRVAAPRGVASPSAGAACRAAGKGKEVLNGVVFRPFEEIKGELALVPQSPDKSLARHKFVDDCEAALNEQINVEYNASYAYHSLFAYFDRDNVALKGFAQFFKDPATRKGAR

SEQ ID NO: 69241 - DNA, 796 bp, Zea mays
  misc_feature: Ceres CLONE 1547065
  misc_feature (501)..(501): n is a, c, t, g, unknown, or other
  misc_feature (526)..(526): n is a, c, t, g, unknown, or other
  misc_feature (596)..(596): n is a, c, t, g, unknown, or other
ccccgcggtggcggccgctctataactagtggatcccccgggctgcaggaattcgtctcacccctagaaaaaacgtctccaccgctgcatgaactccccccctccctggtggaccgcgggcttaccaaccatggcagtcctacccgccgcgcaccacatggtggttgggtcccaccgccttgtccacggccagcacaccagtagcagcccgtcgctgcattcggcctcccgcagctcctccgcggggaagcctcccgtccagctccttctgtcgcaagcaagggcgtctggtttccccgcgggccgtctacgttcaagcggttgcagaaactacaacccagtcttttgtccctcgccccaagacggaggaggggggcggcccagacctcctcccgcccccctaccccaaagggggctttccaaaatcagttatcacacaacgtaccacctatccgaaccgctccacccctaatcacctaagcggaaggaatctcatcaaanaactttgatatttccttagaagacnactacggcttctcataaaagcccttgtctcgaacctcaatccgacttggggttgcatccaagccgttttngggagtaatgaaggggcgaatatctacaccaacttggagaccgtagtcccaaaattctccccgaagattacgtcgagggaagtttaccttgaaagacttaaccgcttctgggtgctcttaaggtgtactaagggaactgcctacgactggccctagtctctcccacaatcttcgaggacctaagtctctaccactctctg

SEQ ID NO: 69242 - DNA, 659 bp, Zea mays
  misc_feature: Ceres CLONE 1547066
  misc_feature (322)..(322): n is a, c, t, g, unknown, or other
  misc_feature (390)..(390): n is a, c, t, g, unknown, or other
  misc_feature (398)..(398): n is a, c, t, g, unknown, or other
  misc_feature (405)..(405): n is a, c, t, g, unknown, or other
tccccgcggtggcggccgctctagaactagtggatcccccgggctgcaggaattcgtctcacccctagaaaaaataccctgctcgtcagcccggataagataacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgcccgtctctctgcctccctccctttcgcctccccactcgtttcaggcgggtacggnacctgggcggcgacttcagtgtcgtccgcgggaaagttgagaacggcggggcctggaagtggtgtgcnaagccacnaactggncggcggccggactcgggtaagaagagggagcggcagaacgacaagcaccgcatccgaaatcacgcgcggcaggcccagaatgcccactaggaatgaaaaaggctttagagctccttgaaaaagctaagaaaaaaccctgaccccccaccctgaaaaaataattgaaaaaaaaaaaacttaatccctgaaggtatacaaacccctctacaaaaacggggaaagggtgggccccctggctaaagaaaacccgggaa

SEQ ID NO: 69243 - DNA, 735 bp, Zea mays
  misc_feature: Ceres CLONE 1547069
  misc_feature: Encodes the peptide sequence at SEQ ID NO. 69244
  misc_feature (382)..(382): n is a, c, t, g, unknown, or other
  misc_feature (383)..(383): n is a, c, t, g, unknown, or other
  misc_feature (581)..(581): n is a, c, t, g, unknown, or other
  misc_feature (735)..(735): n is a, c, t, g, unknown, or other
ggcggccgctctataactcctggatcccccgggctgcaggaattcctctcacccctagaaaaattccccctcgatcggcctccctcccccaagatcctccactcgatcccaaacaaaccaacaaatccatccatcgcacatggacgcgttcttctcggcctcctccgcgtcggcgccctacggctacggcgccggcggatggagctactactcgctcaagaacttccgccagatcacccctgccgtccagacccacctcaagctcgtctacctcaccctgtgcgcggcgctggcctcgtctgcggtgggcgcttacctgcacgtggtctggaaaattttccccccccccacggggcggggggggggcccccacatccccctnncccccccccctggttcgtctacaaagaaaaaaatatgtttgggctgctgatggctgcctccccctcctggaaagggacttcggacggaccccctcttcaagttcaccggggaattttgactcccgcttccttgccgaacaggaaccctcggcgactgccaatcgcgggtcgccggcgtttcctcggatctgccttggnggtcacgcaggtctgagttaatccttctcccgggggtctgtctgtcttcattctaccggcttcccaagcgggttcaggcctgtctaactcccgcccgttgaccctctcgcgcgctaagtctacctaattgtttattgacctgggcgcagtctcn

SEQ ID NO: 69244 - protein, 97 aa, Zea mays
  misc_feature: Ceres CLONE 1547069
  misc_feature (82)..(82): Xaa is any aa, unknown, or other
MDAFFSASSASAPYGYGAGGWSYYSLKNFRQITPAVQTHLKLVYLTLCAALASSAVGAYLHVVWKIFPPPTGRGGGPHIPLXPPPGSSTKKKICLGC

SEQ ID NO: 69245 - DNA, 617 bp, Zea mays
  misc_feature: Ceres CLONE 1547074
  misc_feature: Encodes the peptide sequence at SEQ ID NO. 69246
  misc_feature (93)..(93): n is a, c, t, g, unknown, or other
  misc_feature (94)..(94): n is a, c, t, g, unknown, or other
tgggctccccgcggtggcggccgctctagaactagtggatcccccgggctgcaggaattcgtctcacccctagaaaaatcaaccaaagctagnnctactttgttgctgtttttattcgtttgtcacataagcagtggtggtcggtcggccggcgacaatgagcggccgtgtgttcgtcctggccgctgccttcggcgtgctgctcgccgcagccgccgtgtcctcgaggcccgtcctgactccgctgggtactagccgccctgctgccggcgacctgtccgtgtacttccacgcggactcgtgcccgcagctggagacgatcgtgcggtccagcgtggacggcgcgcttcagcagaacgtccgtctgacggcgggtcctcctccgcctcctggtcacgactgcttcccccagggctgcgacccgtccattctcctggaaaaggggaaggggggccctcccgcccaacttggggctgcacccaggaagccctgccacttggggaagaaatcccccggaaaaggggccaccggggtgggggccccccccgggttcggggccccaaattccggggggtggggccccccccaaaacccccttaacctttttccgggggggc

SEQ ID NO: 69246 - protein, 153 aa, Zea mays
  misc_feature: Ceres CLONE 1547074
  misc_feature: SWISSPROT Homolog: EC 1.11.1.7 Peroxidase
MSGRVFVLAAAFGVLLAAAAVSSRPVLTPLGTSRPAAGDLSVYFHADSCPQLETIVRSSVDGALQQNVRLTAGPPPPPGHDCFPQGCDPSILLEKGKGGPPAQLGAAPRKPCHLGKKSPGKGATGVGAPPGFGAPNSGGWGPPQNPLNLFPGG

SEQ ID NO: 69247 - DNA, 707 bp, Zea mays
  misc_feature: Ceres CLONE 1547081
  misc_feature: Encodes the peptide sequence at SEQ ID NO. 69248
  misc_feature (611)..(611): n is a, c, t, g, unknown, or other
tccccgcggtggcggccgctctagaactagtggatcccccgggctgcaggaattcgtctcacccctagaaaaaagcttcccactccgctcggccaccagctttgaccgcctcccctcccctcctctcctgtgttcctccataccccactccccccgcaggagcggcgcggcggcggcaaaggcaaaggcaaaggcaagatgttcgggcgcgcgccgaagaagagcgacaacaccaagtactatgagatcctcggagtgcccaagtcggcgtcccaggacgacctcaagaaggcctaccgcaaggccgctatcaagaaccaccccgacaagggcggtgaccccgagaagttcaaggagctcgcacaagcctatgaggttttgagtgatccagagaaacgtgagatttatgatcagtatggtgaagatgcccttaaggaaggaatgggtggtggtggatcccatgctgatccatttgacattttctcatcattctttggaccctcttttggaggaggtggtggaagcaccaggggaagaaggcaaaggaaggggagaagatgtagtccactcacttaaagttctcttggaagatctttacaatggaatctcanaaaacctctctctttcccgccatgtcatctgctccaggggcaagggcaaggcctccaagtcctgggcttcaatggagtgccctgggtgccagggct

SEQ ID NO: 69248 - protein, 125 aa, Zea mays
  misc_feature: Ceres CLONE 1547081
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYEVLSDPEKREIYDQYGEDALKEGMGGGGSHADPFDIFSSFFGPSFGGGGGSTRGRRQRKGRRCSPLT

SEQ ID NO: 69249 - DNA, 781 bp, Zea mays
  misc_feature: Ceres CLONE 1547083
  misc_feature: Encodes the peptide sequence at SEQ ID NO. 69250
  misc_feature (1)..(1): n is a, c, t, g, unknown, or other
  misc_feature (2)..(2): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (257)..(257): n is a, c, t, g, unknown, or other
  misc_feature (278)..(278): n is a, c, t, g, unknown, or other
  misc_feature (282)..(282): n is a, c, t, g, unknown, or other
  misc_feature (305)..(305): n is a, c, t, g, unknown, or other
  misc_feature (308)..(308): n is a, c, t, g, unknown, or other
  misc_feature (309)..(309): n is a, c, t, g, unknown, or other
  misc_feature (316)..(316): n is a, c, t, g, unknown, or other
  misc_feature (325)..(325): n is a, c, t, g, unknown, or other
  misc_feature (335)..(335): n is a, c, t, g, unknown, or other
  misc_feature (344)..(344): n is a, c, t, g, unknown, or other
  misc_feature (345)..(345): n is a, c, t, g, unknown, or other
  misc_feature (357)..(357): n is a, c, t, g, unknown, or other
  misc_feature (553)..(553): n is a, c, t, g, unknown, or other
  misc_feature (557)..(557): n is a, c, t, g, unknown, or other
  misc_feature (558)..(558): n is a, c, t, g, unknown, or other
  misc_feature (609)..(609): n is a, c, t, g, unknown, or other
  misc_feature (610)..(610): n is a, c, t, g, unknown, or other
  misc_feature (692)..(692): n is a, c, t, g, unknown, or other
  misc_feature (729)..(729): n is a, c, t, g, unknown, or other
  misc_feature (733)..(733): n is a, c, t, g, unknown, or other
  misc_feature (752)..(752): n is a, c, t, g, unknown, or other
  misc_feature (767)..(767): n is a, c, t, g, unknown, or other
nntttattgttgcctccccccctattannnttnnnnttttttnnnaaggataaaggactccccgcggtggcggccgctctaaaatagtggatcccccgggctgcaggaattcgtctcacccctagaaaaatctctagaagaaaaacaaaatcagtgcacagcttgcctgctcaaatgatgcaacacaaaataaaaggtggttttgatgggaaagcttggtgggttaactccggccttttgccataaagcatcagatnagaactgatggtacgccgcancgantgcaatgctggaaaaatgcttcntanntccgcangcgttacgnttcaagacgncgtcaccannctttccccgagntccatcagggcttcgggatcctaatgggcaagtgaccttgaagcacggcgacaaaactctcgttgattcgagggacatctgccggtacgtctgcacccagtttccaaacgatggaaacaagagcctttacggatccggcgctctagaacgggcgtcgatagaacagtggcttcaggcggaggctcagaactcgggncctnnagctcgcgctcgtctccagctgggcgtcgtccctcacctcactcacctggnncgtcgtcaggaccctgccgtgatcgccgagaacgaggataagctgaagcagggtccttgatgtctacgacgagatactctcngaggaacgagtatctgggctggcgacgagttcacccntggnctgactctcctaccctccngaaactcgcactacnatcgtgaacactga

SEQ ID NO: 69250 - protein, 127 aa, Zea mays
  misc_feature: Ceres CLONE 1547083
  misc_feature: SWISSPROT Homolog: EC 2.5.1.18 Glutathione transferase
  misc_feature (7)..(7): Xaa is any aa, unknown, or other
  misc_feature (8)..(8): Xaa is any aa, unknown, or other
  misc_feature (10)..(10): Xaa is any aa, unknown, or other
  misc_feature (17)..(17): Xaa is any aa, unknown, or other
  misc_feature (20)..(20): Xaa is any aa, unknown, or other
  misc_feature (24)..(24): Xaa is any aa, unknown, or other
  misc_feature (91)..(91): Xaa is any aa, unknown, or other
  misc_feature (108)..(108): Xaa is any aa, unknown, or other
MLEKCFXXPXALRFKTXSPXFPRXPSGLRDPNGQVTLKHGDKTLVDSRDICRYVCTQFPNDGNKSLYGSGALERASIEQWLQAEAQNSGPXARARLQLGVVPHLTHLXRRQDPAVIAENEDKLKQGP

SEQ ID NO: 69251 - DNA, 753 bp, Zea mays
  misc_feature: Ceres CLONE 1547084
  misc_feature: Encodes the peptide sequence at SEQ ID NO. 69252
gactcggtggagctccccgcggtggcggccgctctagaactagtggatcccccgggctgcaggaattcgtctcacccctagaaaaattgggagctcactcgctggtcgttgcctgctgcggattgcccccaggcggccccactcactccgctgttgatatttcgtttggttctcctttccgtcttgtccgtcgccgaggccttcttcccctcgctccccagctccagcaggcagatcagatccatccaaccacgaacaggaaggaaggtaggaggcctgaggggctgaagttgaaccatgagtgccgtcgcggtttcgtcgtcgctgaacccgaacgcgccgctcttcatcccggcggcgctgctgcccgtggaggacggctcgccgcattggtgggacctcatcacccccaccgccttggttccccgacccctggttcccgcaaccacgcccacctggactgaaatagccaatcagctcgagttgggcgcccctcctggcgaccactgaggatgaggacctgcttctacggggagcaggcccccggctgccggatccttaaaaaagaattccgtgctccaggctcctgaatctggggttcgccctgaaaatggccaactccccgtaggtgtttccttggaaaaaggtgccatgttggaaaggcccactattaggccctccatacacgggaataccggtgtgtatccttctccctggggggtgagtgaagtacctctgtgggatctttggagg

SEQ ID NO: 69252 - protein, 70 aa, Zea mays
  misc_feature: Ceres CLONE 1547084
MSAVAVSSSLNPNAPLFIPAALLPVEDGSPHWWDLITPTALVPRPLVPATTPTWTEIANQLELGAPPGDH

SEQ ID NO: 69253 - DNA, 721 bp, Zea mays
  misc_feature: Ceres CLONE 1547087
  misc_feature: Encodes the peptide sequence at SEQ ID NO. 69254
ggagctccccgcggtggcggccgctctagaactagtggatcccccgggctgcaggaattcgtctcacccctagaaaaatttccattccatcggtggcacgagacaggagacgccaaggccatagctagagcctagagcagcagcagaggcttgacctgaagctccacccgccatggcattcacgcccgctacggcctgctgcaaggcttccctggcgctggcaccgcgggcgtcgccccgcggcccggcggcctgcgcgcaggcggcgctcctctgcacgccctccacctccgtgttccgcggcctccgggcgcccgcatccgccgcgccggccccgcgccggcgccgctcggcggcgtccacgggcatagtctgcggcaaggtcgccaagggcagcgtgccgccgaacttcaccctcaaggaccagaacggcaagcccgtgtcgctgaacaagttcaagggcaagcccgtcgtggtttacttctaccccgccgacgagacgcccggatgcacaaagcatgcgtgcgcgttcaaggactcgtacgataagttccagaaggccggggcggaggtgatcggcatcagcggcgacgacgccggcgtcgcacaaagcgttcgcgcataagtacccggctgccgtttcacgctgcttgaacgacgagggggaacccccgttgcgcaaggtagtggggggcgttccccctccggaactggttcgggg

SEQ ID NO: 69254 - protein, 150 aa, Zea mays
  misc_feature: Ceres CLONE 1547087
  misc_feature (73)..(151): Pfam Name: AhpC-TSA Pfam Description: AhpC/TSA family
  misc_feature: SWISSPROT Homolog: EC 1.11.1.15 Peroxiredoxin
MAFTPATACCKASLALAPRASPRGPAACAQAALLCTPSTSVFRGLRAPASAAPAPRRRRSAASTGIVCGKVAKGSVPPNFTLKDQNGKPVSLNKFKGKPVVVYFYPADETPGCTKHACAFKDSYDKFQKAGAEVIGISGDDAGVAQSVRA

SEQ ID NO: 69255 - DNA, 543 bp, Zea mays
  misc_feature: Ceres CLONE 1547094
  misc_feature (152)..(152): n is a, c, t, g, unknown, or other
  misc_feature (354)..(354): n is a, c, t, g, unknown, or other
  misc_feature (399)..(399): n is a, c, t, g, unknown, or other
  misc_feature (401)..(401): n is a, c, t, g, unknown, or other
  misc_feature (407)..(407): n is a, c, t, g, unknown, or other
  misc_feature (442)..(442): n is a, c, t, g, unknown, or other
  misc_feature (494)..(494): n is a, c, t, g, unknown, or other
  misc_feature (525)..(525): n is a, c, t, g, unknown, or other
gcggtggcggccgctctagaactagtggatcccccgggctgcaggaattcgtctcacccctagaaaaaaaacaaatctctcgcgcctcccactcctccccgccactcgccgccagcgaccaaccatttcgcccgcccagcagcagcacgggntcccacgccagggacttcgaacccaacgcgcggctagctaaaagctcccccgcccgccctgaatattaaggccctgaagtttccgggggggctggcctttttttttcccggggcccggggccgggggtttttccgcccccccccaaaaggggggggggtttataaaaaaccccccccccccccccccaaaaaaacaaccccnaaaaaaaaaaaaaaatgtggcgaaaaaaggggccccctggggggngncccccntgtttttttttccccaaaaaaaaatatttttgtgnttggggggggggtgttttttttgtggtccccccccccccccccttctttttnataaaaaaaatttttttgtgggggggggagnaaaaaaaaaaataaaaaa

SEQ ID NO: 69256 - DNA, 775 bp, Zea mays
  misc_feature: Ceres CLONE 1547102
  misc_feature (1)..(1): n is a, c, t, g, unknown, or other
  misc_feature (2)..(2): n is a, c, t, g, unknown, or other
  misc_feature (11)..(11): n is a, c, t, g, unknown, or other
  misc_feature (48)..(48): n is a, c, t, g, unknown, or other
  misc_feature (156)..(156): n is a, c, t, g, unknown, or other
  misc_feature (414)..(414): n is a, c, t, g, unknown, or other
  misc_feature (457)..(457): n is a, c, t, g, unknown, or other
  misc_feature (483)..(483): n is a, c, t, g, unknown, or other
nnaataccccnacaaacgtcgagctccccgcggtggcggccgctctanaactagtggatcccccgggctgcaggaattcctctcacccctagaaaaacctcgctttttgtactcttccgtctttgccctcgcgttatcgcgctcgtctcgcctggnctagctagctgcctgcctgccttggcttgcttgctacctcgtgtacacagcgagaggaaggacaggaccaaaaaaagaaagaatagacagagagagagacagtcgtttcctttcctcgaacttattccatggagacctcttctcacaaccgggggcgggagggggtccatctcgccgccgtcgctgcccccgactgagaggtcgtgtgggcggatttttttttccccccccctggggggaagacgggggctctaaatnctctaaaacaacacccacccgggcggcgacggaaaaatagaanccggcctggggagccgggaggaggcnagagcttcttttaccaatgctccggaggccgaaaccagattggcccggataggaggttgctcctcgagggccgtgaccactaggtaggattcgccgctgtccagtaacgcctcccccttcctacgaagttgagctcgactcgacctatatagcacgaaagtcacggacgccctgtctaaagtacatcctctagcgcgctgcggctattcccttccgtacgactccacacaccctgcgaaatataagcctctccattttcccccccctcttccaactatgggaccttatacag

SEQ ID NO: 69257 - DNA, 724 bp, Zea mays
  misc_feature: Ceres CLONE 1547111
  misc_feature: Encodes the peptide sequence at SEQ ID NO. 69258
cgcggtggcggccgctctatactagtggatcccccgggctgcaggaattcgtctcacccctagaaaaaaactcatccattccatcatcccctttgcaagtatagtctctctgctaagcgaagcgaagcttcaagctagtctcggcggctctagaagacgatgggcaaggacgacgtgatcgatagcggcgctggcggaggcgagttcgctgccaaggactacacggaccctcccccggcgccgctgatcgacgcggcggagctggggtcctggtcgctgtaccgcgccgtgatcgccgagttcatcgccacgctgctgttcctgtacatcacgggggccaccgtgatcgggtaccagcaccagacggacgcgtcggcttctggcgccgacgcgacgtgccgcgccttgggcgtgctgggcatcgcctgggccttcggcgggatgatcttcatcctcgtctactgcaccgccgggatctcggggggccacgtcaaccccgccgtcaccttctgcctcttcctggcgcgcaaggtctccctggtgcgcgcgctgctctacatcgtggcgcagtgcctcggcgccctctgcggcgtctgcctcgccaaggcgttccagagcgcctacttcgactggtacggtggcggcgccaactcgctcgcctccggctactctcgcggcaccggcctcggcgccgagatcatcggcaccttcgtgctcgtctaca

SEQ ID NO: 69258 - protein, 188 aa, Zea mays
  misc_feature: Ceres CLONE 1547111
  misc_feature (34)..(188): Pfam Name: MIP Pfam Description: Major intrinsic protein
MGKDDVIDSGAGGGEFAAKDYTDPPPAPLIDAAELGSWSLYRAVIAEFIATLLFLYITGATVIGYQHQTDASASGADATCRALGVLGIAWAFGGMIFILVYCTAGISGGHVNPAVTFCLFLARKVSLVRALLYIVAQCLGALCGVCLAKAFQSAYFDWYGGGANSLASGYSRGTGLGAEIIGTFVLVY

SEQ ID NO: 69259 - DNA, 706 bp, Zea mays
  misc_feature: Ceres CLONE 1547115
  misc_feature: SWISSPROT Homolog: EC 3.1.3.16 Phosphoprotein phosphatase
  misc_feature (667)..(667): n is a, c, t, g, unknown, or other
  misc_feature (701)..(701): n is a, c, t, g, unknown, or other
ggtggcggccgctctagaactagtggatcccccgggctgcaggaattcgtctcacccctagaaaaaaggcccgtgatggtcaccacctctcccagcacgaacttctgtccatctgcgagtatctgatcgagatccctcctcgcttatctaacgtgtctccggtgcacctctcgtgactgtttgcggagatctcctcgacccgttccctgagctgctgaacctctctccgacgccgggcccttgcctcggacacgatctatattttcataggcgacttagcgcaccgtgacttcgaagacgtagaggtgttcgacatacggtgggttgtcgcagccagggatacaggacaacttatgcttgtgctcggatttcgagggcgcaattcgttgacccaggagtgtgatctctaatatcatagactcaggaagtatggcagctatcatgcatgtgctgattgctctgatgtaattccatcactatgaacgatcacaggctgaactgtgggcgtcgtctgagattttcctggacactcttgcagatgagacaggtattaaagttactgccattttcgctgacgctggagcagctgcccttcatcggcatctctgcaatcatgcacaatatcgatgtgccagatatagagaccggaatgcatatgctcgtgaanatgaggtcgctgttatgattatccctgatcatcnaatgc

SEQ ID NO: 69260 - DNA, 692 bp, Zea mays
  misc_feature: Ceres CLONE 1547116
  misc_feature: Encodes the peptide sequence at SEQ ID NO. 69261
  misc_feature (675)..(675): n is a, c, t, g, unknown, or other
  misc_feature (676)..(676): n is a, c, t, g, unknown, or other
aaagctggagctccccgcggtggcggccgctctagaactagtggatcccccgggctgcaggaattcgtctcacccctagaaaaacccatcagccatcccctcccgcggcaagtctctctgaattgtgggtctccggcgatggcggctcttgctccatccaagattctgggcaccaagctcaacttcgccggctcctcccgctacgccaccgcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggagaggtccctggagactatggctacgacccttttggcctgggcaagaagccagaggacttcgccaagtaccaggcctacgagctgatccatgccagatgggccatgctcggtgccgctggcgctgtcatcccagaggcgtgcaacaagttcggcgctaactgcggccccgaggccgtctggttcaagaccggagccctgctcctcgacggaaacaccctcagctatttcggcaacagcatccccatcaacctggtggtcgccggatcnncggaggtcgtcctcgt

SEQ ID NO: 69261 - protein, 184 aa, Zea mays
  misc_feature: Ceres CLONE 1547116
  misc_feature (83)..(180): Pfam Name: Chloroa_b-bind Pfam Description: Chlorophyll A-B binding protein
  misc_feature (180)..(180): Xaa is any aa, unknown, or other
MAALAPSKILGTKLNFAGSSRYATAAPTAGAQKIVSLFSKKPAQKPKPSAVSSSSPDISDELAKWYGPDRRIYLPDGLLDRSEVPEYLTGEVPGDYGYDPFGLGKKPEDFAKYQAYELIHARWAMLGAAGAVIPEACNKFGANCGPEAVWFKTGALLLDGNTLSYFGNSIPINLVVAGSXEVVL

SEQ ID NO: 69262 - DNA, 703 bp, Zea mays
  misc_feature: Ceres CLONE 1547121
  misc_feature: Encodes the peptide sequence at SEQ ID NO. 69263
  misc_feature (670)..(670): n is a, c, t, g, unknown, or other
cgcggtggcggccgctctagaactagtggatcccccgggctgcaggaattcgtctcacccctagaaaaaatacagaaatggtagggttcttcggcgcctctgctgcatctgatcactgtcgtttgctgacaacaaatggatcagttcaccatgaactgattagacgacaccatggcagaccaagaagtgcgatcaggtgctgcagcagcacggcaaggggaaggaccagggactattactaccaggtgctgggcatcgcaattcaatccacccctcagcagatcaaggaggcttacaggaaactccagaagccacaccatccagacatcgccggctacaaggggcccgactaccccctgctgctgaaccaggcctacaaggttctgatgcgggatgtttccagttcccggcacccccatggaagggccaggagtaggtggggggcggaaccgggtacaccgggaacggaacagtttctgggaaaaggccccttaaaaaacccaaccccctcccgggaccaaaaccaaatgccatagaatgccggggatgggtctcgaccaagcccccttgggaactttccccattggaaaaaactattccgtcataccccccaacctggaaaggtcccattttcggcgacccgtggaaaacaaaaaaatttttcctggtntgttacaaaccccccctacccccgcgggacaag

SEQ ID NO: 69263 - protein, 152 aa, Zea mays
  misc_feature: Ceres CLONE 1547121
  misc_feature (53)..(113): Pfam Name: DnaJ Pfam Description: DnaJ domain
MVGFFGASAASDHCRLLTTNGSVHHELIRRHHGRPRSAIRCCSSTARGRTRDYYYQVLGIAIQSTPQQIKEAYRKLQKPHHPDIAGYKGPDYPLLLNQAYKVLMRDVSSSRHPHGRARSRWGAEPGTPGTEQFLGKGPLKNPTPSRDQNQMP

SEQ ID NO: 69264 - DNA, 621 bp, Zea mays
  misc_feature: Ceres CLONE 1547125
  misc_feature: Translation starting site: 193
  misc_feature: SWISSPROT Homolog: EC 6.3.2.19 Ubiquitin--protein ligase
  misc_feature (621)..(621): n is a, c, t, g, unknown, or other
ccgctctagaactagtggatcccccgggctgcaggaattcgtctcacccctagaaaaagagtgcatgccccgactcctcgcttcctcccgttccgtcgccgcggcgcgcctcgtacaagagatagaggcggccgctgcatcgacgccgcgctagctccgcctgtctcccccggcactgatcgggtttgatccatgcgctcgaagcacatccagcacgagttgaaggacctgcataaggaccctgccacacctcctgcagagcaggtcctgctgctgatcacctgttcgattgtgtaccgaacatcgtggggccttctcacggcccatcttgcaggtggcggtattcctggtgaacaattctcttcgcaccggatgactctttctagccacccaaggtgttttttccgcgccacggattttccaaaacgcaagattttgcgcaaacgggtggcactttgcccttgggaaccttcccttcaaaggaaaaagtgggggaatccccccccttggctctcctgtgtggtattttttcttgttttgcgcggggggggggtgtgtgcccacctctcccttattatagactggaagttctaatcgtcctcttcactctactctcctccn

SEQ ID NO: 69265 - DNA, 701 bp, Zea mays
  misc_feature: Ceres CLONE 1547127
  misc_feature: Encodes the peptide sequence at SEQ ID NO. 69266
ggagctccccgcggtggcggccgctctagaactagtggatcccccgggctgcaggaattcgtctcacccctagaaaaaaagctagtggcgagagaggtcgtgcgcagtgcctggtgggtctagtctagtggcatcatggaggaggcggtggaggccgtggtcgcggtcggagtggagccgttcccgacggtggacaagtgcgacgcgtcgggacgcggcgcgcacgccgtggtggcggacctggactgtgcgctgctgcgctcccgcagcgcgttcccgtactacgcgctggtgggcttcgaggacggcggcgtgccgcgcctgctgctgctgctgctgctggccccgctggccgcggcgctgctggcgctggcctcggagtcggcgtgcgcgcgcgtgctggtgttcgcggacacggtgggcgcccgggtgcgcgacatctagtcggcggcgcgcgccgtgctcccgcgcttctactccgtgcgacgtgcacccggccacgtggcgggtgttctcgggctgcgcactgaggcgcgtcgtgctcacggtctcgcccaggatcatggccgagccgttcctctgggactgcctcggagccgactgcgtcgcgagctccgagctctgcaagtggcgcggccgctgctcatgaatggtggacagccgtcatggcgtcctcgtcggatgcagcaccgacgacgcgc

SEQ ID NO: 69266 - protein, 102 aa, Zea mays
  misc_feature: Ceres CLONE 1547127
  misc_feature: SWISSPROT Homolog: EC 2.3.1.15 Glycerol-3-phosphate O-acyltransferase
MEEAVEAVVAVGVEPFPTVDKCDASGRGAHAVVADLDCALLRSRSAFPYYALVGFEDGGVPRLLLLLLLAPLAAALLALASESACARVLVFADTVGARVRDI

SEQ ID NO: 69267 - DNA, 719 bp, Zea mays
  misc_feature: Ceres CLONE 1547129
  misc_feature: Encodes the peptide sequence at SEQ ID NO. 69268
  misc_feature (719)..(719): n is a, c, t, g, unknown, or other
ggagctccccgcggtggcggccgctctagaactagtggatcccccgggctgcaggaattcgtctcacccctagaaaaaaatccagcacaacttcctcatggctctctccccgagcactaacgacccacccttgcttgacgctcatctcgagctactggtcactgactgtgcttgcaccctatggctgggtcacagctccgcaggagacctagccatgggcgacgacgacaacgccaacgaggcggccccccccctgcaccaaatagatgacgcggacgagatcaacgcctacgagataccctgccagcataacatcatgaggccgctcctcttcccccgcctcctccgcaccacccggccctggccggactactgcgctgcgaagctcgtctatggactgccaccagattctcaactcatgtgagggggctcaacatgccatgtgctccactatcatggccctggtggtgcaccatgactacgagacggctttccctgacctcatgacaggggtgcaacgcgagcgcacaaacacgagcctgtttgagatgatctctcgctctgtgcctgcgacctgaatagacaaagccgaccttcggcgagctcttctgcacccgcatggtctgagacaacagactacgcacggagctcgctgtgatgcacgcggcgacatcctccgtgagctgagctccttgtcaacacaccagagcctcggagcn

SEQ ID NO: 69268 - protein, 69 aa, Zea mays
  misc_feature: Ceres CLONE 1547129
MGDDDNANEAAPPLHQIDDADEINAYEIPCQHNIMRPLLFPRLLRTTRPWPDYCAAKLVYGLPPDSQLM

SEQ ID NO: 69269 - DNA, 774 bp, Zea mays
  misc_feature: Ceres CLONE 1547145
  misc_feature: Encodes the peptide sequence at SEQ ID NO. 69270
attttatttttacaaaatcagtatatatacggaaatagtctctctaaatactggagctccaccgcggtggcggccgctctaaaactagtggatcccccgggctgcaggaattcgtctcacccctagaaaaaaatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctgagtatgtcgtggagtccaccggtgtcttcactgacaaggacaaggctgctgcacatctgaagggtggtgccaagaaagttgttatcttctgcccccaagcaaagatgcacccatgtttgttgttggtgtcaatgaggacaaaaacacctccgatgttaaactttgtttccaaggctagcttgcaccaaaaaatggccttggctcccccttgctaaaggtcatttcatgaacaacctttggcattaattgaaggggtttgaagaaaaactggtctaaggccaaccacg

SEQ ID NO: 69270 - protein, 165 aa, Zea mays
  misc_feature: Ceres CLONE 1547145
  misc_feature (4)..(155): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDITLKDSKTLLFGEKPVTVFGIRNPEEIPWGEAGAEYVVESTGVFTDKDKAAAHLKGGAKKVVIFCPQAKMHPCLLLVSMRTKTPPMLNFVSKASLHQKMALAPPC

SEQ ID NO: 69271 - DNA, 809 bp, Zea mays
  misc_feature: Ceres CLONE 1547153
  misc_feature: Encodes the peptide sequence at SEQ ID NO. 69272
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
ttttttgttttcccttcctacgccttannttaanngnnnnnnnccatagctggaactccccgcggtggcggccgctctattactactggatcccccgggctgcaggaattcgtctcacccctagaaaaagacgctcgcttctccaaatccccccttcgccttgcgagggggcggaggggaggtggtagtggtagggtatacaggagtgctctgcccatggagaaggcggggcaacaacgccatgttatcggcggcggcggcaagaaggcgcccgcgctggggctgcagaagcagaactcgtggtcgccggacatcgagcgcgacgaggcgtgggagcgccggcgcaggggcatgcgccgcgggggcacggcgctgcgccgcgcccgcagcgtcacggacgacgacctcgacgagctccgcggctgcatcgacctgggcttcggcttcgagccggcgcccgccaccgcgtgcgcctgcgcctgcgcctgcgccgggaggaaccgcctcctggagacgctgccggcgctcgacctctactacgccgtccacggcgggccggcggaggggccgccgtgctcgtgcggcgccgcgtcggaagcgtcctcctccgaggagtcgcccgctcggcagcccccatggccatactcttctccaggcgacacgcctggaaaacggcgaaaaatgcgggcttgaaccagtggggcccaaggtggataggcgctggcccatgcctgaacccgcccatctgatcttcttccggggcccacggggccgcccccctttaccttttttccgcaatttggcgaatg

SEQ ID NO: 69272 - protein, 158 aa, Zea mays
  misc_feature: Ceres CLONE 1547153
  misc_feature (21)..(137): Pfam Name: DUF1685 Pfam Description: Protein of unknown function (DUF1685)
MEKAGQQRHVIGGGGKKAPALGLQKQNSWSPDIERDEAWERRRRGMRRGGTALRRARSVTDDDLDELRGCIDLGFGFEPAPATACACACACAGRNRLLETLPALDLYYAVHGGPAEGPPCSCGAASEASSSEESPARQPPWPYSSPGDTPGKRRKMRA

SEQ ID NO: 69273 - DNA, 880 bp, Zea mays
  misc_feature: Ceres CLONE 1547155
  misc_feature: Encodes the peptide sequence at SEQ ID NO. 69274
  misc_feature (37)..(37): n is a, c, t, g, unknown, or other
  misc_feature (42)..(42): n is a, c, t, g, unknown, or other
  misc_feature (837)..(837): n is a, c, t, g, unknown, or other
tggtaggggtggtgtgtgtggacccctaccatggggntgacnaaaaaacggaactcccctcggtggcggccgcctctaccctagtggatcccccgggctgcaggagttcgtctcacccctagaaaaaaccaagaacaaaccattgttggacgcgttcccctcctgcacgcaacctcatctcgtcctccagatccaggatggccgtcctccttgagaccttgcctccccgagtgctctcggggagctactttgttccgatttatcacgaaatccgttcgctccgtgtggggcagggccacatctgactgctcgattcggccgacccgcgttggatcttggtattggctagatccttgggctccgctggcgcgcgccgtcgaatcttgggaggggagaaataacaaataggacccacaagagcgggagccgggggaaactaggcagtcccctttatatgtgccccacctcactggcaaccgaggggcgagagcgcgacggagcgcgcttcgagagcaccggcgccagggcgtggctagcgcggctccagagcacggggagaatcgtccctgaggcgttagatggcgcgggttgtgaattgaccggtggcagaaacataaatagaatccgcggatcggacgtcgatctccccgcggccctgaacccgggaaggtaaacggtggcagacagtgtaggggaagcgggaatttcgagctgctccccttttggtctcttggtcagaggggacctcgtctaaggggtgcgggccccagccgcgcagccgatcgaccccgttgggcgtgactaaatatcaaatgtataccagtaccctccgcctcntgagaggtaggccgccctctaggtggacgagtcattgcactgg

SEQ ID NO: 69274 - protein, 35 aa, Zea mays
  misc_feature: Ceres CLONE 1547155
MAVLLETLPPRVLSGSYFVPIYHEIRSLRVGQGHI

SEQ ID NO: 69275 - DNA, 708 bp, Zea mays
  misc_feature: Ceres CLONE 1547156
  misc_feature: Encodes the peptide sequence at SEQ ID NO. 69276
aaagctggagctccccgcggtggcggccgctttacactagtggatcccccgggctgcatttattcgtctcacccctagaaaaaatcgccccttgaaccctagatcccgcaactgccgccgccactcccacgcccgcagccatgccgaccaagctcgaaccgtcccaggtggtggatgtgttcatccgtgtgactggcggcgacgtctgcgcactcttgtctctggccccccagatttgtccgctcagtctttccccccacaacatctcagagaacatcgtccaggagactgccaacgactggaagggcctccgcgtcaccgtcaagctcaccgacctgaaccggcaagccaacgtctccatcctcccctccgccgcggcgctcatcatcatagcgctccacgagcccgacagggaccgcaagaaagtcctgaacatcatgcacagccgcaacatcaacctcgaccacgtcctcgacatcaccctgaccatgaggcacaggtccatggccaatgaattggccagcacctgccaagacatcctccgtacctgcgtcagcatccggtgcaccatccacagcccggaccccaaggacctgcaacaggagattgacgaccgcgacgtgaacatcccgtccacttaagaaggattggtgtcccggactgtgttatctttgctgatgaagccctttactctgcctcgattttctc

SEQ ID NO: 69276 - protein, 166 aa, Zea mays
  misc_feature: Ceres CLONE 1547156
  misc_feature (76)..(144): Pfam Name: Ribosomal_L11 Pfam Description: Ribosomal protein L11, RNA binding domain
  misc_feature (12)..(71): Pfam Name: Ribosomal_L11_N Pfam Description: Ribosomal protein L11, N-terminal domain
MPTKLEPSQVVDVFIRVTGGDVCALLSLAPQICPLSLSPHNISENIVQETANDWKGLRVTVKLTDLNRQANVSILPSAAALIIIALHEPDRDRKKVLNIMHSRNINLDHVLDITLTMRHRSMANELASTCQDILRTCVSIRCTIHSPDPKDLQQEIDDRDVNIPST

SEQ ID NO: 69277 - DNA, 876 bp, Zea mays
  misc_feature: Ceres CLONE 1547165
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
gggtttggtgtcatactacctctggttcccccnnnagaaccnnnaaaaaaactggactccaccgcggtgggggccgctctagaactagtggatcccccgggctgcaggaattcgtctcacccctagaaaaaagagcatttctcgctgcttctttctcttcaagacaacgtcaaaaaaacgtcagcaccaggctcctccctctaataaatagcggcgggcctctgtcagctcacagctcagtcctcttcaaccccgtttcgccgcccctagcccaaatcccccacctactcgccgccggcgccgtctcagcctcatgcttctccgctagtcatgggccccgcggggactcgggctctactcccgatatcgggaagaagggccgacatcccctactacaaggctatctccccccaccccaggggggggggggggcaccctatgcctgccaatataaattgcccaccccgggggggcgagctctgaggaacggactggaggttatctgtcaataggagatctcagacgcgcacccatgatgggtgcatagacggggcgcccgcgggtgctgcgccatggtttgtgctccggcaaggtggctatgggcgcgacccccgtggtagcgcatgcctccagaactactccgggatgctcggtcggggttgggccggggccctgtctcttggcgatcaggaggctctcgggtcgcgcgacattgtgtgtggtggtgcctacagggcagttgtctggtggcccgctctctccctatcacggatggcggcgggggagcggactggtcagagaagcagtggttccgtgatggtgtgagaaccattctatttgaccgatatctgccgtgtaactgtagcatcgcttgtg

SEQ ID NO: 69278 - DNA, 736 bp, Zea mays
  misc_feature: Ceres CLONE 1547167
  misc_feature: Encodes the peptide sequence at SEQ ID NO. 69279
cccccgggctgcaggaattcgtctcacccctagaaaaacctccctaaagatcttctcctcttcatctcctctccctagcctcttctacgcatgggagactgacctatagcgacgcgtggctagcgatgagggatcatcgtccaagagggataagcacctcaccccgtccctgtggtcctccttcccgcatgggatcatcaccatgctcacgagattgagtaagcccacgggggcattctccacttcctcctgctactgccccgatgttatcaagtacctcggcccccttacccgcgagaccacgcattactttctcagcttattcccccgctactacaggtgccacgcctcgagactttccacaaactggatgacccccccctggatgtataagctgtgaagcatgcccgccctcagggtcatgagcagcagtctgatggctgcacattacccctactttcttgacaaacccgatactgctcgtgtagacttgctatattcaggccgggctgcggatcgtttccccatgggggggtggaaatacatttggggttccccttgcacgatccgggaggagtaccatcctttgatcaccgggggccctggcaagaaacgttttttatgcggaacactgccttatccgctaccaaaaattgccaacggggggtccgtctccagcccacagtacgtaaaggccaaccttgttaacctggggctgtaggggtctttcacctat

SEQ ID NO: 69279 - protein, 105 aa, Zea mays
  misc_feature: Ceres CLONE 1547167
MPALRVMSSSLMAAHYPYFLDKPDTARVDLLYSGRAADRFPMGGWKYIWGSPCTIREEYHPLITGGPGKKRFLCGTLPYPLPKIANGGSVSSPQYVKANLVNLGL

SEQ ID NO: 69280 - DNA, 711 bp, Zea mays
  misc_feature: Ceres CLONE 1547170
  misc_feature: Encodes the peptide sequence at SEQ ID NO. 69281
tgtggatcccccgggctgcaggaattcgtctcacccctagaaaaaagagccatgcgagactggaggcggaaccgcgcacgacaccaagctgccgcgccggactgctgcacgcaagcgcagcgcaggaccgaccgacctccgtaggcacgcacggcgccggcggcatggcggagcacctcctgtcgacggccgtgcacgacacgctgccggggagctacgtgcggccggagccggagcgcccgcgcctcgcggaggtcgtgaccggcgcgcgcatccccgtcgtggacctgggcagccccgaccgcggcgcggtcgtggccgccgtcggcgacgcctgccgctcgcacggcttcttccaggtcgtcaaccaccggatacacgccgccctggtctcggcggtgatggccgcggggcgcggcttcttccggctgccccccgaggagaaggccaagctctactccgacgaccccgccaggaagatccggctgtccaccagcttcaacgtgcgcaaggaaacggtgcacaaactggcgcgactaccttccgcctgcactgccatccccttcgaaaaagttctggcccgatttggccttccaaccccccccgatttctagggagaaccatggggccacctacttgctaggtagggcccgggagccctcgggtttccgggctgttacgccccccgatctctgcaatagccctggggcc

SEQ ID NO: 69281 - protein, 149 aa, Zea mays
  misc_feature: Ceres CLONE 1547170
  misc_feature: SWISSPROT Homolog: EC 1.14.11.9 Flavanone 3-dioxygenase
MAEHLLSTAVHDTLPGSYVRPEPERPRLAEVVTGARIPVVDLGSPDRGAVVAAVGDACRSHGFFQVVNHRIHAALVSAVMAAGRGFFRLPPEEKAKLYSDDPARKIRLSTSFNVRKETVHKLARLPSACTAIPFEKVLARFGLPTPPDF

SEQ ID NO: 69282 - DNA, 696 bp, Zea mays
  misc_feature: Ceres CLONE 1547171
  misc_feature: Encodes the peptide sequence at SEQ ID NO. 69283
gctctataactagtggatcccccgggctgcaggaattcgtctcacccctagaaaaaccattcccttcgtgcttgtttgctctagggtttttgccaccccgccgccgctctgccccttccaccccaccgattttcccagatgaccgcccacgctgcggaggagctcgccgcccacatcgagcagcctatgctcgacgagcaaactaccgacgcagaagaggttgtggtggaggaggatgacgaggatgatgaggatgacgatgatgatgaccaggatgatgatgaactggatggacaagaaggggatgggagtggcaagtcgaagcaaagcacgagtgagaagaagagccgcaaggccatgctgaagcttggcatgaagcccatcactggtgtcagccgggtcactgtgaagaaaagcaagaatatgctttttgtcatctcaaagccagatgtgttcaagagcccatactcggacacctatgtcatattcggcgaggcgaagatcgaggacctcagctcccagctgcagacccaagctgcagagcagttcaaggctcctgacctgagccagatgatcccgaagcctgagacatctgtgctgggcctggacgacaacgaggaagaggaggttgacgaaactggtgtcgaggccaaggatgtcgagctggtgatgactcaggcatctgtttcgaggccg

SEQ ID NO: 69283 - protein, 186 aa, Zea mays
  misc_feature: Ceres CLONE 1547171
  misc_feature (65)..(124): Pfam Name: NAC Pfam Description: NAC domain
MTAHAAEELAAHIEQPMLDEQTTDAEEVVVEEDDEDDEDDDDDDQDDDELDGQEGDGSGKSKQSTSEKKSRKAMLKLGMKPITGVSRVTVKKSKNMLFVISKPDVFKSPYSDTYVIFGEAKIEDLSSQLQTQAAEQFKAPDLSQMIPKPETSVLGLDDNEEEEVDETGVEAKDVELVMTQASVSRP

SEQ ID NO: 69284 - DNA, 817 bp, Zea mays
  misc_feature: Ceres CLONE 1547172
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
gaggggggggtcatattagtgagtttatccctcataatttcttccggcaagaaaaaattnnnnttatagctgggactccccgcggtggcggccgctctagaatagtggatcccccgggctgcaggaattcgtctcacccctagaaaaaaattccgcgagaccgcgactgcttctccatccttccacgaactagacgagggaagagcgctgaagcctgaagctgtggaggaaaacgaaggatctccccgtgcttgtgtatggccagtcgcctgctctccgtccgcatcccgtcccttcgggaactcggggctcccgggtgtggcaaaatcatgggttttcggacaccgtggccaagaaaactcccccccaaattcgatgtgaggcccccgaaaacacacaaatgggcccccctttgggggggcttttgttgcgcggaaaaaaaaaacccccctaaaaaaaccctttgtggggcaaaaagcggggggcaaaaattttttatttttttagggggcccccctgggggggcccccccctttttttttaaaccacccccttggggcccccccatagagagggggcggcgccccgaaaaaaatttcttttttttttttttctaggggggagaaatatttttgtggctccctcctccatacacaaaaagggggtgcggggggtttttttcttctccccccggggggggggaagaataattttttgttcttgtggagcgcccccgccgcttgggtgatgatataaaaaaaaaatacatatcagcgtgcgcggtttcggctgatggggagagtgtcattacaaatgt

SEQ ID NO: 69285 - DNA, 783 bp, Zea mays
  misc_feature: Ceres CLONE 1547183
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
ttttnnnnttttttttttttttttttggggggggnnnannnanaacaaactggagctcccgcggtggcggccgctctttactagtggatcccccgggctgcaggaattcgtctcacccctagaaaaaggctctcaagccaccatcccccttctagtctcgatgcacaccattgccctttagaaagcgtcgcgatggcatacagcaccatggtgtctctcctccactggccttctccggcaagggcgtgaacgtgccggcagcctccgccttcggcgaggcccgcgtgacgatgcacaagacgctacggcaatcgccaagcctgcggcggcgtccaggagcccgtggtacggccccgaccgcgagctgtacctgggcccaatgttcggggtagccgccgagctacctgatgggatgagtttgcgggcgactacggactgggacaccgttggggctgtcggcggaccctgacacgttcgtcgataacctttagcttggaggtgatccacttccggctgggtcatgctggtcgcgctttgctgcgtcttcccttatctgctcttccgctctttcgtgcatttcgcggaaggccgtgtgcgtgcatggccgtttccctgatcttcaacccaccgtggtactggtactacttcgggaaaccctaaccctcatccactgtctattagtattcttcgctcatcttggctcttgccaaggtctttgcttaattgtgcttccggctggaggccttcccccattttcccgtgtgggcccccctctggccaggt

SEQ ID NO: 69286 - DNA, 835 bp, Zea mays
  misc_feature: Ceres CLONE 1547187
  misc_feature: Translation starting site: 200
  misc_feature: SWISSPROT Homolog: EC 2.5.1.18 Glutathione transferase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (16)..(16): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (392)..(392): n is a, c, t, g, unknown, or other
  misc_feature (463)..(463): n is a, c, t, g, unknown, or other
nnnnnccccccccccnaaannnncctcttnttttnnnggtggatctnnnntcactactggagctccccgcggtggcggccgctctagaactagtggatcccccgggctgcaggaattcgtctcacccctagaaaaaaaaaagagcagattttagcagagcagcgagggtcggagaagcctccccaagcttcgaatcgctatgcagcccgtcaaggtgtacgccgaccggcggtcgcaaccctcccgagctgtcatcatcttctgcagggtgaaccagatcgatttcgaggaggtcacggtggatctgttcaagtctcagcacctcacacccgaattcaaaaaattaaacccaatggggacaggtacctgcccattgttgatggaagattcanactattgggaaaggcatgcgattttgggtgttcttccccccccccccccggggggggggggggaccccctnttattccttcctcacctgctcccccccaggcaatatttgagtcaatccccggagcgggccctcccggcgacattttacttacttccggccccccagccctttggtccggcacccccgccgtgcggctccccatccctgaggctccacgacccggtacaggagggtgtggcaaaacgaccgcgatggatggtgggtttatggccgcccccgggcgggctgcctcccggcgggggttggggctggaagcgggcacgggcctgggttgctgggcggagtgtgtgtttcgtggtgatcgtccaaaagcgtgatttgcataaccctcgcctctggggcgaggagaaggtggggggggggaggcgcccccggtgcgtg

SEQ ID NO: 69287 - DNA, 915 bp, Zea mays
  misc_feature: Ceres CLONE 1547193
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (31)..(31): n is a, c, t, g, unknown, or other
cggccccgnnnncnnnnnnnnncccgcgcgncgacaccaacacaccccaatactggagctccccgcggcggcggccgctctattactagtggatcccccgggctgcaggaattcgtctcacccctagaaaaagtgagctctcagctggttgctgccgccaggattggaggagtgcgcgcgcgcgcgagtgagccatcactgagctgtggacgtgaattgcgatcatccgttctcgctttctggggctcggctgctgcggtcatggcgccgccgccgccgccgttacagctgcggtgttagaaattgattccaaaacaagtcttaccccacgatcccgccttcccctctcgctttttcttcctttttctccccgtcactcctttttccttcctccctagctgttcttcctgtgtcgctgtcctgtcctgtgtgtttggtgtgttgtggccgtgtttatcgtgttgctttaccccctcccctatctttacctcacattatctatattcctaaatctctactccccgcttattacccgtcttgtttttttcccctattcctcctcccattttaattttccccgtgctacagctctccccgtttgcgcccccgcttctctccccttccctccccctcttcccaccttactcatcctctcttttttcgccgtcttatatataccactttacttgcctcatcttaccctttcttcttaatatatacatgggagtgtccctcgcgggtaattatcggtggaaaagacgctgagtggtctttagtgagtttgtaagtggctttaaattaatactaagaaagaagcaatattatcttaatgtaatgttgtttattcgatctttgttgttcttcccttcttaccctgtatttatcctgatcccggccgctttaacacattgaccg

SEQ ID NO: 69288 - DNA, 754 bp, Zea mays
  misc_feature: Ceres CLONE 1547203
  misc_feature: Encodes the peptide sequence at SEQ ID NO. 69289
  misc_feature (13)..(13): n is a, c, t, g, unknown, or other
  misc_feature (14)..(14): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
ttttttttccggnnccgnnnccggcggnnncancacacaacaaccggcaagctggagctccacgcggtggcggccgctctagactagtggatcccccgggctgcaggaattcgtctcacccctagaaaaaaaaagccctcggaccctccttccccccactaccagaagtccagaactcctcacctcacttcagcctcaacgcctaccaaacttacgcagcctctccataactgcgagctgttgctcctcctcccgagctaccattctccgtcgatctcctccaggctgtagcgcgctgccacgcccgcccatggcctcgggctcgaaaccggacagcgtggagaccgaccatcctggcggcggcctctccatcgccgtcgagcacaacccaccggagtcgcgcctgcatcagctcggcgtcaggtcctggcccaagtggggttgcccgccggggaagttcccggtgaacttcgacgcgcggcagacgtgctacctgctcaagggcaaggtgcgggcgcacatcaaggggtcgtcggagtgcgtggagttcggcgccggcgacctcgtcgtcttccccaagggtctcagctgcacctgggacgtcgccgccgccgtcgacaagtactacaagttcgactcgtcctgacgggtgacgcacatcgctcccggcccggctccgctgatttggtcccgattatgggttcggctgcccgcttaattgggaggaatagctcagtttccagataatttgggg

SEQ ID NO: 69289 - protein, 111 aa, Zea mays
  misc_feature: Ceres CLONE 1547203
  misc_feature (32)..(106): Pfam Name: Cupin_3 Pfam Description: Protein of unknown function (DUF861)
MASGSKPDSVETDHPGGGLSIAVEHNPPESRLHQLGVRSWPKWGCPPGKFPVNFDARQTCYLLKGKVRAHIKGSSECVEFGAGDLVVFPKGLSCTWDVAAAVDKYYKFDSS

SEQ ID NO: 69290 - DNA, 757 bp, Zea mays
  misc_feature: Ceres CLONE 1547206
  misc_feature (28)..(28): n is a, c, t, g, unknown, or other
  misc_feature (334)..(334): n is a, c, t, g, unknown, or other
  misc_feature (360)..(360): n is a, c, t, g, unknown, or other
  misc_feature (426)..(426): n is a, c, t, g, unknown, or other
  misc_feature (427)..(427): n is a, c, t, g, unknown, or other
  misc_feature (516)..(516): n is a, c, t, g, unknown, or other
  misc_feature (553)..(553): n is a, c, t, g, unknown, or other
  misc_feature (594)..(594): n is a, c, t, g, unknown, or other
  misc_feature (665)..(665): n is a, c, t, g, unknown, or other
  misc_feature (703)..(703): n is a, c, t, g, unknown, or other
ccgcctgccgggccgcgcgcgccgcccnaattttttttattctcctctccctaacctgaaccgccccccgcggcgcccgcctcttctgtagtgggtccaccgggctgcccgaacttctctcccccctataaaaaaagaggtgagcagaaggatgaaggaccgatgatggaaacagagaacatggcgacgaatcgcgacaccgagtcggacggcgaaggctccaaccccgtcggtggtggcgcgactccgccgcccctagccgccgcccctgtcgtatgcctcctccgctccgccggggacttcggtggcggcgccttcgttggatccatcttcntatatggacaacgcttgatcaccaanaagggttttaagggctcattcagcaatgccggctcctctgccaagacttttgcaattctctctggnnttccgactttgcttctgtgcttgctgcctcggctacctgccctcgatgacattgtcaatgctgctatccctggctcgtgcactcgcccncctctgggcgtcccaccgtccccccacgcatcgctcnaaggctgtgccccctctcctgccttctcccgtctcacgcangggctcctttaccctccggctcccgcggctcctacgccctgtagggattgcttcgcatggcccccgcatgnacaatgtgccggttccgcccccccttcaccctaccacntaattcttaatgcacctgatcgctctaacctcttggctcccctctcatgactaa

SEQ ID NO: 69291 - DNA, 667 bp, Zea mays
  misc_feature: Ceres CLONE 1547212
  misc_feature: Encodes the peptide sequence at SEQ ID NO. 69292
ggatcccccgggctgcaggaattcgtctcacccctagaaaaaagttcagcacagcacatcttcctcgcagcgccggtgctccatcttcggctccctcccccaccttcgatcgtgacgcaggctcggcgtcgtcgtcaggggttcctcctcccgcctctcgccagtagcctcgcgccctcgccgactggcgaccctgccttgaaggggctggcaagatgatcggcgtaaggaaggcgaagcagtacgccaacgtccttgacaagcccctcagccgtggcaggcaggaggtcagtttgagtgcatttgcattcttgttctctgagttggttcagtacaaccagactcaagttgacaacattactgagctggaacggaggctggaggatgctggttatgctgttggtgcgagggtgcttgaactactctgtcacagggagaagggaaatagacgagagacacgacttctgggcattttatcattcatccacagtactgttaggaaagtgttgtttgcaagagtggctgactcccttgaaaaggggaacgaacacgaggatgaatacttgatcagtgaaaaggagcttcttgttaaccgtttcatttctgtgccaaagacatggtagctttcatctgtggagcttttgttgcgggaattgaaaagggggaa

SEQ ID NO: 69292 - protein, 135 aa, Zea mays
  misc_feature: Ceres CLONE 1547212
  misc_feature (29)..(136): Pfam Name: TRAPP_Bet3 Pfam Description: Transport protein particle (TRAPP) component, Bet3
MIGVRKAKQYANVLDKPLSRGRQEVSLSAFAFLFSELVQYNQTQVDNITELERRLEDAGYAVGARVLELLCHREKGNRRETRLLGILSFIHSTVRKVLFARVADSLEKGNEHEDEYLISEKELLVNRFISVPKTW

SEQ ID NO: 69293 - DNA, 798 bp, Zea mays
  misc_feature: Ceres CLONE 1547226
  misc_feature: Translation starting site: 240
  misc_feature: SWISSPROT Homolog: EC 3.2.1.23 Beta-galactosidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
nnnnnnnnnnnnnnnnnnnnnnnaaaannnnnnnnccggtgttnnnnccaaactggagctccccgcggtggcggccgctctagaactagtggatcccccgggctgcaggaattcgtctcacccctagaaaaatctgctgctgtttgtgtttgtctaaaagtcggcaaatgcaccttgtagattgagcgtccgaggtggtagagactttgctgccgcgacaaggaccccaaaggtatggtatgtatagagtcgcccatcagacagcaatcggatcagtgtgtaacagcttaaataaaaaaaaaaaatcgagacgctcgaggtacccaattcgccctatagtgagtcgtattacgcgcgctcactggccgtcgttttacaacgtcgtgactgggaaaaccctggcgttacccaacttaatcgccttggatcacatccccctttcgccagctggcgtaatacctaataggcccgcaccgatcgccctttccacagtttgcgagccctgattgggaatgggaattgcacgcgttgatattttgttaaaattccggttaatttttggtaaattccgcctcatttttttaacctaaaaggcccgaattctgaaaaatccccttaaaaaaaaacaaggaaaaaacccgcagatagggcttgagtgtttggtccccattttgggatacaaaagttctccctttttaaggaacaaggggacttccatcgctccaaaggggctgtataaaacccctcctcttccaggaggggaagagaccccaccttggtgggaaagcgttttgtccg

SEQ ID NO: 69294 - DNA, 808 bp, Zea mays
  misc_feature: Ceres CLONE 1547241
  misc_feature: Encodes the peptide sequence at SEQ ID NO. 69295
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
nnnnnnnnnnnnnnnnnnnnnnnnnnnnaatccccnnnncttcaaactggagctccccgcggtggcggccgctctagaactagtggatcccccgggctgcaggaattcgtctcacccctagaaaaacacatgattggattaacgagattcccactgtccctgtctactatccagcgaacccacagccaagggaacgggcttggtggaatcggcggggaaagaagaccctgttgagcttgactctagtccgactttgtgaaatgacttgagaggtgtaggataagtgggagcctccgggcgcaagtgaaataccactactttcaccgtgatttcacttattccgagggtcggaagcggggcaccgcccctccttttggctccaaggcccggcctcgccgggccgatccgggcggaagacattgtcaggtggggagtttggctggcgcggcccatctgttaaaagataacgcaggtgtcctcacatgacctccaccacaacagaaatctcgtgtggaatagaaaatggaaataaaccgagacgctcgaggtacccaattcgccctatagtgattcgtattaccgcgcgctcactggccgtcgtttttacaactcctgtgaatggggaaaaccctgggcgttaccccaccttaatccccgttggaaacagattccccccttttctcccagcctggccgtatttttcgtaaaaagggcccgctacctattttcccccttccccaaacaaaattacccccagcccctgaaatgggccaaaagggcaacatttgtgaggccgcgttattatctt

SEQ ID NO: 69295 - protein, 34 aa, Zea mays
  misc_feature: Ceres CLONE 1547241
MIGLTRFPLSLSTIQRTHSQGNGLGGIGGERRPC

SEQ ID NO: 69296 - DNA, 729 bp, Zea mays
  misc_feature: Ceres CLONE 1547246
  misc_feature: Translation starting site: 125
  misc_feature: SWISSPROT Homolog: EC 3.2.1.23 Beta-galactosidase
  misc_feature (406)..(406): n is a, c, t, g, unknown, or other
  misc_feature (420)..(420): n is a, c, t, g, unknown, or other
  misc_feature (422)..(422): n is a, c, t, g, unknown, or other
aaagctggagctccccgcggtggcggccgctctagaactagtggatcccccgggctgcaggaattcgtctcacccctagaaaaagtacatttaggcttccattgttccatcaactagtagctacatgtcctcctactctcctagtaaagtaccagtgtttgtttgtgtaatgtttgttacgcccattaaattcttcttggattggatgaactacaagcaaagacattccctggatgcagtacaatgataacagcagccagtaggcaaacacattccagatggaagcaaagagattatttgccttttccataatgtactactaccaactagccatacataaacaacaaaaaaaaaagaaaaaaaaaaaaaaaaacgagacgctcgaggtacccagttcgccctatantgagtcctattacncnccctcactggccgtcgttttacaacgtcgtgactgggaaaaccctggcgttacccaacttaatcgccttgcagcacatccccctttccccagctggcgtaataacgaaaaggcccccacccaattcgccttcccaaaagttggggcaacccgaatgggcgaatggaaattttaagccttaaaattttgttaaaaattcccgtttaaatttttggtaaataaagctcattttttttaacccaatagggccgaaaatcggtaaaaatccccttcttatattaaaaaaaaaatacacccaaaataggggc

SEQ ID NO: 69297 - DNA, 866 bp, Zea mays
  misc_feature: Ceres CLONE 1547248
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (702)..(702): n is a, c, t, g, unknown, or other
nnnnnnnnnnnnnnnnnnnaaaaaacccccnnnnnnnnnnggaannnnnnaaataaagagatccccgcggtggcgggcgctctagaactagtggatcccccgggctgcaggaattcgtctcacccctagaaaaagcgaccccaggtcagtcgggactacccgctgagtttaagcatataaataagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgaaagcccccgtccggcccggaccctgtctgaatctttaggtgccgtcaacggagtcggggttgtttggggaatggtttttttttttccccccccctaagggggggggagaaggggggggggtatttttttccctcttctcctccccgccccccccggtggctgccgaaaaaaacaccctttatccgcacctcaagattgacggggggggggtgccacggggaccccatcctctccttttttacctcgggcgcgggggcgtagggttgaaagatgggcgtggctcgttgtgtgtgtggtggtggcggccggcgctatgtttgtagaggggatgcccccgcggatttgcttcggctctggggntatgggagggtgggtgagagtgatgtgtcggcggcctcggctctggataattagaaggggggtggtggagggggttgttatgtttgtgtaggtatatttggttaccttcctttagtatcttttgtgtggttcttttccaggtgcgggaggttagggtggggtgc

SEQ ID NO: 69298 - DNA, 877 bp, Zea mays
  misc_feature: Ceres CLONE 1547252
  misc_feature: Encodes the peptide sequence at SEQ ID NO. 69299
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (22)..(22): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
nnnnnnnnnnnnttgggttttntttttnnnnngttaaannnnnnnaaaactggagctccccgcggtggcggccgctctagactcctggatcccccgggctgcaggaattcgtctcacccctagaaaaatctccgcatttccatcttcccgtgggatcccagccgccgccgcaagaagaagagctcggggacttccaggtgtcgcgagaagatgccgaagcagatccacgagatccaggatttccttctccccgcgaggaggaaggatgcccgatcagtgaatatcaagaggagcaaggatgttgtcaagttcaaggtccgctgttccaaggacctgcacacccctttgcggattcgacagctgacaacgccgactcctttttatccactctctcccccccgggctggagacgcccagtgtttttttcctccgcttaccggggggggggggggggggggagcctcccacttaccatcctctttccacccccccagaacctggctgccttcatgacgtcttgcgggccggtaaaaatagtggggggggggtcgcgggccgaacacaccacgcgcacccccgtgtcggcttggctaaattcccccgactggccgccgcctcgggggcagcgccgttgcacggggaagagaacccccacctcgcgtgaatgggcgccgaaaaaacccaccaaaaacagagaaggagaaaagcggcgaagaacacataataagtctctctttcttcctcatcgcccttatgtggggtggagctaaagggagtgagatttgcggcgacccacgagtaggcggtgtagcctccccctccccccccccagtcacgccgctgcctcccaacctccgacgccggccaccacaccccc

SEQ ID NO: 69299 - protein, 100 aa, Zea mays
  misc_feature: Ceres CLONE 1547252
  misc_feature (2)..(51): Pfam Name: Ribosomal_L38e Pfam Description: Ribosomal L38e protein family
MPKQIHEIQDFLLPARRKDARSVNIKRSKDVVKFKVRCSKDLHTPLRIRQLTTPTPFYPLSPPRAGDAQCFFPPLTGGGGGGGASHLPSSFHPPRTWLPS

SEQ ID NO: 69300 - DNA, 631 bp, Zea mays
  misc_feature: Ceres CLONE 1547253
  misc_feature: Encodes the peptide sequence at SEQ ID NO. 69301
aaagctggagctccccgcggtggcggccgctctagaactagtggatcccccgggctgcaggaattcgtctcacccctagaaaaaacctgccctcctgccttcgtcctgcccggcgcctctgccctcctccgggctccacagagtgaaaaagtctcctcttttcctcttcctctcccgttgccaggcatggggttggcctagttgtgcccgttgagcactagcagcctccttgaaacctccagatctgtgcctccaaggcccccgttcctcggcaacaagccgtccagatggacaccgccgcgcccctgcaactgaaagcctgcgccggcgacgccgcggagaagctgctgctcgccgtcgcagccgaaggtcctatctgtggtgtgccagacttcaagatgaggggaaagaaaagtgatgagctcgaacctgtcgatgctggcgatgaagatgatgatggtggtgacgatggggggcaagaatggtgactttggggaaggaggttgaagaggactgcccctaaaggggagggatatgacaacctcaaggggcgatgaggaccagtaaacgcacgaggtggaccctgcaggaaaactggggcaggataaattcaaggaaaaaaccaggaaaa

SEQ ID NO: 69301 - protein, 66 aa, Zea mays
  misc_feature: Ceres CLONE 1547253
MDTAAPLQLKACAGDAAEKLLLAVAAEGPICGVPDFKMRGKKSDELEPVDAGDEDDDGGDDGGQEW

SEQ ID NO: 69302 - DNA, 747 bp, Zea mays
  misc_feature: Ceres CLONE 1547260
  misc_feature: Encodes the peptide sequence at SEQ ID NO. 69303
agagctggagctccccgcggtggcggccgctctagaactagtggatcccccgggctgcaggaattcgtctcacccctagaaaaaccgcgccggcacccgcgcccgggccggccaaggccaagaccaagaagaagaagaagtccgccgccatcgccgagccgcccacggccgacgacgacgacaccggctccacttccgacgaccagaaggctgccgccgcgccgccacgcgccagtagggcggccgccgcgctctccgtgctcggcgccgctgttctcgtcggcggcctcttctgatgggaagaggatcggatcggacgcagatagaatgtatgctccgtccttcagaccaagatcacaccgcgtgtgtgcgttccccccccccgcggggggggggggggggctacgtccttgggggaattttctcttctctctctccctcgtctcgaaaggaattgtatttggggcctaggggggggggcccctccccgcgcgcttgttccctcctttcggaagagaaaaataatcaggcggatccgctctaaggttccccatttcgccccttttggggagttgtttttgggggggggctgggggggcgggtgggtttacacggacccgcggcgggggggaaaccccgccgtctccccccccttgcccgccggggggcggcgggcgcccgtctggccggcgcggcgggctcaagcggggggcggccccgtcgaggggaccctacccccagtgtggg

SEQ ID NO: 69303 - protein, 47 aa, Zea mays
  misc_feature: Ceres CLONE 1547260
MYAPSFRPRSHRVCAFPPPAGGGGGLRPWGNFLFSLSLVSKGIVFGA

SEQ ID NO: 69304 - DNA, 857 bp, Zea mays
  misc_feature: Ceres CLONE 1547261
  misc_feature: Encodes the peptide sequence at SEQ ID NO. 69305
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (16)..(16): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (607)..(607): n is a, c, t, g, unknown, or other
  misc_feature (746)..(746): n is a, c, t, g, unknown, or other
nggggnnnnnnggggnggggggggggggnnnnnngcttgagtaannnnnnaaaatcggtgctccccgcggtggcggccgctctagaactagtggatcccccgggctgcaggaattcgtctcacccctagaaaaaaagaaaatttgattaatgctacttctattagtttggaacaattagaaaagtctaaaaacgaaaccctttattttgaaaaacaaagggcgatgaatctggtccgacaacgggttttccaacaagctgtacaaggagctctaggaactctgaataggtgtttgaataccgagttacgtttccgtgacgattcgtggctaatatttggcattcttcgggccctaggaagggaagagaacattccattaattaggtcttggaacatctttcttttgtttagtttttaaggcgttttttttcccccttgcttgttgaaggaggggggaggagaaacttaatttccttccgcttccccacactttccccctaagatggtgtcataaatttgttgcgctctcattgggctggtcttttttgcggagtgaaaaggaaatggaatgaaaacttttggttagcgttccacaacctaaagaatntgtgggtctgtggaaaggagcgcctattgcggtggatgggcgcgcgtgtgccgcgctgtcgagggtccggtgtgccggaggtttgccattcccgtcgatatctgtctggaaatgaccttaaatggccgacgtccggttnagagtaatcgacgccgtatttatcggttgctatctaaaactatacgctcacacgcgctctttcattgatactaatgccgccgctggcggcgcggtcgcgccgaaggcgggg

SEQ ID NO: 69305 - protein, 64 aa, Zea mays
  misc_feature: Ceres CLONE 1547261
  misc_feature: SWISSPROT Homolog: EC 3.6.3.14 H(+)-transporting two-sector ATPase
MNLVRQRVFQQAVQGALGTLNRCLNTELRFRDDSWLIFGILRALGREENIPLIRSWNIFLLFSF

SEQ ID NO: 69306 - DNA, 790 bp, Zea mays
  misc_feature: Ceres CLONE 1547262
  misc_feature: Encodes the peptide sequence at SEQ ID NO. 69307
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (340)..(340): n is a, c, t, g, unknown, or other
  misc_feature (349)..(349): n is a, c, t, g, unknown, or other
  misc_feature (363)..(363): n is a, c, t, g, unknown, or other
  misc_feature (379)..(379): n is a, c, t, g, unknown, or other
  misc_feature (593)..(593): n is a, c, t, g, unknown, or other
  misc_feature (790)..(790): n is a, c, t, g, unknown, or other
aagctggagctccccgcggtggcggccgctctagaactagtggatcccccgggctgcaggaattcgtctcacccctagaaaaaatccgcggccacatcgcgaggaagaggatgcagaagaagggccctacccccaccatgggcaagacgccttcgctgagaggctacgtcgtcgatccggagctcggttccaacgagggctagaggtcgtgcttgttcttttgggtagcggaaaaaaaatagggtgtttctcccccccggctcttggtgttatattgtatatttaagatcaggggataaaaaaactggtatcacacgttttggaaccnnnnaaaaaaaanaaaaacaanggaggggggcggtnagaggttttttttttnccccccccacaggggggggggggggggggaggttgttatataccccttttcgcctttggtcccatatttaaatatccccaagtttccctgtcccgcgcggggatgggcgttgtctctgtccttgttatctcccttaggtgcgtgcgcccatatttgctgcgccgccccgcggcggcccgccctttttatgtcacataagatggggaggtgctancttgaggggaattgttctttttgtggtgtgtccgtatagttcggtgtctgttgtgaatgatgtgtggtgcttatgcagaagaagagtgcggttgttcgcgtgaagctacaaaattaatgcatatagatcggtttagatgggtatacggtaacattcttcctcagggtagttcgcagggggggtggactggtggtggn

SEQ ID NO: 69307 - protein, 66 aa, Zea mays
  misc_feature: Ceres CLONE 1547262
AGAPRGGGRSRTSGSPGLQEFVSPLEKIRGHIARKRMQKKGPTPTMGKTPSLRGYVVDPELGSNEG

SEQ ID NO: 69308 - DNA, 616 bp, Zea mays
  misc_feature: Ceres CLONE 1547271
  misc_feature: Encodes the peptide sequence at SEQ ID NO. 69309
tggagctccccgcggtggcggccgctctagaactagtggatcccccgggctgcaggaattcgtctcacccctagaaaaaatttcacctagtacccagtaaatggaggcgctcgtggtgcggcagctgggcgatcccaccctgccccctggcggtgaagcctccccgttcgccgcggtctctggggatcacccagtgccggagatctcatcgccgacggctgtccgagtgcgagtcgcggcgaccagcctcaacttcgccacgttcctccaggtgcagggcaagtaccaggagcggcccccgcttccgttcgtgcctggatccgactactctggcgtggtcgacgcagtcggtcccggcgtgcgtgggctccggcccggcgaccgcgtctgctcctttaccggcctcggttccttcgctgacttcatcgtcgccgaggagaagcagctgtacgtccctgaggtcaaaaggatcgaactctgcctcacccgaggtcctcctcacgagtattccaaaaactccgccttgctcgagcccgatctcggacagggcgtgagcttgggagaatgtccgcctcggccgaggagaagcagctatttttggtgcctgatggatgcg

SEQ ID NO: 69309 - protein, 172 aa, Zea mays
  misc_feature: Ceres CLONE 1547271
  misc_feature (38)..(119): Pfam Name: ADH_N Pfam Description: Alcohol dehydrogenase GroES-like domain
  misc_feature: SWISSPROT Homolog: EC 1.6.5.5 NADPH:quinone reductase
MEALVVRQLGDPTLPPGGEASPFAAVSGDHPVPEISSPTAVRVRVAATSLNFATFLQVQGKYQERPPLPFVPGSDYSGVVDAVGPGVRGLRPGDRVCSFTGLGSFADFIVAEEKQLYVPEVKRIELCLTRGPPHEYSKNSALLEPDLGQGVSLGECPPRPRRSSYFWCLMDA

SEQ ID NO: 69310 - DNA, 823 bp, Zea mays
  misc_feature: Ceres CLONE 1547273
  misc_feature: Encodes the peptide sequence at SEQ ID NO. 69311
  misc_feature (9)..(9): n is a, c, t, g, unknown, or other
  misc_feature (17)..(17): n is a, c, t, g, unknown, or other
  misc_feature (29)..(29): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
aggagaggnaatggttnagggtgactttnttnttnnnnggtccannnnnnnaaaacctggagctccccgcggtggcggccgctctagaactagtggatcccccgggctgcaggaattcgtctcacccctagaaaaaaacacacagtacgtacaagcctctcatcagcaatggagtccaccaagctctccgcgctgctggtgctcgccatgctcgcgctctccacgtccccactggctctagcgtgggagaaggcggaaccggagtgccactcgtgcgagtccggctccccaccctcgaccgggcggcgtccccctgcctcccgccagcatacccgtcgctcccgctgccccctggcagcataaccgtcagtccccctgccccctggtcaccaaaccgggcggtggcccccggacggtgggttaacccccccccctcccagggggcgggagggggggggggggcaaatccccgtatctcccatacataaaaacgcccccatccgtgaaaggggttgccccaagtggggtctcccaatactgcggtcacctatggtttcggacgaaaccggttcgcccctcaacgcactagctcccccgcaaccataccgcccccggatagggattaaatgttcgcactgctcgttgactctcatccctagggatacaataaaacaacaaactggggggtaataattacactctcaaagcctcgcgggccaatgatgggtcggccacccctcatcttcaacgggggtgtggcaaaacggagcgtgcgacggcaccgcggcaactaaaaaactagcgcgggcaactccccgcgcgg

SEQ ID NO: 69311 - protein, 64 aa, Zea mays
  misc_feature: Ceres CLONE 1547273
MESTKLSALLVLAMLALSTSPLALAWEKAEPECHSCESGSPPSTGRRPPASRQHTRRSRCPLAA

SEQ ID NO: 69312 - DNA, 661 bp, Zea mays
  misc_feature: Ceres CLONE 1547281
  misc_feature: Encodes the peptide sequence at SEQ ID NO. 69313
  misc_feature (338)..(338): n is a, c, t, g, unknown, or other
  misc_feature (661)..(661): n is a, c, t, g, unknown, or other
catttctcgtggatcccccgggctgcaggaattcctctcacccctagaaaaaaggtgctcgggtcggctgtgcctgtgtccccccgaaaatggcctcgtccccgctcttcacctcgctccggctgcccgtgcccaccagtctaccgcgctgtgcttctccgccgcacggcgtgccctcggcggacgacgccgtccctcggccggcgcctctcgtggaggccgctagccacaggagggagctggtggtaggggcggcgctgaccgcggtgctgttgccaagggcgccgctgctggcccaggcgcgcgaggtcgcggtcggtacgtatctttcccccccnccctccgggggggggggggggcttcttccgcgccacctccaaggacacccccgcgctccgagcctggtttgtgggaaccggacgaagttcttccttgccgccgaacctggatagccccaccccgcgtctcccatcatccctggccggggaaccttctggccattcccatattgcggccaagtccggggggtggggatgtgatagcctccgaggtccaaaaaaggctgggccggggtggttaggtggaagggtcccccgccggcccctatcccgcttgctctcaaaccgggtccggcgggccgcatatccattggtcccttctn

SEQ ID NO: 69313 - protein, 120 aa, Zea mays
  misc_feature: Ceres CLONE 1547281
MASSPLFTSLRLPVPTSLPRCASPPHGVPSADDAVPRPAPLVEAASHRRELVVGAALTAVLLPRAPLLAQAREVAVGTYLSPPPSGGGGGLLPRHLQGHPRAPSLVCGNRTKFFLAAEPG

SEQ ID NO: 69314 - DNA, 604 bp, Zea mays
  misc_feature: Ceres CLONE 1547282
  misc_feature: Encodes the peptide sequence at SEQ ID NO. 69315
gctctttactagtggatcccccgggctgcaggaattcgtctcacccctagaaaaatccttcgtttaaacccaaaccctaattgcgacctctgttcccccaaaaccctacggccatggacggcggaggcggtggtgtagggggaggcggagttggggcaggtgtcatggtgggcggcggcgttggcgttggcgttggcggagacgtggagctcgtcagcaagacgctgcagttcgagcacaagctgttctacttcgatctgaaggagaacccgcgggggaggtacctcaagatctccgagaagacctcggccacgcgctccaccatcatcgtccccgtcgacggcgtggcctggttcctcgacctcttcgactactacatccgcaccgacgagcgcgacgccttcagcaaggagctgcgactccagaccaaggtgttctatttcgatatcggggagaacaagaggggccgattcctcaaggtttccgaggcctctgtcaaccgaaaccggagtaccataattgttccagctggcagctctggtgaagagggctgggaagcattcaagagtgtactgctggagataaataacgaggctaccagatg

SEQ ID NO: 69315 - protein, 163 aa, Zea mays
  misc_feature: Ceres CLONE 1547282
  misc_feature (8)..(161): Pfam Name: PurA Pfam Description: PurA ssDNA and RNA-binding protein
MDGGGGGVGGGGVGAGVMVGGGVGVGVGGDVELVSKTLQFEHKLFYFDLKENPRGRYLKISEKTSATRSTIIVPVDGVAWFLDLFDYYIRTDERDAFSKELRLQTKVFYFDIGENKRGRFLKVSEASVNRNRSTIIVPAGSSGEEGWEAFKSVLLEINNEATR

SEQ ID NO: 69316 - DNA, 619 bp, Zea mays
  misc_feature: Ceres CLONE 1547284
  misc_feature: Encodes the peptide sequence at SEQ ID NO. 69317
ggagctccccgcggtggcggccgctctagaactagtggatcccccgggctgcaggaattcgtctcacccctagaaaaactccccaccccacgaggcgctcgctgcggcacggaaccagcgccattagaggccacaagcccgcaccacgcctccctcgttctcgcgcgcgcgcacgcatgcacgaggagctgctgcagagaagaggaggcctgtcgatttgattgaactttccaaattcagattcagaagctggccaagatgactgccggtttccagctcggcgtgatcgggtctctcacgctctccgtcgcgtcgtcggttgccattgtcatctgcaacaaagccctcatcagcaccctaggctttccattcgctacgactctgacaagctggcacctgatggtgaccttctgcaccctccacgtggcgcagcgcctgcgcctttttcgagcccaaggcgatcgacgggcagacggtagttctgtttggcttgctcaacgggacctcaatttggcttctgaaccttaagttaagggtcaactccctcggaatctaccaaagaaaaaattggccattttacccttcacgggggctggtggaaactttattcccagaaaaa

SEQ ID NO: 69317 - protein, 89 aa, Zea mays
  misc_feature: Ceres CLONE 1547284
MTAGFQLGVIGSLTLSVASSVAIVICNKALISTLGFPFATTLTSWHLMVTFCTLHVAQRLRLFRAQGDRRADGSSVWLAQRDLNLASEP

SEQ ID NO: 69318 - DNA, 693 bp, Zea mays
  misc_feature: Ceres CLONE 1547287
  misc_feature: Encodes the peptide sequence at SEQ ID NO. 69319
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
aaaaaaagggggaaaaaagnatcaaagcgccccccccccnnnnnaattttnnnnnnnnattatggggctccccgcggtggcggccgctctataatagtggatcccccgggctgcaggaattcgtctcacccctagaaaaaacgcgcacggcgcacacatatcccttccttcactgcggtcccggcaaaagtcagtcaactcagccaacaagcgctgctgctcgggcacgggtggtttgggaggccggacgcaacgtcgggatgcagtcgctgcaggacaaggcgtcggagtggagcggggtggcggccgccgatgcctttgccatcgacgacgtcaacatattcgagtccctcggcggcactccgcagccattcgtcgacctctccaccaatttctacaccagggtttatgaggactaggaggattggtttcgggagatattcggggggtcctagaaggaggatgccatccagaaccagtatgagttcctgatccagcgcatgggcggcccgcctctattctcccagaggagaggacaccctgcccttataggacgacatcgaccattcttggttacccaccgagctgcagagcggggggttacaccacatgtaccaaagcttttgcacccaactgaaaaccatagaatctggacttcaaaaaccaaaaatcgatgacacttccttgaggccc

SEQ ID NO: 69319 - protein, 52 aa, Zea mays
  misc_feature: Ceres CLONE 1547287
MQSLQDKASEWSGVAAADAFAIDDVNIFESLGGTPQPFVDLSTNFYTRVYED

SEQ ID NO: 69320 - DNA, 661 bp, Zea mays
  misc_feature: Ceres CLONE 1547290
  misc_feature: Encodes the peptide sequence at SEQ ID NO. 69321
  misc_feature (163)..(163): n is a, c, t, g, unknown, or other
  misc_feature (368)..(368): n is a, c, t, g, unknown, or other
  misc_feature (369)..(369): n is a, c, t, g, unknown, or other
  misc_feature (373)..(373): n is a, c, t, g, unknown, or other
  misc_feature (380)..(380): n is a, c, t, g, unknown, or other
  misc_feature (387)..(387): n is a, c, t, g, unknown, or other
ctgaactagtggatcccccgggctgcaggaattcgtctcacccctagaaaaaacagccatcacacgcatactgcatacacaacgcagagcatcagaagcagctgcgatctgatcgacatggctgccgccaccatggggatgcacctcccgcgcgctcgtcggnaagccggcggctggcacgagggacgtcttcggcgagggccgcatcaccatgcgcaagaccgccgccaagcccaagccggcggcgtccggcttcccatggaacggggccgaccgcttcctgtacctgttcccgctgaccagctcgcccccgaactacccggatttttttttccccccccccaagggaaaagaaaaagggggtcctnncctntcttccntaccctnaaaccttttcaaaaaaaaaaataaattggtaagtgagggcgcgggccgcttgttctctttcttatagagcatttctgaagattttgtcccacaagccgacttcactctttatatgtgagttatattctgtgtggggcggttttagattctatagccgggctccaacgatcttctttaacagtgctgagcctaagcgtctctccagcgaccacagagtccgattaaacatacgcatgatgaatccgtcgggccaaattaggagttggcttttttc

SEQ ID NO: 69321 - protein, 80 aa, Zea mays
  misc_feature: Ceres CLONE 1547290
  misc_feature (53)..(53): Xaa is any aa, unknown, or other
  misc_feature (57)..(57): Xaa is any aa, unknown, or other
  misc_feature (59)..(59): Xaa is any aa, unknown, or other
MRKTAAKPKPAASGFPWNGADRFLYLFPLTSSPPNYPDFFFPPPKGKEKGGPXLSSXPXNLFKKKNKLVSEGAGRLFSFL

SEQ ID NO: 69322 - DNA, 809 bp, Zea mays
  misc_feature: Ceres CLONE 1547291
  misc_feature (1)..(1): n is a, c, t, g, unknown, or other
  misc_feature (6)..(6): n is a, c, t, g, unknown, or other
  misc_feature (11)..(11): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
nccccnaaaanaaaaccatttcttttttttcnnnnnnnnnnnggaaacnnnnccaaaactggaactccccgcggtggcggccgctctataactagtggatcccccgggctgcaggaattcgtctcacccctagaaaaattttttgggcacgtagccgccgtcgccgcctcgctttctcctcttccgccccaccccggtgaggcgctgatccatcgcctcggacagcggctccagaacctccgcgttgcagtggttggggttggcttcttgctattcagaaacacagtagcgagaactattcggtggggccgaaaatggtgtcgctgaaggtgcctaagcgcctcgccgcaagcgttctcaagtgtgggaaagggcaagtgtggctttgaccccaatgaagttagtgagattttttttgggcccactcccgggggggggggggggggggagagttggtataggatggggttttttccctcccggaaagccctccaaaaaaatcccccctcctgtggagccgcgtgggccagaggctgtggcgcccctcagggctttttgtccttttattggggaccggcctccctcctaggagaaataggggtaagagcgtgccgaagggtcacacgccgggcaaggccgttgggcacccccccaccccattgggacaccggtcggggttgtagaggatgggattctccctcgttcccttagagggcgcatccaggctctccttcatgtgttacgtgcgcgagtgggcaccgtggtatagacgcgacttacagctcatttttggttcaccacacttaatt

SEQ ID NO: 69323 - DNA, 1158 bp, Zea mays
  misc_feature: Ceres CLONE 1547292
  misc_feature: Encodes the peptide sequence at SEQ ID NO. 69324
aatcggaggacgcaagcgcacgagagatgttgccaattcacattctgcgtgcatcacatggaattcctccagttgcaccaactcaaatagcgcagccaatcttcctcctcccaaacaaaggcactctcctcctctccaccacggaccaacaagcgtatcgtctctgagtctctcgtctcatgccctggccaacatgagcacgtacatatctctctccttagagcgcagcagcagcgtggtccgcgacgccgccaagtccgcgcctccgggcagtggtgtcagtgccccgtatccacgcgcgggcgcgggcacgtcgctttccctgtccggcgcagcggcggcgcatgggcacggccagtacctccccctcaacgaggacgactccctggacatggtcctcttcgacgtgctccgcgaggcatccggctccgcacccgccgccacctaccagccgccctcgtcgtcgttgcctacgctgaaggcgctcgcttccggcgcctcgcgcaagggcggtggcaacagcggcaacggcagtagggccgcgcacgcacccaaggcggccacggggcggcactaccgcggggtgaggcggcggccgtggggcaagtatgccgcagagatccgtgacccggcgcggcacggggcgcggctctggctcggcaccttcgccacggccgaggaggccgccgcggcgtacgaccgcgccgcgttcggcatgcggggcgccaaggcgctgctcaacttcccgccgccggccgcgggctgcgggaacgccgcaaccgccacggcgaagcaggctgctggaagccaagtgaacaacggcgaatgcgatctcctcgaagaaaatgggtcatcgcatgatagtgaatgtttctaagcattgtccagtccgttgattgaccagagtggtatgtggtagcgatccctcttctcgttgtaaggacatgccgtgagctgtgatgggttcaaattggggggatgatgatagccataaaactccaatgtttcttttttgtgcgtgtgtgtgtttccttcaaaatctggtttgggagcgaacgtgcacgatcctatttggatgcttgtttaatcatgaatatatacaaaaaaaaggtcaagatgaaaacatgattttgttcgctgcaaaaaaaaaaaaaaaaa

SEQ ID NO: 69324 - protein, 227 aa, Zea mays
  misc_feature: Ceres CLONE 1547292
  misc_feature (126)..(178): Pfam Name: AP2 Pfam Description: AP2 domain
MSTYISLSLERSSSVVRDAAKSAPPGSGVSAPYPRAGAGTSLSLSGAAAAHGHGQYLPLNEDDSLDMVLFDVLREASGSAPAATYQPPSSSLPTLKALASGASRKGGGNSGNGSRAAHAPKAATGRHYRGVRRRPWGKYAAEIRDPARHGARLWLGTFATAEEAAAAYDRAAFGMRGAKALLNFPPPAAGCGNAATATAKQAAGSQVNNGECDLLEENGSSHDSECF

SEQ ID NO: 69325 - DNA, 1016 bp, Zea mays
  misc_feature: Ceres CLONE 1547297-R
  misc_feature (428)..(428): n is a, c, t, g, unknown, or other
ttggggtactcgagcgtctcgtttttttttttttttttctcaccaactgcctgatgccaatcgcagcgagttccaattaaaaaacagggaacgttaaatggttacatatgatacggcagaaacaaaaaataaaacaggcggacaccttttcagccaatgtattcttttttgtttctgagctacacaaacagcctatacacataaatacaatacaacccatcaacaaactcactgatcttggacagctgatccgcgaccggcaaccatctaatttactactcttccttattttatgcctcagcaggagaaatttcgcttcccctggaaaaaaagctacctagatgcatcaaaatcagtgttactgttaattccacaccttgacctagttgtcatggatatcaaaaccttccacccctgtgactgggtgnactgcaccagaccccacttattagaccttcaggagcaatgaaaaggttagagcctcagagttatttcaacaatgttccaaaaaacatcatagaaaacttggtaggccctcccatataacccaacaagaattggcaaattaactcctgggttgggaaacaacgctaataaaatctgaaaaccttagtttttctcgatatgcgaatactctacgtcctcttgtaaataatgcccgaattcccccccccagttctgaagcgattttgagaaggcgatagaacccggtagaagcgttggggtagagcttgaaacgtggaatgagaaagtgaaaactgtgtttttttccgaacaatttgcgtggttcccccgcgccaacatacggtacacagcagcatgttaccaaagcataaatagagggcacatgtgtgtgacgtgtatttttctctttctaccgctgggtgttgctcaatatactaaatagattctggataaacaccagtgtattatgaactagtgatgcgccaattaaacactgaggctgctaatgagtcggccgaaaacaggtgatacgagaaaaaaaccagaacaaa

SEQ ID NO: 69326 - DNA, 643 bp, Zea mays
  misc_feature: Ceres CLONE 1547302
  misc_feature: Encodes the peptide sequence at SEQ ID NO. 69327
ggagctccccgcggtggcggccgctctagaactagtggatcccccgggctgcaggaattcgtctcacccctatattaaaacccccatcttccatcccctcccgcggcaagtctctctgaattgtgggtctccggcgatggcgactcttgctccttcccagaattctgggcccccatctcatcttctgcggctcctcccgctacgccaccgcatcgcccaccgcgggggctcacaaaatcgtctccctcttcggcaagaagcctgcccagaagccctagccctctgcggtgtcatcctcttctccggacatcaaccacgagctcgcctagtggtacggtcctgacatgaggatctacctgccggatggactcttggaccgctcggaggtaccggagtacctcaccggacacggccctggagactatggctacaacccttttggcctgcgcaagaagccaaacgacttcgccaagtaccaagcctacgagctgatccatgccacatgggccatgctcggtgccgctggcgctgtcgtcccagatgcgtgcaacaagttcggcgctaactgcggccccgatgccgtctggctctagaccggagccctgctcctcgaccgagacaccctcgactatttcggcctcag

SEQ ID NO: 69327 - protein, 82 aa, Zea mays
  misc_feature: Ceres CLONE 1547302
  misc_feature (14)..(83): Pfam Name: Chloroa_b-bind Pfam Description: Chlorophyll A-B binding protein
MRIYLPDGLLDRSEVPEYLTGHGPGDYGYNPFGLRKKPNDFAKYQAYELIHATWAMLGAAGAVVPDACNKFGANCGPDAVWL

SEQ ID NO: 69328 - DNA, 625 bp, Zea mays
  misc_feature: Ceres CLONE 1547303
tccccgcggtggcggccgctctagaactagtggatcccccgggctgcaggaattcgtctcacccctagaaaaaatagatagctgcaaacgtaacttaactttcaactacctacgtatcagacccatcacatgtctatgttatcattttaatcagatcgttcatgatttatagttaacatgttgtcgtggctcaacattccatctggtcgagttatggaaggtctatttgattcatgtgtgctcctggattatcatttgcacctgacagtaatatgtgtttgtactacaatgatcatcttttgttgccagtctagcgcatgttatgcttcttgatgttatgacttcacatcaatctatccacccatctactgttagtcatatgccatttttaccacagtgaattttaccgttgcaagtatgccatagcttgtctttcttgcttcttaagacattgttctgccttttggcacttatggaaattattttatctgaatgtttgctaggatcatggataagcatttgaagacccttgccccagtctacgtgggaacaaaattcgtcaagcttgatgctgaagtctgtatactaccacttggctataaactacatccttttgataatcatg

SEQ ID NO: 69329 - DNA, 687 bp, Zea mays
  misc_feature: Ceres CLONE 1547304
  misc_feature: Encodes the peptide sequence at SEQ ID NO. 69330
  misc_feature (20)..(20): n is a, c, t, g, unknown, or other
  misc_feature (41)..(41): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (87)..(87): n is a, c, t, g, unknown, or other
  misc_feature (622)..(622): n is a, c, t, g, unknown, or other
ttttacccccggtacaatangtagcgagagcgtaaaatccntnnnnnnnnnnnnnnnnnaaaaactggaactccccgcggtggcggncgttctccaactagtggatcccccgggctgcaggaattcgtctcacccctagaaaaaatccgcatacccccattccccgaaggccgagctcatccaatccagtcgcctgattgcattgggatcccatggccaagctcgccgtcctcctcctcctcctcgccgtggccgcgtccgccacagtgccggtgcacggccgcgataccccgactgagatcaagctcatcaaaggcacggacgcctccggcgtgggcgacgacagcatggagtgcgtgtacacggtgttcatccggacggggtcgatcctgaaggccgggacggacgcgaacgtcacgctggagctggccgccgcggacggcaacggcgtgaggatctcgaacctgcccgcctggggcgggctcatggggcagggctactcctacttcgagcgcagcaacctggacatcttccgcggccgcgggccctgcatggagaaggcgccgtgctggatgcggctggccaccgacggccccgggcgaccaccacgggtggtactgcnactacgtggaggtcaccaccacggggccggacaaggggtgcgggcaacaactgtttcaccgtcga

SEQ ID NO: 69330 - protein, 158 aa, Zea mays
  misc_feature: Ceres CLONE 1547304
  misc_feature (137)..(137): Xaa is any aa, unknown, or other
MAKLAVLLLLLAVAASATVPVHGRDTPTEIKLIKGTDASGVGDDSMECVYTVFIRTGSILKAGTDANVTLELAAADGNGVRISNLPAWGGLMGQGYSYFERSNLDIFRGRGPCMEKAPCWMRLATDGPGRPPRVVLXLRGGHHHGAGQGVRATTVSPS

SEQ ID NO: 69331 - DNA, 650 bp, Zea mays
  misc_feature: Ceres CLONE 1547305
  misc_feature: SWISSPROT Homolog: EC 1.1.1.37 Malate dehydrogenase
  misc_feature (650)..(650): n is a, c, t, g, unknown, or other
ggagctccccgcggtggcggccgctctagaatagtggatcccccgggctgcaggaattcgtctcacccctagaaaaaactccactttgtctgcctgatccttcttactctctggccatgctggcttccggaaccttctcaaaattccccttcgtgtcctcgactcgcaccgatggggaacgaaccaatgcgcgtgcttcctcactggcgacacatgacaaatctgaatctgctccggttcccatgattggtaggattgattatgctcgatacaaatcattgtgtcagtcggcactagcttgattttccttccttctatgaacccattaatggcgttcagatatgaacctcctgatgctgcctatcgtcttctgatcgaactcgttgctacgaatgatgtctgtgtagacctgcactggtgtcaatgtgtgcgtcttgtgtcgcggactcccccatatagatgcattggaaaggaaagatgttaggtcgaaaaaagtctctttctactgatcccaagcatctgaccatgaatcgcatgcagctcccaacttgccagttctggtgggtgccttcccgccgaacaccagtgctcttatcttgaaagaattctgctctctctattcctaacaagagagttgctttgcctgatcn

SEQ ID NO: 69332 - DNA, 663 bp, Zea mays
  misc_feature: Ceres CLONE 1547311
  misc_feature: Translation starting site: 191
  misc_feature (269)..(269): n is a, c, t, g, unknown, or other
atagctggagctccccgcggtggcggccgctctagaactagtggatcccccgggctgcaggaattcgtctcacccctagaaaaaggagtacttcaattggcgttggccgaagaagaggagaagcgaagcaagcaggcttcgagaacaagggggagggggaggaccaagcgaaagggggaactagagcaagatgggcggcgaactgctgcttgcgctcctcctcgtctctgctgctgccgcccctcaggtacttggagttggcaatgganacaatcacatgagaatcatccaggaggacatcattgagacagtcaacaaccatcccagtgctgggtggacagcctcacgtaatccttacttttcacactataccatggcggggggggggcgcatacttggagtgaaacccccccccacagaatgcactaagcaatgttccggtcaaaacttattcaagacccctggaacttccaaaagagtttgacgctagatccgcctggccccgttgccgcacaattgggaacatacttggatcagggcaccgggggcccttggtggggcttttggggccgggggaagggcccccaggaccgttttttgccttcaccctcaacatgaactcttttactttccggcccagggacctactgggcaggctgccgg

SEQ ID NO: 69333 - DNA, 681 bp, Zea mays
  misc_feature: Ceres CLONE 1547313
  misc_feature (183)..(183): n is a, c, t, g, unknown, or other
  misc_feature (399)..(399): n is a, c, t, g, unknown, or other
  misc_feature (681)..(681): n is a, c, t, g, unknown, or other
tccccgcggtggcggccgctctaaaactagtggatcccccgggctgcaggaattcttctcacccctagaaaaaatcccaacccactcacagtctcacgctactatcgctatctagagctccggccgtcacagacacgagctagagctagagctgcggggaagaagaagaagcaggaggagganaaaatgagggcgtcccccctggtctgcttcgtggcggtgtcggcgtgcataacatgcatcgcgcatggcggcaacttctaccaggacacggatatgacctgggggcgggggcgcggcttggtggtgtacttccgccccccgcctgaacctgtaccttggatgggttttctctgccccccctttggggagaaagaaaggggggcctttttctctaanatcccacatcccccatggagtctggtagcccagttaccgcggcgggggacgccggggcggccgctgttccctgtccttcccacaggccgacgccgtccgcgccttccggcccagagtttctctgggccatcctgtgctgggtttgccttaatcccgctttctcccgaaacttctctccccccgtgcgttttgtcgctcctgtcactctccttctccgcccccccgagccgcgcctcctccccaccatttcctccgcttggttcgtgttgccgttgctcccgn

SEQ ID NO: 69334 - DNA, 783 bp, Zea mays
  misc_feature: Ceres CLONE 1547324
  misc_feature (269)..(269): n is a, c, t, g, unknown, or other
  misc_feature (270)..(270): n is a, c, t, g, unknown, or other
  misc_feature (273)..(273): n is a, c, t, g, unknown, or other
gcggtggcggccgctctagaactagtggatcccccgggctgcaggaattcgtctcacccctagaaaaaataagtatatcccatctttagtttctctattgaggattgtcacttaagctagcatgtatttgaaaacctataaatattttatacattttaaattgtaatttttttgaatcactttcttttgtaatcactccgataattgtataatgtaaacttattgtaatatgaaatcattttgcaataaagaattttatttccgctgcnnagnagaagaaaaaaaaaaaaaaaaaaaaaaaaaaaaaaaaaaaaaaaaaaaaaaaaaaaaaaaaaaaaaaaaaagaaagaaaggccgctgaagggggggggtggcgttgtgggatgactcttattccgcgccccccgctgaccagggggggtgcgccggcttcgggggcctcctcttctctcccggaagaagcgctgtggtatacggccgtgccgtcctggcgcgtcgttttttcgaggggggggggcggggagaaaaaaccgcgtggtctaacacgaaactggaccgggacggtacgacccagatcttctttttggggggggggagtgaaatagaggaaaagcgcccgcagtaatttcgttttgtaaaaagaggggtgtcggaccggtgagaggtgggtgggcagagagtgagtgcctataggtgattaataaaatacggcaaagtatgatttgtgtacatcacacggtgtttttgaagaaacaaagagttaggaagcggaagatcttcttg

SEQ ID NO: 69335 - DNA, 694 bp, Zea mays
  misc_feature: Ceres CLONE 1547346
  misc_feature: Translation starting site: 320
  misc_feature: SWISSPROT Homolog: EC 3.2.1.23 Beta-galactosidase
  misc_feature (694)..(694): n is a, c, t, g, unknown, or other
gcggtggcggccgctctagaactagtggatcccccgggctgcaggaattcgtctcacccctagaaaaaggttccctacttccctcaaaccacgtcctctgcaacgagcgcgccctacgcgacggcgttccctcggctacctctacctcctggacatgccaccctcctcccggcctccttcgcctcaaccctaaccccgcaccttcgaacccattgctgctcccctctctccccggctctaatccgctcctaacttccgccttgtttgctgcaaggaggcgtgcgcgacctccagttccaatctgagcgactttggtggcatggacttcctgttcaccatcgccggcttcctcaccatcatcagctttggtggcggacatgagaggagagaagaatccttcgaggcttgcagagaagacaaacactggtagtcgtagaacccaatgaaattaacttcactagaataaagaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagccccgcacgatcgcccttcccacagttgcgcagcctgaatggcan

SEQ ID NO: 69336 - DNA, 625 bp, Zea mays
  misc_feature: Ceres CLONE 1547350
  misc_feature: Encodes the peptide sequence at SEQ ID NO. 69337
  misc_feature (126)..(126): n is a, c, t, g, unknown, or other
  misc_feature (129)..(129): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (390)..(390): n is a, c, t, g, unknown, or other
tccccgcggtggcggccgctctagaactagtggatcccccgggctgcaggaattcgtctcacccctagaaaagtccgcttctctctccccatctccatctgcaatcctcgctcgcccacactcggnagncatggcgtcgtcgcgcaccggagccggagccggcggccgtgtggtggtcttcccgttcccattccagggccacttcaacccggtgatggggctggcccgcgcgctgcacgccccgggcctcgcgattaccgtctttcacagcggcgccctggaaccggccgactaccccgccgatttttgcttcgggcccgtgaccgtggaagcggaccctttttttcccccccccaaggggggaagaaggggggtnnntccatttaaacncccctttcaaccccccctttaaaaaaccccgcctccgagggtggtgggcggcgggagcgcaaaaaaatcccccccgcgctttttttcccaaggaccgtgggacagggcggggctgatcgtgcgtcccggggacccggttcggcctctaacccccccccctaaagaccacccgcctcccccggggtcattttgtgttttcggtggccccgatgtgcgtttgcgggccccactcgcg

SEQ ID NO: 69337 - protein, 93 aa, Zea mays
  misc_feature: Ceres CLONE 1547350
  misc_feature (83)..(83): Xaa is any aa, unknown, or other
  misc_feature (87)..(87): Xaa is any aa, unknown, or other
MASSRTGAGAGGRVVVFPFPFQGHFNPVMGLARALHAPGLAITVFHSGALEPADYPADFCFGPVTVEADPFFPPPKGGRRGVXPFKXPFQPPL

SEQ ID NO: 69338 - DNA, 612 bp, Zea mays
  misc_feature: Ceres CLONE 1547352
  misc_feature: Encodes the peptide sequence at SEQ ID NO. 69339
aaagctggagctccccgcggtggcggccgctctagaatagtggatcccccgggctgcaggaattcgtctcacccctagaaaaaaacacgtgataccccgcgcggcaccctcgcctccgccgcacgcccccactctctcaccgccaccgccgagaatggcctgctcccacctcgccgccgcgggtggctcttcccctgccgccgccgcagtggttcgttccccgacgcattccccagccgccgccttcgcgcgcctccggtcgacgccgcgtttctcgagcgccggcctgtcggttaagggaagcagggcggctttcccgtgggtcgccgccgcggggccggccgcggcggcgccggtggccgacctggacggccgcccggccacggagaagcagcccatcattgtcatcgataactacgacagcttcacctacaacctctgccagtatatgggggagcttggattgaacttcgaagtataccgcaatgatgaactgaccatagaagatgtaaagaggaagaacccaagaggaatacttatttctccagggcctggtgaaccacaagattcagggatatcattgcagactgttcttgaattaggcccaaccat

SEQ ID NO: 69339 - protein, 152 aa, Zea mays
  misc_feature: Ceres CLONE 1547352
  misc_feature: SWISSPROT Homolog: EC 4.1.3.27 Anthranilate synthase
MACSHLAAAGGSSPAAAAVVRSPTHSPAAAFARLRSTPRFSSAGLSVKGSRAAFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPT

SEQ ID NO: 69340 - DNA, 894 bp, Zea mays
  misc_feature: Ceres CLONE 1547355-R
  misc_feature: Pfam Name: BURP Pfam Description: BURP domain
  misc_feature (704)..(704): n is a, c, t, g, unknown, or other
  misc_feature (723)..(723): n is a, c, t, g, unknown, or other
caattgggacctcgagcgtctcgtttttttttttttttttttttttttttttttttttggtttttttttttttttttttgaacgggagggggattccattcatcatcagatgtctcccgagaagtagatcccacaagcgtcgtcggaaataaattaaaaacttggttagcccgagagctagcagaaataacagaaatgtctgattattccaaactatacaaacataatctaagcaaacgggggcgtcctgaccagtggatgcaaacggggaccactctcagccgccgcgggtccagacaaactggtcctgcggcaggaaatggcaaatcggcaccgtgccgggcttcaccctgagcacctggaacgcgacgtgcttggggttcccgcccgacgtgtcggcgtggcacaccgcgacagcgtccacgggcgtgccgtccctgcccagcatcgacaccgaatacgcccgcgtctgctgcgtcaagtggcacgcgaacacggggtacgcgtacggctccccgtgggaaggcaacagggggccgccgcccgcccgctttaagcctgtcacggtgtactcctgcctcggcgagccctccctccccacgaacgtcgacgcggccctcacgtggctggtcccgaagctggcggtggcaaagtccaccatggattccagcgacgtggggcacgccttcctctcgccccctggncgcgggcgactcccaatcntgcaacgtctgcgccatctccgccgcctccatggagtccgggtccacccagaaacgggcgaagatctccgggaacctctccgaggaaaacggattgcctccgcatcccttcccggaagaacttgccgccggccaccccggtgttgcgaaatgggacgtccccttcctcccg

SEQ ID NO: 69341 - DNA, 633 bp, Zea mays
  misc_feature: Ceres CLONE 1547355
  misc_feature: Encodes the peptide sequence at SEQ ID NO. 69342
ctccccgcggtggcggccgctctagaactagtggatcccccgggctgcaggaattcgtctcacccctagaaaaaatccctccctctcaacgttcctcattggccatcgctgtgcgtgttacgtggatacgctccttgctgcgctactactcggcttcctattattgatcacctccggactaagcgctgcccctctggctatacatccctactggaagactactcttcgcgacactcgcatgccgagctctctctcgcaactcctcaactcctcaactggcaagggcggcgtccgtggaggcaacaggttactcaaacccgacggccccaccgtgggagttagtaaacggtcactgggcgttaacgttaaccctactcaacccggcctcccccgtacaaccgatggcgttggacaatgtggcgtcagacgacggatctctcacgggtacagtcaggcgggtggcacacatgctggcgttctcaatgccaagtatggcgtccacgtgaacccgggcaagaatcccgtcctcgtagccgtcgggcctttccagtacaagtacgccgcatctgatacgcttctgcaccagcaccccactgtggagctcttcttccgataggacgacctgcatcccgg

SEQ ID NO: 69342 - protein, 125 aa, Zea mays
  misc_feature: Ceres CLONE 1547355
MPSSLSQLLNSSTGKGGVRGGNRLLKPDGPTVGVSKRSLGVNVNPTQPGLPRTTDGVGQCGVRRRISHGYSQAGGTHAGVLNAKYGVHVNPGKNPVLVAVGPFQYKYAASDTLLHQHPTVELFFR

SEQ ID NO: 69343 - DNA, 847 bp, Zea mays
  misc_feature: Ceres CLONE 1547360-R
  misc_feature (847)..(847): n is a, c, t, g, unknown, or other
tgggtacctcgagcgtctcgtttttttttttttttttgccacaatgccacattgtgtcattgcagaattaataggttacaacaacacttctccgatcgtaacggaaagccatgtacattctgatattgatggcattcacatgcgtgtttttacattctatgaatgaacgtgagcatattcccatcatgaactccgaacatcaactaccagaacatacaagatatgcaccccccaaatttgatgcccaacagttctctacaactggggtatggtctcacatcgtacgagctttgcttgacaacacaccactccatagaaatttttgtccctcgccaaattgtaaatcactacccctactacatgtaaccttccttgtgggtgcggcatgacgcacgtctggactttgagggacgagacgcactgatcaccacataagattcctcctgctgcccggtctccaggaaggatccctccgactgggctaccgaaccagactcaattttgcctgcccaagtggaccaagcccaaggacatgacgactatgggaactgcgctccggaagtctcggctgagtcaaggatgtaggcctcctctggagcatcaaactcatgctcttcaccctcaggcccaaccagcttcaccttttatacagccatggccgatgacatccagttgtcctggaagtcttcaggcttggaaccttcgtaacttggctgaataagcttagagacaaacggctcttcaccgctgtctgggaggcctgccttgttctaacattgcccaacatcctgacagaagtacggcatctgctgggtccacctattgaatcctgacaacctcgcgggan

SEQ ID NO: 69344 - DNA, 625 bp, Zea mays
  misc_feature: Ceres CLONE 1547360
  misc_feature: Encodes the peptide sequence at SEQ ID NO. 69345
aagctggagctccccgcggtggcggccgctctagaactagtggatcccccgggctgcaggaattcgtctcacccctagaaaaactccgctatgatcaccattcccaggcatgccctacctcctgcccttgataaacggaagaacggcccccgtcccaatggcccaaactctgtccgccgcctcgaagatggccaccctcgaacgcccattcttgttcgacggcttcggctatgatctcaacaacggctgcgcgaccggcaagaagcccaaggcgctccctacgtacggggacccggcggcggctatggccgcagcgcgggactacttcagcgagcacagcagcccgtacttgtccatctacgcctccgcaactttcacggtgatgagaccggacaccatgcggaagcttgttcgctggcgacctggtcgcccgaccgctgaaacatgtacatctacgaccggcacttccaccagactgagctggcgctggagcgcgacatggttgacgctggaggagactgaggcgggctactgcactgactcctgcgatgtccgccatctggtccgtgctgatgcagctagtggaggccggctgccacgagctgtcgtagcggtgcctgctcga

SEQ ID NO: 69345 - protein, 146 aa, Zea mays
  misc_feature: Ceres CLONE 1547360
MATLERPFLFDGFGYDLNNGCATGKKPKALPTYGDPAAAMAAARDYFSEHSSPYLSIYASATFTVMRPDTMRKLVRWRPGRPTAETCTSTTGTSTRLSWRWSATWLTLEETEAGYCTDSCDVRHLVRADAASGGRLPRAVVAVPAR

SEQ ID NO: 69346 - DNA, 605 bp, Zea mays
  misc_feature: Ceres CLONE 1547374
  misc_feature: Encodes the peptide sequence at SEQ ID NO. 69347
ccccgcggtggcggccgctctagaactagtggatcccccgggctgcaggaattcgtctcacccctagaaaaaactcccctcccgtccctatggcggccgttaccacagccactgccgccgcgtcctcctcctccttcctccaccgccgaagccccgcctgcctgcgcgccacgctccgcgccgcgccgcggcactgccgcaactccagctccatgctcgcctgccgcgccgccgaggtgtacggggccgagtcgtcctcggccgcggcagagggcgcgcgacgaggcgggggcgcgtcgtgggtgcccgtggagccgctcgccgcgctgcagcgcggagagcgccgcgtgatcgtgcacgacggggaggagatcctgctgctctggtacaagaaccaggtcttcgccatcgagaaccggtcgcctgcggagggcgcctacaccgagggcctcctcaacgccaagctcacgcatgacgggtgcattgtttgtccatcaacaaacagcacatttgaccttcgcaccggtgagataaaagaatggtatccgaaaaaccctgtcctacgggctcttacgccagccttgaagaaactattcacctaccgg

SEQ ID NO: 69347 - protein, 172 aa, Zea mays
  misc_feature: Ceres CLONE 1547374
MAAVTTATAAASSSSFLHRRSPACLRATLRAAPRHCRNSSSMLACRAAEVYGAESSSAAAEGARRGGGASWVPVEPLAALQRGERRVIVHDGEEILLLWYKNQVFAIENRSPAEGAYTEGLLNAKLTHDGCIVCPSTNSTFDLRTGEIKEWYPKNPVLRALTPALKKLFTYR

SEQ ID NO: 69348 - DNA, 691 bp, Zea mays
  misc_feature: Ceres CLONE 1547375
  misc_feature (303)..(303): n is a, c, t, g, unknown, or other
  misc_feature (383)..(383): n is a, c, t, g, unknown, or other
  misc_feature (552)..(552): n is a, c, t, g, unknown, or other
  misc_feature (691)..(691): n is a, c, t, g, unknown, or other
tcaccgcggtggcggccgctctagaactagtggatctcttgggctgcaggaattcccctaacccctagaaaaaagactcaatactcaaccggagatcaaaacatttcttgcttcccgctagctaactcgcaagaaataatggctccacttcttcttgcttctcgcacagcctgtcgtcctgaccttacaagccgccatgcccatgataatggccggcacggcctgtcttcttcaccaccaggaagtcgtagtaagcgaagccgtagccttagcttgaggccacgagctgaaaagacgacgacnggcggtgggggtcatgttgtgagcgaaaagctgagcccctgttttatcccccccagggaggggggggggggcgagcttanctctggcgctgccccttccgcataccaaattaaaaagagctcggcaccaaacggggaaaaggggccaaccacttggaaaacaactactgccacaacccaccccggaaagggatacccccacccgcgaccaccgggggaattcttcaaaccaaacctcctacttatgtgnaaagggcggcggaccgtcgaaactgctttaaacgcaaatggaattccggagccccccaacaagattcccccaagtctctctggggtaccacgaaaaatagccccaagggagaaacagaccctccgcgggggacttcaan

SEQ ID NO: 69349 - DNA, 623 bp, Zea mays
  misc_feature: Ceres CLONE 1547380
  misc_feature: Encodes the peptide sequence at SEQ ID NO. 69350
  misc_feature (551)..(551): n is a, c, t, g, unknown, or other
ggagctccccgcggtggcggccgctctagaactagtggatcccccgggctgcaggaattcgtctcacccctagaaaaaatcctcagctcagtctcttccactctcccttgacctgtctcctctcacctgctgactgctgtgccgctccgctccggtggcatctgcatctgcatctccatccctcgatctgtcttctctcagggtggaagaagcgtgacaatggaggctccacccgtggcgctgttcgacaccctcaaggcagccaaaccgttcttcttgttggctggtcccaacgtgattgaatcggaggagcacgtcctgaagatggccaaacacatcaaagcaattacgaccaagcttggaattccactcgtgttcaagtccagctttgataaagcaaaccgtacatcatcaaaatcgttccgtggtcctggtcttgaagaaggtctaaagatccttcaaaaggtgaaagcaacatatgaccttccgatagtcactgaatgtgcacgaaagccaccagtgttgaactgttggaaaaattgctgacatcntacaaattccagccttccctctggcgccaaaaggatcttctaggggctgctgctaaaactggaaaaattttc

SEQ ID NO: 69350 - protein, 108 aa, Zea mays
  misc_feature: Ceres CLONE 1547380
  misc_feature: SWISSPROT Homolog: EC 2.5.1.55 3-deoxy-8-phosphooctulonate synthase
MEAPPVALFDTLKAAKPFFLLAGPNVIESEEHVLKMAKHIKAITTKLGIPLVFKSSFDKANRTSSKSFRGPGLEEGLKILQKVKATYDLPIVTECARKPPVLNCWKNC

SEQ ID NO: 69351 - DNA, 784 bp, Zea mays
  misc_feature: Ceres CLONE 1547381
  misc_feature: Encodes the peptide sequence at SEQ ID NO. 69352
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (53)..(53): n is a, c, t, g, unknown, or other
  misc_feature (54)..(54): n is a, c, t, g, unknown, or other
  misc_feature (74)..(74): n is a, c, t, g, unknown, or other
tttgggtgtgtnnnnnnnntgttccgccccttctccctattnnnngcaaaatnnaaacaaactggagctccccncggtggcggccgctctataatagtggatcccccgggctgcaggaattcgtctcacccctagaaaaaaggcattcaccgtccacgttccatatggcttcctgcaggatggcactcctccttggcttgctgctgctagtagtagcttcgccagcgatcgctgatgacgactccggtatctactaccagctggctcttatgtggccaggagcatactgcgagcagaccagcgctgggtgctgcaagccgaccaccggcgtctcgccggcgcgcgacttctacataacaggcttcaccgtaccttaacgcgaccaccgacgctgcagtgactgtattgcatcattttttctccctacgacccggaaggggaggggacgggtattcccaggcctgaattccgtactcggagccaacatccacgtagccaccagcaaacattggtacagcatcagcttactaacaaccccctgttaacaaagagtcggacgccttgctcccgcgcctcgggcaagtaccaactatacttctagaactggcccctcccactttccaacaaccccgaatcaaaacccacttcttacactctaccacaaaccaatattgtattcttaacccaagcaacttccaggtcatctacccggcgcaagaaaggtcaattgcacctttcctgcccattacaatatagctctttcccccacccgccaacccctccc

SEQ ID NO: 69352 - protein, 70 aa, Zea mays
  misc_feature: Ceres CLONE 1547381
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVP

SEQ ID NO: 69353 - DNA, 629 bp, Zea mays
  misc_feature: Ceres CLONE 1547382
  misc_feature: Encodes the peptide sequence at SEQ ID NO. 69354
ctggagctccccgcggtggcggccgctctagaactagtggatcccccgggctgcaggaattcgtctcacccctagaaaaatccactgcggcacgcgtcccgcctctggtttgcttgcctcccagatcttgccaactaattggaggcagccgagctgatctcccatcccgcaacgcgccgtctcgacggcggatcgttttcttctgcttctactgcgtgatctttgggcaagaagataagacacgtccaagcgtcgccacagtcaagggcggcttggttgcagtcaagatggggaaggacagagaatctgccaagctgaaggaggagaaggggtccaaggatgagatccatatgaaggtcaagagcaagggcgagccgtccggcgaggaagacggcaaggaggaggtcgaggtagagattgaggccaagtttgttgagaaggaagaggtcacaggctcgggtgacggtgcgggaggaaagggtaccaagaagaaggatacaaaggagaaagacaagaaaaagaaggaaggtggtgacgattcagggaaggcagaggaagacaataagggtaaagcgaaggattcggagggcaagggccaagtgaagaaggaaaagaaggatggtgctggg

SEQ ID NO: 69354 - protein, 114 aa, Zea mays
  misc_feature: Ceres CLONE 1547382
MGKDRESAKLKEEKGSKDEIHMKVKSKGEPSGEEDGKEEVEVEIEAKFVEKEEVTGSGDGAGGKGTKKKDTKEKDKKKKEGGDDSGKAEEDNKGKAKDSEGKGQVKKEKKDGAG

SEQ ID NO: 69355 - DNA, 675 bp, Zea mays
  misc_feature: Ceres CLONE 1547383
  misc_feature (662)..(662): n is a, c, t, g, unknown, or other
tgtggatcccccgggctgcaggaattcgtctcacccctagaaaaagcagcggccgtcgcctccctttccccttccctccctccctctccccgcgggccgccagaggctatttcgccctcgattccaccccgagtcagccgcccgcgaccgggattccctccgccaagcgcggatctgaacgctgcgctccgtgtcgccgctcgaatccgccatgaacggggccaaatcccagggcgccgcccaggccgatgcctagctggcggtgaagagcatgggggcggaaaatgccgcctaggggacgaaagggaagggcgggattggtttcccccacctcaaggagggggggggggggtattcctcccgttctcgaaaaactcccccaacgaaactaaaggagaagaccccgaatgaccatctcaggggctgccgctgacaagatgtgtgggcgatcggtgaatatcccctgaaggagggtcaagacgcttcccttctgtaaccatacgttaaccaacgttcacgctttcgaatccacctaggttgtttgccggcgccatgatcaaattgtacaatagtactgcgaacgggaaaacagcccccctcgctcctatcaaaacacctacaatcccaaccacggccaaatctgtctccttcgcatatgtccnctatggggtgggg

SEQ ID NO: 69356 - DNA, 656 bp, Zea mays
  misc_feature: Ceres CLONE 1547384
  misc_feature: Encodes the peptide sequence at SEQ ID NO. 69357
  misc_feature (398)..(398): n is a, c, t, g, unknown, or other
  misc_feature (399)..(399): n is a, c, t, g, unknown, or other
aaagctggagctccccgcggtggcggccgctctagactagtggatcccccgggctgcaggaattcgtctcacccctagaaaacctacatgggcaaggagcgcgcgatgctgctccccaactgcctgttccgcatgggcggcgccgcggcgctgctgtccaccgacggcgccggcgcgcggttccggctggcgcgcgtggtgcgcacgctgcgcggcgcctcagacgccgcgtaccgctgcgtgtaccaggaggaggacgagcgcggcaacgtgggcatcaacctgtccaaggacctgatgagcatcgcgggcgacgcgctgaaggcgaacatcacggcgatggggcccctggtgcttgccgcccccccaccaggtggggggggggctgtccttcatcnngcgcaaggtgctgaacgaccgggtgaagccctacatccccggacttccgcacggggttccagcactttcggcttccccgccgggcggggcgccccgtgattcacgaactcccaccgaagccggacgcctgtcggacaaacaggtggaagccgccccggaagaacgctgcccccggttcgggaaacacccccagcaggttccccctgggccgacgcccccctcatcgggggccaaggcccgctgggcccgggggcacg

SEQ ID NO: 69357 - protein, 136 aa, Zea mays
  misc_feature: Ceres CLONE 1547384
  misc_feature (1)..(92): Pfam Name: FAE1_CUT1_RppA Pfam Description: FAE1/Type III polyketide synthase-like protein
  misc_feature: SWISSPROT Homolog: EC 2.3.1.119 Icosanoyl-CoA synthase
  misc_feature (104)..(104): Xaa is any aa, unknown, or other
MGKERAMLLPNCLFRMGGAAALLSTDGAGARFRLARVVRTLRGASDAAYRCVYQEEDERGNVGINLSKDLMSIAGDALKANITAMGPLVLAAPPPGGGGAVLHXAQGAERPGEALHPRTSARGSSTFGFPAGRGAP

SEQ ID NO: 69358 - DNA, 690 bp, Zea mays
  misc_feature: Ceres CLONE 1547385
  misc_feature: Translation starting site: 88
  misc_feature (387)..(387): n is a, c, t, g, unknown, or other
gtggcggccgctctatactactggatcccccgggctgcaggaattcctctcacccctagaaaaagctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcgtacctgaccggcgagttccccggcgactacggttggttcccgccccccctggggggcagcaggggaggctttctctcggaacanggcgctggaagtgattcaaaggcggtgggcgatgctgggtgcgctggggctgctcacccccgaagtgctggaaaacacgggtgcccccggactcccaggagccccggtggtttcacgggccggcctgcaaatctttctcgcaaggccgggcttggatcaacttgggccaacccccaacccttgtttcaccccgccatagcattccctgtgccttggactagggcttccatgggaaaacccctaccgggagctaccccccacaggggacttcctcgcccacatcccgaccctccctcccgcacg

SEQ ID NO: 69359 - DNA, 639 bp, Zea mays
  misc_feature: Ceres CLONE 1547387
  misc_feature: Encodes the peptide sequence at SEQ ID NO. 69360
aaagctggagctccccgcggtggcggccgctctagaactagtggatcccccgggctgcaggaattcgtctcacccctagaaaaagtcgtcgtcggcggcgagggcggtcgccaggcctggcgccgcggagcagctgcagcggcaccccgtggtgctgatcccgggagcgggcggcaaccagctggaggcgcggctgacggagggctacgagccgtccagcctggtgtgccgggtgtggccactcgtgcgcggccgcggtggctggttccgcctctggttcgacccccccgtgctggtcgcgccgctcaccaggtgcttcgccgaccggatgacgctctcctacgacgccgatgccttcccccccccccaggggggggggggggagaaaaaggtctccaacttccgctccccctccaccctcggctacctcgaaccaaatctgggggggctcggggggtacattgaacctcctggggaggcacccgggaaaaggccggcttccaagaaaggcccctacctgttcggggccgcccaacaacatcccggaacggggcgggccggggcctgggggactccgtccccagggggttgtcctacttccctggccatcccctcccgttgttggtcgcaccccggcta

SEQ ID NO: 69360 - protein, 103 aa, Zea mays
  misc_feature: Ceres CLONE 1547387
MTLSYDADAFPPPQGGGGEKKVSNFRSPSTLGYLEPNLGGLGGYIEPPGEAPGKRPASKKGPYLFGAAQQHPGTGRAGAWGTPSPGGCPTSLAIPSRCWSHPG

SEQ ID NO: 69361 - DNA, 658 bp, Zea mays
  misc_feature: Ceres CLONE 1547389
  misc_feature: Encodes the peptide sequence at SEQ ID NO. 69362
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (393)..(393): n is a, c, t, g, unknown, or other
  misc_feature (394)..(394): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (472)..(472): n is a, c, t, g, unknown, or other
  misc_feature (515)..(515): n is a, c, t, g, unknown, or other
aaaactggagctccccgcggtggcggccgctctagaactagtggatcccccgggctgcaggaattcgtctcacccctagaaaaagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaaagttattgcaatctccgcttgggttatctactaagaagcaaactggtttagttccgccgggttttttgtttccccccccgagagggaagagggggtggnnnttnnccttattttnnnaaaaaacttcttaaaaaaacacactgccggggcctccccagatcctctttgaccttctattttatnagggaaagtaatttatccccaaaaaaagtgcttcctatgttgnaaattggacaagcgttttttttccccctttttgggggaaatttccccgggcctccccattctcccccacatacccagccctaccctgaaaggggattcacctttttaagaaaaagaactttgtggacacccccccacaaagcg

SEQ ID NO: 69362 - protein, 65 aa, Zea mays
  misc_feature: Ceres CLONE 1547389
MAAQGSLVMWRAVFAALGLLMVATLVYTLATDGSPFRLELFTPWMVATLADFYVKVIAISAWVIY

SEQ ID NO: 69363 - DNA, 661 bp, Zea mays
  misc_feature: Ceres CLONE 1547391
  misc_feature: Encodes the peptide sequence at SEQ ID NO. 69364
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
aacagtggagctccccgcggtggcggccgctctagactagtggatccccagggctgcaggaattcctctaacccctagaaaaagcagtctccctcaaccaattagacattggccagcacagcagtgtataggcatagctacgtacgtgggaagtgggaacgatggcactcatcatgcaggaaagtagtagccatgatttgctccaagctcacgacgagctcttgcaccattccctgtgcttcgccaaatcgctcgcgctcgccgtggcgctggacctccgcatccccgacgcgatccaccaccacggcgccggcggctcctctcttctccagatcctcgccaagactgcgctttttttttccccccccccaggggggggggggggggggnnnnttttttcctttctctttcatcttctctaaaaaaaaaaacaccacactcgtgggggggagaattcaaccctcccacacgtacggacaaaaaaaccttgcctcgtcctcccgagttgacgtaaacccccccccttacctctgcctgcaaacaatctgaaccgccgagaaactaggaaccccccttccagaatagtagtggggcccaaaccctatccactccccccggccagctaggcgtcgtggggaacacccgcgccggtccgccaccg

SEQ ID NO: 69364 - protein, 86 aa, Zea mays
  misc_feature: Ceres CLONE 1547391
  misc_feature: SWISSPROT Homolog: EC 2.1.1.146 (Iso)eugenol O-methyltransferase
  misc_feature (77)..(77): Xaa is any aa, unknown, or other
  misc_feature (78)..(78): Xaa is any aa, unknown, or other
MALIMQESSSHDLLQAHDELLHHSLCFAKSLALAVALDLRIPDAIHHHGAGGSSLLQILAKTALFFSPPPGGGGGGXXFSFLFHLL

SEQ ID NO: 69365 - DNA, 689 bp, Zea mays
  misc_feature: Ceres CLONE 1547392
  misc_feature: Encodes the peptide sequence at SEQ ID NO. 69366
ggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgtttcttggccagggtcgcgccgccgccgccgccgccaatgccagccccctccgcgacgtcgccgccgccgctgctggcggccggatcaccatgggcaacgacctgtggtacggcccggaccgcgtcaagtacctgggccccttctccgcccagacgccctcggagctgaccggcgtagtccccggcgactacggctgggacaccgcctggctgtccgcggacccggaggcgttcgcgcggaacacggcgctggaagtgatccaccggcggtgggcgaacctggctgcacctgggctcatcccccccgaaagggcctggaaaattgggtgccccatgaacttcaaggaacccctcgtgggtccaagggccgggcaccccaaaaccctcaccagaagagcgtgtctggaactttccttgggtcaacacccccacctgtgggtaaattcgcaaagaagcccccctcgggcctggccccgg

SEQ ID NO: 69366 - protein, 177 aa, Zea mays
  misc_feature: Ceres CLONE 1547392
MASTIMAATSRIVAAKTPFLGQGRAAAAAANASPLRDVAAAAAGGRITMGNDLWYGPDRVKYLGPFSAQTPSELTGVVPGDYGWDTAWLSADPEAFARNTALEVIHRRWANLAAPGLIPPERAWKIGCPMNFKEPLVGPRAGHPKTLTRRACLELSLGQHPHLWVNSQRSPPRAWPR

SEQ ID NO: 69367 - DNA, 679 bp, Zea mays
  misc_feature: Ceres CLONE 1547396
  misc_feature: Translation starting site: 164
ggagctccccgcggtggcggccgctctagaactagtggatcccccgggctgcaggaattcgtctcacccctagaaaaaagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttccgcaaggcgcagtgcccgatcgtcgagcgcctcacaaagggcgcgcatgatgcacgggcgcaacaacggcaacaacgccatgggctgtccgcatcatcaagcataccctggagatcatccacctgctcaccgatgccaaccccatccaggttcgtcgtcgacgcgatcatcaaccgtggacccccgggaggatgccaccccgaattggttcccgcgggagttgtgaggaggcaggccctggaatatctcaccccttgaaggagggggaaccagggccatctacctccctccccactggttggccaggaaaatagctttcccgaaacatcaaaacccttggcccaaggg

SEQ ID NO: 69368 - DNA, 653 bp, Zea mays
  misc_feature: Ceres CLONE 1547399
  misc_feature: Encodes the peptide sequence at SEQ ID NO. 69369
aaagctggagctccccgcggtggcggccgctctagaactagtggatcccccgggctgcaggaattcccctaacccctagaaaaagcttcccctcttctccattccattgcgaatcttcgagcccctacctccctgtggtgcttggacatggcggactaccacttcttgtataaggacgtggagggggcgagcacagagtgggacgacatccagcgccgcctggggaacttgcccccgaagccggagcccttcaagccgccgcccttcgcccctaaggttgacgccgacgagcagcccaagtccaaggaatggcttgacgtgcgcgagcccgaagagctcgaggaactagaggacgatctggatgacgaccgcttccccgagaagtacaggaagatgaggctcgtacagctgagggaagccgcagaagccgcgcgattttgtacgatactttcccatgctgggatacgacttcgtggggcaaagtatcgcgaggcacatacaacatgtttcgagttgttggcctctcctctaccacggatggggaaacccgaaatgggggaattggttccggaacctgcgagggaaaacaatccgccctgcgccggcattccaggctattataatttctttttataaacgtatcttcccaaccg

SEQ ID NO: 69369 - protein, 162 aa, Zea mays
  misc_feature: Ceres CLONE 1547399
MADYHFLYKDVEGASTEWDDIQRRLGNLPPKPEPFKPPPFAPKVDADEQPKSKEWLDVREPEELEELEDDLDDDRFPEKYRKMRLVQLREAAEAARFCTILSHAGIRLRGAKYREAHTTCFELLASPLPRMGKPEMGELVPEPARENNPPCAGIPGYYNFFL

SEQ ID NO: 69370 - DNA, 693 bp, Zea mays
  misc_feature: Ceres CLONE 1547405
  misc_feature: Encodes the peptide sequence at SEQ ID NO. 69371
ggagctcaccgcggtggcggccgctctataactagtggatcccccgggctgcaggaattcgtctcacccctagaaaaaataaaaccctactaaccgcgtctcctctccagcgcccgccgtcgccgccgccctcctcttggtcccgccgtccgtcgaggtcatcatggtgagggtcagtgtgctcaacgatgcgctcaagtccatgtacaatgcagagaagaggggcaagaggcaggtcatgatcaggccgtcgtccaaggtgatcatcaagttcctgacggtcatgcagcgtcatggatacattggcgagttcgagtacgtggatgaccacagagctgggaagattgtggtggaactgaacggcagactaaacaaatgcggtgtaattagcccccggtttgatgttggggtaaaggaaatcgaaggctggactgcgaggctgcttccgtctcgccagtttggctatatcgtgcttacaacctctgcgggaattatggatcacgaggaggcccgacgcatgaacgtcggaggcaaagtccttggtttcttttattaattaaagggtcgtcccgaattttcttcctatcaaatgagcgggctcgacccgaattttctggtctattgattttttgggtctagcaatttgaaaaaaccagaggttttgcccttccctttaaaagaacttggagaaat

SEQ ID NO: 69371 - protein, 130 aa, Zea mays
  misc_feature: Ceres CLONE 1547405
  misc_feature (5)..(130): Pfam Name: Ribosomal_S8 Pfam Description: Ribosomal protein S8
MVRVSVLNDALKSMYNAEKRGKRQVMIRPSSKVIIKFLTVMQRHGYIGEFEYVDDHRAGKIVVELNGRLNKCGVISPRFDVGVKEIEGWTARLLPSRQFGYIVLTTSAGIMDHEEARRMNVGGKVLGFFY

SEQ ID NO: 69372 - DNA, 656 bp, Zea mays
  misc_feature: Ceres CLONE 1547406
  misc_feature: Translation starting site: 525
  misc_feature: SWISSPROT Homolog: EC 1.1.1.2 Alcohol dehydrogenase (NADP(+))
ggagctcccctaggtggcggccgctctagaactagtggatcccccgggctgcaggaattcgtctcacccctagaaaaaagggctcggcacctacaaggccggacccggcgtcgtcgccgacgcgatcaccgccgccgtcaaggccgggtaccggcacatcgactgcgcgccgctatacaagaacgagaaggagatcggcgttgctctgagcaagctatttgatgacggcgtcgtcaagcgagaagaccttttcatcacttcaaagatatggtgcagcgatctcgcacctgaagacgtgccgttggcgatcgacagcaccctgaatgatctgcagctggattatcttgacctgtacctggtaacctgaatatgtacactgcaagagccaacagaccccatttctttgctactagcctactactactcctactaagtgataacctccgggaccttcgtagatacactggcccttccagataaagagaggcagcgagctcagtccagagaacttcgtccacctcgacatgcccaagacctggcaggcaatggagaaactgtacggctcaggcaaagcccgcgcggtaggcgtcagcaatttctcgaccaggaagctggccgatctgcttgccgtagcccgtgtccctccagccgttgat

SEQ ID NO: 69373 - DNA, 638 bp, Zea mays
  misc_feature: Ceres CLONE 1547415
  misc_feature (499)..(499): n is a, c, t, g, unknown, or other
aagctggagctccccgcggtggcggccgctctagaactagtggatcccccgggctgcaggaattcgtctcacccctagaaaaacccctttcctgcccctccccctccgcctttcctctctcacgctctcctcgtctcctctcctctcctgtccttccgcatcacacaccacgactccgaagcggcggttggatttggtgctccgagctcttcctcttccacacccgacatctctcttgggtcgacggcctactgtctgcgtcgtccacggagatcaaggaacccccccggaaatatagggagagagtcgacgggagataaagacgagagagagcgcagcggcccgacacggcacattctccaagcgacgacgcgaccacttctgcaagagggacgacctctgcgtagcatgtgcgatgccgaagtcacactcatagtcttctcatccaggggaaaactctcacacttcgccaactcccgtatgaatagagagcattcancagctcagcacactgtctaaacaaactgtggtaaagcagagcagccttcgatatgacttggagctcacaacatatctgaaatgcaaattccagtgaacagattgtgaaaacccagccttacactgcatgcagatgaaag

SEQ ID NO: 69374 - DNA, 671 bp, Zea mays
  misc_feature: Ceres CLONE 1547416
  misc_feature: Encodes the peptide sequence at SEQ ID NO. 69375
  misc_feature (527)..(527): n is a, c, t, g, unknown, or other
tagctggagctccccgcggtggcggccgctctagaactagtggatcccccgggctgcaggaattcgtctcacccctagaaaaatatggacgtgttgatgtcacagcagctgaacagtgtccgcccgaggggaggcttcctgatgctggcccacgtgatcctgctgaacaccttagggaggtattttatagaatgggccttgatgacaaggaaattgttgcactatctggagcacacacacttggaagagcaaggcctgaccggagtggctggggaaagctagaaacaaaatatactaaggatgggcctggtgagcctggagggcaatcatggacagttgagtggttgaagtttgataatagttacttcaaggacatgaagtttttgagccagcttccctggaaagagcacaacgaacaggatcttctagttttgcctacagatgctgcattatttgagaacccatcgttcaaggtatacgcagaaaagtatgcagatgacctagaatcgttctttaaagactatggngaagctcatgctaagctgagcgatcttggtgcaaaggttgatccccctgaaggattcccactccacgatgacacaatctctttcccttccgacgagaagaccggaaaaacctcccctggtagcgggtaggagccccagctaccg

SEQ ID NO: 69375 - protein, 217 aa, Zea mays
  misc_feature: Ceres CLONE 1547416
  misc_feature (1)..(166): Pfam Name: peroxidase Pfam Description: Peroxidase
  misc_feature: SWISSPROT Homolog: EC 1.11.1.11 L-ascorbate peroxidase
AGAPRGGGRSRTSGSPGLQEFVSPLEKYGRVDVTAAEQCPPEGRLPDAGPRDPAEHLREVFYRMGLDDKEIVALSGAHTLGRARPDRSGWGKLETKYTKDGPGEPGGQSWTVEWLKFDNSYFKDMKFLSQLPWKEHNEQDLLVLPTDAALFENPSFKVYAEKYADDLESFFKDYGEAHAKLSDLGAKVDPPEGFPLHDDTISFPSDEKTGKTSPGSG

SEQ ID NO: 69376 - DNA, 649 bp, Zea mays
  misc_feature: Ceres CLONE 1547418
  misc_feature: Encodes the peptide sequence at SEQ ID NO. 69377
  misc_feature (396)..(396): n is a, c, t, g, unknown, or other
  misc_feature (398)..(398): n is a, c, t, g, unknown, or other
cacaactggagctccccgcggtggcggccgctctagaactagtggatcccccgggctgcaggaattcgtctcacccctagaaaaactctccctttccgagggccgccgcatccactccgtcccccgcctcgcagtgcctccccaccgccctccgcgcccggtaggcgacgtcccgttccagatccaagactcaaacaaaccagtacattaccaccatggttcttgattcattatcatcacctcacaggaggtcccaaaacacattcttcgtgtcatctgcaaaaaagcctcagtcatctcgtgacgacagttggtctgcactggttgacccaccccggtttctcctgacaacactccttgttcttgcccccctgagggaggggaggggtactttgnantaaccttgggggcatcaaatgcttgcactggattggaaggagcagagaggattgagcgccccgcaagatctgtgctggcacatggaaaagttaaattccccagaactttggaagacccattgatgaaaaccaattttttgagctttataacccctcccggcccatgaaaaaatctctggataccatgtatctggatattgggggggggggccagatgttatttgacccccaaaaatttctctggaacggga

SEQ ID NO: 69377 - protein, 60 aa, Zea mays
  misc_feature: Ceres CLONE 1547418
MVLDSLSSPHRRSQNTFFVSSAKKPQSSRDDSWSALVDPPRFLLTTLLVLAPLREGRGTL

SEQ ID NO: 69378 - DNA, 735 bp, Zea mays
  misc_feature: Ceres CLONE 1547429
  misc_feature: Encodes the peptide sequence at SEQ ID NO. 69379
  misc_feature (31)..(31): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (48)..(48): n is a, c, t, g, unknown, or other
gttgtgttttgttgtggttttttatataaannaannnngccgcccttncttcatagctgggactccacgcggtggcggccgctctagaactagtggatcccccgggctgcaggaattcgtctcacccctagaaaaaacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgccggcgagcagcattacttcaccgacaccaccaccctcttcatcatcgagctcatcctcatcggctgggccgagggccgccgctgggctgaacatcgtcaaagcccgtaagcgtcaacatccgacccccatcctccccaagcaacaagctcaacgggcacccgaacttcagg

SEQ ID NO: 69379 - protein, 166 aa, Zea mays
  misc_feature: Ceres CLONE 1547429
  misc_feature (63)..(164): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTAGEQHYFTDTTTLFIIELILIGWAEGRRWAEHRQSP

SEQ ID NO: 69380 - DNA, 663 bp, Zea mays
  misc_feature: Ceres CLONE 1547443
  misc_feature: Encodes the peptide sequence at SEQ ID NO. 69381
  misc_feature (663)..(663): n is a, c, t, g, unknown, or other
aaagctggagctccccgcggtggcggccgctctagaactagtggatcccccgggctgcaggaattcgtctcacccctagaaaaaatggtggtccaagcaaaggctgggactttttttccgcccttcctgctttccctcttttctgtttttgttttgtttctgaattggggaggagagaattgatatggtcggagtgttgatcgattgcaggtgttcatcaacgtgccgtggtggtacctggcggcaaacaaggtgatgagcccattcctgactcagcgcaccaagagcaagatcgtcttctgcagccccggcaagtcggcggagaccctcttcaggtacatcgccccggagcaagtccccgtccagttcggcggcctgtacaaggaggacgacaccgagttctccacctccgacgccgtcaccgagctcaccgtgaaaccgtcctccaaggagaccgtcgagatcccagccaccgagaactccaccgtggtgtgggagctccgcgtgctggggtgggatgtgagctacggcgccgagttcacccccgacgcggagggcggctacaccgtcatcgtgcagaagacgcggaaggtccccgcccacgaggagcccatcatgaagggcagcttcaaggccaccgagcccggcaagctggtgctgggn

SEQ ID NO: 69381 - protein, 136 aa, Zea mays
  misc_feature: Ceres CLONE 1547443
MSPFLTQRTKSKIVFCSPGKSAETLFRYIAPEQVPVQFGGLYKEDDTEFSTSDAVTELTVKPSSKETVEIPATENSTVVWELRVLGWDVSYGAEFTPDAEGGYTVIVQKTRKVPAHEEPIMKGSFKATEPGKLVLG

SEQ ID NO: 69382 - DNA, 688 bp, Zea mays
  misc_feature: Ceres CLONE 1547444
  misc_feature: Encodes the peptide sequence at SEQ ID NO. 69383
ggagctccccgcggtggcggccgctctagaactagtggatcccccgggctgcaggaattcgtctcacccctagaaaaacagacccccgcccacgaccacacgcagcaagcagcagccgcgcgctcgcctaggactaccgactacgagtagtgctcagctagcctccatcctcagcgggcggccggcacatatggcagcgcagtccatgctcatgtcgaccagcgtcaacggcggccgcgcgctgccgtctcttcaggccgtccggccggctccatacccgcggctaccgctgccgtcgtcgtcatcctcgtcaggctacaagcactccaaggccgtctccgtgaagacgctcgccctgttcggcaaatccaaggtcaagaccgcgcccggcgaaaaaggcatcgcctacttggagaggccattaacggggaaaggcatcctttgcccagctgaaccttggaaaagggcatccccctttttagaagggggaaccccccccctccgggttcttcatccctcttcacccccccttggggggccttcgggggctcctcggggaaccccgggccccctttcttttaaaaaagaaagggccccccgggccttcaaaaaagggccgttttttccaaaacccgggaaagggggttttccccggggggggcctcttcgggccttaagcgaaggggag

SEQ ID NO: 69383 - protein, 166 aa, Zea mays
  misc_feature: Ceres CLONE 1547444
MAAQSMLMSTSVNGGRALPSLQAVRPAPYPRLPLPSSSSSSGYKHSKAVSVKTLALFGKSKVKTAPGEKGIAYLERPLTGKGILCPAEPWKRASPFLEGGTPPLRVLHPSSPPLGGPSGAPRGTPGPLSFKKERAPRAFKKGPFFPKPGKGGFPRGGPLRALSEGE

SEQ ID NO: 69384 - DNA, 658 bp, Zea mays
  misc_feature: Ceres CLONE 1547448
  misc_feature: Encodes the peptide sequence at SEQ ID NO. 69385
tccccgcggtggcggccgctctagaactagtggatcccccgggctgcaggaattcgtctcacccctagaaaaactcttactacagatgagcttctggccagcggccatggcgagcgacgacatcacggtgcacgtggaaagcctggcgcgccgcctgacgcagcagcaggaggacgcggcggcgacggagcagcaccggatcatggtgaatgccctccgcgtgtcccgcgtccccgaccacgtccgcgtgcacaacgaggacgcatacagaccgggcctcgtcgccatcggcccgctccacgccgcagacaagcgacttcgcgccggctaccggctcaagatggcctatctccacagcctcatctcccgcggccactcggaccccgcgcgccacctcgccgtcatcgagggttacatccgcctcgtcgccgcgcgcgagcgggaggcccgcgccatgtacgccgccgaggacgtggatatcagcgccgaggatttcatccagatgcttgtcctcgatggctgcttcatcatcgaacacctcgttaacgtcgccgcgtcagtggaggaggcgtcgctgtacgccacgccgttcggacccgcgcagctgtccatcgacctcgtcctcgccgagaaccagatcccgttcttcgtcctcgtc

SEQ ID NO: 69385 - protein, 184 aa, Zea mays
  misc_feature: Ceres CLONE 1547448
MASDDITVHVESLARRLTQQQEDAAATEQHRIMVNALRVSRVPDHVRVHNEDAYRPGLVAIGPLHAADKRLRAGYRLKMAYLHSLISRGHSDPARHLAVIEGYIRLVAAREREARAMYAAEDVDISAEDFIQMLVLDGCFIIEHLVNVAASVEEASLYATPFGPAQLSIDLVLAENQIPFFVLV

SEQ ID NO: 69386 - DNA, 762 bp, Zea mays
  misc_feature: Ceres CLONE 1547453
  misc_feature: Encodes the peptide sequence at SEQ ID NO. 69387
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (422)..(422): n is a, c, t, g, unknown, or other
  misc_feature (430)..(430): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (442)..(442): n is a, c, t, g, unknown, or other
  misc_feature (446)..(446): n is a, c, t, g, unknown, or other
  misc_feature (606)..(606): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (626)..(626): n is a, c, t, g, unknown, or other
  misc_feature (762)..(762): n is a, c, t, g, unknown, or other
caaaagctggagctccccgcggtggcggccgctctagaactagtggatcccccgggctgcaggaattcgtctcacccctagaaaaaaagggacgggagaggaacccgaggaaggcgaaaatgatctaccgcaactggtcgctgctctcgtccacagtcgtcatttggggcggcgtcgccaccgccggcctcgccggtatcttcctcttgggcggcaaggagaaattcaatggttatcgtnnnnnggcccctgaaggcgagaggcttacgcagcaggacagagcctcgatgggcctgaagctaagacgttagcctatctttggtaatccccaaggggggagtcaaaaggcccctttcaaaatttccacaaaaattcccccgggtttcttttttcccccaaccaattccccttagtggaggggngaaaaatnatattnnnnntncttntccccccttatctcggcaaagaggcgtttttacccccttttttctctaggtgggagaggactaaattccctggcgctcacacaacacaaaacacaatcatttccagggcgagaaggagtccttgttttacgtcgccctccagaccccaagcctaacacanaatagtagattttnnnnctncgagacgcctacgacatatacgtaggcccccatatcccgccaagtccgagtagacataagtctacatatagactaactgtatggattatatcatacccctcatcacaatccattctaccccctttaccctctgcan

SEQ ID NO: 69387 - protein, 63 aa, Zea mays
  misc_feature: Ceres CLONE 1547453
  misc_feature (41)..(41): Xaa is any aa, unknown, or other
  misc_feature (42)..(42): Xaa is any aa, unknown, or other
MIYRNWSLLSSTVVIWGGVATAGLAGIFLLGGKEKFNGYRXXAPEGERLTQQDRASMGLKLRR

SEQ ID NO: 69388 - DNA, 703 bp, Zea mays
  misc_feature: Ceres CLONE 1547455
  misc_feature (8)..(8): n is a, c, t, g, unknown, or other
  misc_feature (21)..(21): n is a, c, t, g, unknown, or other
  misc_feature (22)..(22): n is a, c, t, g, unknown, or other
  misc_feature (57)..(57): n is a, c, t, g, unknown, or other
  misc_feature (193)..(193): n is a, c, t, g, unknown, or other
ataagctnggagctccaccgnncggtggcggccgctctagaactagtggatcccccngggctgcaggaattcgtctcacccctagaaaaaatccatccagactgcgatcagagcagcgagagagagagagagagagagagcaactgagcaagcaagcaaggaagcaagcaagcaatcggagcgatggagcacngggtacccctgcaacggctgcggcaaggagaagcggccgccgctcaagagggccagctcaagctgcagatcgccaggaccctgctcggcagcctcgcggcgccggtcgccaagaaaccgggaaccgtggcctttccgggaaaaatagggcccccccccctttccccgggtaaccgggaataaaatattaccttccttaaagaaattccctccggccaaagtgggggggaaattttcccccccttaaaaaaaaaggaaaaagctttttgtcttttccccccccctttttttttttttttttaaaaaaaaaaaaggcgggtgttggggctctaaaaaaaaaaaaaaaaaaaaaaccggcccacccccggggaaacccccaattccccccccaaaagtgggggggggatttttttgccccccccccctcgggggggggtttttttttaaaacaccccggcggggggggaaaaaaaaaacccgcgggttacaccccccaaaaaattaatcccgc

SEQ ID NO: 69389 - DNA, 747 bp, Zea mays
  misc_feature: Ceres CLONE 1547457
gctctagaactagtggatcccccgggctgcaggaattcgtctcacccctagaaaaaaaactttagcaaaggatctaacattgaaggagctatacagtatacaaagcaggttggctcaggagaaagctagagaaacaacataccgacaaagattccaaataccagaacttcaaggcctcatccaggagcagaatcccccaatcgatctctgtggtcttcacatcagcgaggccatgcacgtcctgaactacgagctcaacaaccgaagaaagatcgtgagatccactggtcgccgactccaggctatgatcatatcaagcgcccgcaccccagcaaggctgactgctgccgtcgagcagtacctcatggaacacggccttccccccccacgggggggcaacccaggcctcttccgcgtcctggctctagggaatggagccggccctagctggttgtcccgaagacgaaaaaagaaaaaaaaaacccggacgcttcaaggtaccccaattcgccccaatagtgaggctgtatttacgcgcctctctctgggaccgtccgttttactacagtcctgcaggggagaaaaaccttggggtttaccgcacgttaatcggtctgggcagcgactcccccatgtactcaaggcttggcgggaaacaccgaaaagggtcccgagagggactcgcccatccccaaaaggtacgtccagccttaagtggcgcaggttggaatatttgtcattgttgca

SEQ ID NO: 69390 - DNA, 751 bp, Zea mays
  misc_feature: Ceres CLONE 1547459
  misc_feature: Encodes the peptide sequence at SEQ ID NO. 69391
  misc_feature (359)..(359): n is a, c, t, g, unknown, or other
aagctggagctccccgcggtggcggccgctctagaactagtggatcccccgggctgcaggaattcgtctcacccctagaaaaaaagtacgggtgcggccacgagttctggatctgcctcctcctcaccttcctcggctacatccccggcatcatctacgccatctacgccatcaccaagaacaactagctagtcatccttgccgacgacgatccatgtctctgtatctgcgtctgttcatatgcctgatgccgacttgtgctgtatgtagttgcttgaattcagtcgtgttttgctaccgtacccaccccatgcatcatctgtcaccgcgacgcaataatcatagtaataacaagttcngagaaaaaaaagcaacacaccgaaaaacacttcccaaaaaatacaaaaacaaaaaaccacaaaagaaaaatagaaagcaaaaaaaataaagtaaaaattcgcgttgaaattcccctaaaaaaaaaaaaaaccgggccccccgggggccccaatcccccccaagggggaggaaataaccccgccccccgggcggggttttaaacacgcccggggctgggaaaaacagtggggttcccacaaatataggcccttaaagaaaaaccccctttttaaccgggggggtaaaaaaagaaaaaaggcccaaaaaaatacctctttcaaaaaattttctcccccctcaagggggaaaagaaaaaattaaaaccctaaaattttttgtgaaaaccccgcgt

SEQ ID NO: 69391 - protein, 61 aa, Zea mays
  misc_feature: Ceres CLONE 1547459
  misc_feature (28)..(59): Pfam Name: UPF0057 Pfam Description: Uncharacterized protein family UPF0057
AGAPRGGGRSRTSGSPGLQEFVSPLEKKYGCGHEFWICLLLTFLGYIPGIIYAIYAITKNN

SEQ ID NO: 69392 - DNA, 790 bp, Zea mays
  misc_feature: Ceres CLONE 1547467
  misc_feature (12)..(12): n is a, c, t, g, unknown, or other
  misc_feature (17)..(17): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tgttgttttctntcctnttatctcttaccaccnnnnnggggtatnnnnnagaacactggactccacgcggtggcggccgctcttttcttctctatcccccgggctgcaagaattcctctcacccctagaaaaatcagtcatcacccaccgcctccgccgccgacaacagcgtagtatagtgtagttccggagagggttggggagagtattactgatccgcagtgtctaccgaggacgctgttgtggctgaggtcccggtgaccgatgtgcccgcggaggtcccggcggcccacgtggccgaagcgcccaacgcgaaaaaggcgcccaacgagaaaaaggcgcctaaggagaaaaaattttccgcggctaataattcgggcggcgcctcctccctaccccccaaattattttttttcccccccccccggggggggggaggagggggaaatctcttcttcctcctttctccccaccccccactttcctttttaatgagaaaaccatggcccgcccacgccccctgggctgtttttccccacaactcgcatcccccgtttttcttcttataaatgggttgccctcttcccacgtccaagtcggacgtagcgcgcgattttatttacgacctctgacaagcctgtagcaccatcttcccctacatcacagtccgcacaaacttactttcactatcttatattattgaggaatcaatacacatctacttcttatccctcgaggctcccccaacctttcatccccttttcttactcacctccccggtccttctccg

SEQ ID NO: 69393 - DNA, 640 bp, Zea mays
  misc_feature: Ceres CLONE 1547470
  misc_feature: Encodes the peptide sequence at SEQ ID NO. 69394
aaagctggagctccccgcggtggcggccgctctagaactagtggatcccccgggctgcaggaattcgtctcacccctagaaaaaactcccacaccacgctcgagacgagagccagctctcccagcacacgagcacatggcgtccaccaccctcctcgctgtcttcctgctcgtggctgcgtccgcagcgccggcgcggtcttgctcacctcgcgacctgcaggcgctgttgagcgtgaagcaggcgctagggaacccggcaacgctgtcgacgtggaccccagcgtcgcccgactgctgctcgtgggaccacctccggtgtaacgacgccggacgcgtgaacaacgtgttcatcgacggcgcggacgacgtgcgcgggcaaatcccgtcggcggtgggcgggctgacggagctcatgtcgctgaccctgttccggctggcggggctgacgggccccatcccggcctgcctggccgcgctgtccaacctgcagttcctgaccgtctcccacaccaacgtgtccggcgccatcccggagtccctggcgcggctgcccggcctcgactcggtggacctctccagcaaccagctgacgggcggcatcccggcgtctttcgccgacctggccagcctccggtcgc

SEQ ID NO: 69394 - protein, 168 aa, Zea mays
  misc_feature: Ceres CLONE 1547470
  misc_feature (24)..(63): Pfam Name: LRRNT_2 Pfam Description: Leucine rich repeat N-terminal domain
  misc_feature: SWISSPROT Homolog: EC 2.7.11.1 Non-specific serine/threonine protein kinase
MASTTLLAVFLLVAASAAPARSCSPRDLQALLSVKQALGNPATLSTWTPASPDCCSWDHLRCNDAGRVNNVFIDGADDVRGQIPSAVGGLTELMSLTLFRLAGLTGPIPACLAALSNLQFLTVSHTNVSGAIPESLARLPGLDSVDLSSNQLTGGIPASFADLASLRS

SEQ ID NO: 69395 - DNA, 860 bp, Zea mays
  misc_feature: Ceres CLONE 1547471
  misc_feature: Encodes the peptide sequence at SEQ ID NO. 69396
  misc_feature (6)..(6): n is a, c, t, g, unknown, or other
  misc_feature (26)..(26): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (37)..(37): n is a, c, t, g, unknown, or other
  misc_feature (38)..(38): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (52)..(52): n is a, c, t, g, unknown, or other
  misc_feature (81)..(81): n is a, c, t, g, unknown, or other
  misc_feature (109)..(109): n is a, c, t, g, unknown, or other
  misc_feature (143)..(143): n is a, c, t, g, unknown, or other
  misc_feature (144)..(144): n is a, c, t, g, unknown, or other
gttggntgcttccgccccctttggtnggnnnnagggnngcgggcnnnnnnanaaatatggagtccacgcggtgggggaagnattcttccatctccatcccccgggctgnaggttttcctctcacccctagaaaaaaagagggnnagagcccgatcccgatccagcgaggtggctaccctccctcctccccttgcttcgctcgtccagccctgaccacccgcatccccgtcagtcatggcagcggcagcaggcggaggcgcggtgcgtgcgctgtcccccaaggaggcggacatacagatgatgctcggcgccgacgacagccttgacgcctttgactgcgatttccagaaggggggggattggcggtccagatctgttaccaagcgggctgagtccgttcgtgctttgtttattttttttgctgccaaccggggggggggggggggggggcattatctgtttgtttttttttcatccccccccccctacaccataccacgcgagatggggtcgcggtcgatattgcgtcacgagccgctctgtttgattcagtttatatgcgagtaaaatgggtgcggacctttcgtggtggttgtgccgggtggtttagggtggcggctcgtcgggtgcaatcttattattgcatatcattactacatcgcttagtgaaaacggaatggaggattgcttgactcggcgggagggggtgtgtttccggcgtgttactctcaaaggatcatttacctcgggcacgattctctgtgatgatgttgcggtggcgtcgtgctgggggagggtgtgtgtgtggtgctccgtcgccctctgtcgtgcgagggggaggcagtgcgtgattggccgtg

SEQ ID NO: 69396 - protein, 110 aa, Zea mays
  misc_feature: Ceres CLONE 1547471
MAAAAGGGAVRALSPKEADIQMMLGADDSLDAFDCDFQKGGDWRSRSVTKRAESVRALFIFFAANRGGGGGGHYLFVFFSSPPPYTIPREMGSRSILRHEPLCLIQFICE

SEQ ID NO: 69397 - DNA, 736 bp, Zea mays
  misc_feature: Ceres CLONE 1547474
  misc_feature: SWISSPROT Homolog: EC 3.2.1.23 Beta-galactosidase
aaagctggagctccccgcggtggcggccgctctagaactagtggatcccccgggctgcaggaattcgtctcacccctagaaaaaaaaatgctgattcatcatatttgagtgcaaagtttacagagaaaactggcggctcaacttatgaaagcaaaaggaactcatgggggcgtacttcagcaagaaaaggcttgtcaacagaggaggctggctgttgcagtgataatgacgaggctcatattgcgaagcttgaaaacaagaagacccatctccaatctaaacttacggaggaggtaaaagaaaacacagtcctccaggcaaatttagaaaggcgaaaagcagcactacatgagcgtcgtgtagcacttgaaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaaattcgcgttaatttttgttaaatcagctcatttttttaaccaataggccgaaatcggcaaaatcccttataaatcaaaagaatagaccgagatagggttgagtgttgtt

SEQ ID NO: 69398 - DNA, 701 bp, Zea mays
  misc_feature: Ceres CLONE 1547475
  misc_feature: Encodes the peptide sequence at SEQ ID NO. 69399
  misc_feature (701)..(701): n is a, c, t, g, unknown, or other
aaagctggagctccccgcggtggcggccgctctagaactagtggatcccccgggctgcaggaattcgtctcacccctagaaaaagggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcggttttcttcgtggtcatgggaaggaactccccagggagtctcggggcagaaaaaccctttagaacaaagtctgtccactacgggtgagggaaaagctgctggacgacaaggtgcaaaatccctataccgaggtcaggacaaggctcccctatgttcggctcaggctcaatacttcttctagcttcgtctaacacgatggtccatctcttggctttcaacccaggggcgtagcgcccccgcccccctcaacaaggacaccgtgacatttgtggttttgtttcttcgaatcagggtgtagtcaggcctgtttcagggcccctatcccaaacgtgccaccgtccccgccccccccccaccccn

SEQ ID NO: 69399 - protein, 66 aa, Zea mays
  misc_feature: Ceres CLONE 1547475
MKGAKSKGAAKADAKLAVKSKGAEKPAKGRKGKAGKDPNKPKRAPSGFLRGHGKELPRESRGRKTL

SEQ ID NO: 69400 - DNA, 856 bp, Zea mays
  misc_feature: Ceres CLONE 1547481
  misc_feature (856)..(856): n is a, c, t, g, unknown, or other
actttttctttctataagcaggggttagtatttcaattaatcttatcataactggagctccccgcggtggcggccgctctataactagtggatcccccgggctgcaggaattcgtctcacccctagaaaaactgtaaaatagttcgttacctacaagcatgatgcatatattgaccaaggtaattaataggagagggttgctgttaccctggtgggattgtgggatgtacaaattgttgctgggctttgctttctttttttttaacttttcctcccaaggaattttttaagagggctgggttctgcaaaggatttgtttaggctattagttagctatgtagcagaaaactagagaatgctacacgttggacgtgttttttttcacgtatattgttgtaccacatggtattttttatcttccgcatgaaattggatgtacctagcatagtttaggtggggcccccatacgtgtcgaggtacccaagttcaccctatactgagtcgtaatataacagatctcactaggccgcaacttttaacagcgttcatgaactggggaaaaacccttggccgttacctcacctttaattctaccttggcagcgaaatcccccctgtttcaccaaggttgggcgttaataatgctaaagagatttccatgacccgattatgaaaattgcctaacatattttcctcaatgcctggaaaggaggtaaagggcatattcgtaacgcatatgaataatttttcctagaaacattcaaccctctaaattctttagtgtaatacgagcacctcatattgtctttacaccacacacaactccataaatatcacccgaaaattctccatgaacn

SEQ ID NO: 69401 - DNA, 674 bp, Zea mays
  misc_feature: Ceres CLONE 1547490
  misc_feature: SWISSPROT Homolog: EC 3.2.1.23 Beta-galactosidase
  misc_feature (131)..(131): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
agagctggagctccccgcggtggcggccgctctagaactagtggatcccccgggctgcaggaattcgtctcacccctagagtttctggtgttattgacgctgtgagccgagatgcgatgcaatttttttcntggttctgggagcgtgcgagtttgggctacatggactgagtagctctgtgtatttttcttgcatcgcagcttagtgggaatggattactgcgtcgtattgtggacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaaataacccaaaaagggcccgcaccgaattgccctttccccaacagttgccccagcccttgaaaagggggccaaaaaagggggggaannnnaagttggggaggggggaaaattttgttaaaaaaccccgcgaaaatttttttgaaaaaaccccccttttttttttttaaaaggggggggagaggggggggaaccctcctttttatttaaaaaaaaaaaaaccccccccgggggggggggggggggtggctccctctttttaaaaaaaaaacac

SEQ ID NO: 69402 - DNA, 813 bp, Zea mays
  misc_feature: Ceres CLONE 1547512
  misc_feature (20)..(20): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
ggttggttgtcccggggccnattaatttaatttnnnnnnggggaaannnnaaaggctggggctccccgcggtggcggccgctctagaactagtggatcccccgggctgcaggaattcgtctcacccctagaaaaaagcggcagcgcccttcccagtctcagatccgcgtcgtcgcggcccctcccccctctcccgtgcgctgcgcccccaattcccgctccccacgcacccagagacacgccgagcgggagaggaagcgacagcccgctcccgaggcggcccgcgccagcgcaggcctgaccactcccactcccagtggcgacgggtcgcccccgggctcccccgacggggtggccccctcctccgccgagaggattccccgcccccgatcaccccccctcgcctatgaggatttttttccccccccccgggggggggggggggggggggctcctctttaatttctcccctttgcccccccccggcctcgaaatctggcggccattccccccggccccccgtcgcggtgcttgctcggcgcccttgtgtaatggcctgtctccctgccttctctgaccggccggcttccgccctccccccccccctcgtctgagggggggcgggcgggttgggcgtgtaccagcgcccggccatcatccctaccggaccgtcgcgcggtcgccccctccactacacgcccaacgcccgtcaccttaacaccgatatcccacgcagtgtgggcgcgggccggatgcctggtgggtcggtgtgccgtgggtgccattgttctttttatcgcggcggctccttttc

SEQ ID NO: 69403 - DNA, 731 bp, Zea mays
  misc_feature: Ceres CLONE 1547514
  misc_feature: SWISSPROT Homolog: EC 3.2.1.23 Beta-galactosidase
gatagctggagctccccgcggtggcggccgctctagaactagtggatcccccgggctgcaggaattcgtctcacccctataaaaattcttctctccgtttactcttttccctgttcgtagctttgagttttaatttttgttttttggtggacggattgttccggggaggtccaggttgggatctaaatttattttcaatcggtggagatccatctatctatcagccgcagcagcaggagcaaccatgttttctctccaacaatacattggaattgaattcctaacgggcagattggatccttagaattgaattttattctaataatattaatttagacaaaggtcttttaaactaaaaaaaaaaaaaaaaacgagacgctcgaggtacccaattcgccctatagtagagtcgtattacgcgcgctcactggccgtcgttttacaacgtcatgactggtaaaaccctggcgttacccaacttaatcgccttgcagcacatccccctttcgccagctggcgtaatatcgaagaggcccgcaccgatcgcccttcccaacagttgcgcagcctgaatggcgaatggaaattgtaagcgttaatattttgttaaaattcgcgttaaatttttgttagatcagctcatttttttgagcaatagagccgaaatcggggaaatcccttataaatcaaaagcatagacctgagataggggttgagtgttgctacgagtt

SEQ ID NO: 69404 - DNA, 713 bp, Zea mays
  misc_feature: Ceres CLONE 1547525
  misc_feature: Encodes the peptide sequence at SEQ ID NO. 69405
atagctggagctccccgcggtggcggccgctctagaactagtggatcccccgggctgcaggaattcgtctcacccctagaaaaaatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacgggtgggacggcgcgggcctttcggcggacccggacaccttccccaagaaccgggaagctggaagtcatccactccccgctgggccatgcctgggcgcgttggggcctgcgtgttccccggagctgcttcgcccgctaacggcgtcaaggttcggcagaggccgtagcgagttcaaggcccaggtccccaaatattccacgccagggtggggctggaattactctccggccaacccgaagctttgtatcaactccgaaaaaagagacccttcgcccattctgggccctggccagtgtaccgtggctaccaaaggcagaccattcgtaagcggtcacccc

SEQ ID NO: 69405 - protein, 190 aa, Zea mays
  misc_feature: Ceres CLONE 1547525
MASSTMALSSTAFAGKAVNVPSSLFGEARVTMRKTAAKAKPAASSGSPWYGPDRVLYLGPLSGAPPSYLTGEFPGDYGWDGAGLSADPDTFPKNREAGSHPLPAGPCLGALGPACSPELLRPLTASRFGRGRSEFKAQVPKYSTPGWGWNYSPANPKLCINSEKRDPSPILGPGQCTVATKGRPFVSGHP

SEQ ID NO: 69406 - DNA, 668 bp, Zea mays
  misc_feature: Ceres CLONE 1547527
  misc_feature: Encodes the peptide sequence at SEQ ID NO. 69407
ggagctccccgcggtggcggccgctctagaactagtggatcccccgggctgcaggaattcgtctcacccctagaaaaaagtgcggcgattgaggttttgctccgctttctcagggttttctatcgtctcgtctcccatcgtcgtcgtcgcccgccgctgctaggtttggggtttccggtggccaggacccaagccagctccgtcgggcgccgtggggaactgctgggaagggcggtcgaccggcggtgcctctgcttcgggttctccgtaccggcgtcggaggggatcggatggcataagacgacgctttccactagaatgaaggtggcaaatgggttgtctttgaggaaatctaatggtaggtttaaatcaaagcttatgatggaacttgttaaacaatggcgagaacatcaagcaaatatgaggtgcatgaatctatccaagcgtaataacaacatctatgttggggcagaaggagccaacataacttctcccaacgatagcaacatttggccaacgagtgctttagtagcaaagaatagcaacccaagatatgtgctagcctcaaagtgtgcaagccagcctcctacaatgtggctagagaatagcttgaatacttcatcgggtttcaagtgctctaagccctctatcgttgaatgcacttcctt

SEQ ID NO: 69407 - protein, 116 aa, Zea mays
  misc_feature: Ceres CLONE 1547527
MKVANGLSLRKSNGRFKSKLMMELVKQWREHQANMRCMNLSKRNNNIYVGAEGANITSPNDSNIWPTSALVAKNSNPRYVLASKCASQPPTMWLENSLNTSSGFKCSKPSIVECTS

SEQ ID NO: 69408 - DNA, 664 bp, Zea mays
  misc_feature: Ceres CLONE 1547532
  misc_feature: Encodes the peptide sequence at SEQ ID NO. 69409
aaagctggagctccccgcggtggcggccgctctagaactagtggatcccccgggctgcaggaattcgtctcacccctagaaaaacccccacccacaaagagataggcggatagcgtctatccccccaatcctcccgccgcggcgacgccttcccctccctccttcctccgtcccatgctccgccgctgacacgttggcccgacttaaccttacgatggccgccgcctccgccatcaccgccgtctccggcgttgtgcttccccaaaccttcctatccccccggtcgccgccgccgcaggtcctagccgtggcctcctcattccgccggctctccttgtgcgcttcccctcgccggatcactcacataatcccccgcgctgatgcaagtgccgaagctggagaaccggagcctgtcactgcttcagatgaatccgaagaggaggtggccgaggggtctgtcgctgtggcggaggggggaggaaccgacgccgccgagcaagccgaaggttaagttcggcgaaataattgggattccgaataagcagttcattgaggaggctgagaaggtgaagactgtacccggatctgatgcctggcgatatcattggagcttaggatgcaacggcccaaacaaaaggaaattggtcggctctttaaagggcat

SEQ ID NO: 69409 - protein, 98 aa, Zea mays
  misc_feature: Ceres CLONE 1547532
MAAASAITAVSGVVLPQTFLSPRSPPPQVLAVASSFRRLSLCASPRRITHIIPRADASAEAGEPEPVTASDESEEEVAEGSVAVAEGGGTDAAEQAEG

SEQ ID NO: 69410 - DNA, 762 bp, Zea mays
  misc_feature: Ceres CLONE 1547533
  misc_feature: Encodes the peptide sequence at SEQ ID NO. 69411
  misc_feature (9)..(9): n is a, c, t, g, unknown, or other
  misc_feature (29)..(29): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
ttttttttntttttttttttttttttttnaccacnnnttttctttttttttcaatgctggtactccccgcggtggcggccgctctagaactagtggatcccccgggctgcaggaattcgtctcacccctagaaaaagtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccaagtcccgcggcggccgtggaggcggctgctgtggttaccgtggtggccttggaagccgcggctacggcggtggcgggcgccctgatgggtgtggcggctacgccggtggcggcggactccggtgggatgtggccggcttagtgtggtgagtggccgccggactactggggttggaaataccgtggtccggcgggctttccggctaactcccccaccgggcacttgggaatgaaaacttcacaccggttggggggcccctgccgtctgattcaa

SEQ ID NO: 69411 - protein, 112 aa, Zea mays
  misc_feature: Ceres CLONE 1547533
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQVPRRPWRRLLWLPWWPWKPRLRRWRAP

SEQ ID NO: 69412 - DNA, 671 bp, Zea mays
  misc_feature: Ceres CLONE 1547541
  misc_feature: Encodes the peptide sequence at SEQ ID NO. 69413
cagctggagctcaccgcggtggcggccgctctagaactagtggatcccccgggctgcaggaattcgtctcacccctagaaaaaaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgccaccgcgccggagaagggcgagcggttcaaggagtcataggtgtaccactgccgctgggccatgcttgccgtccccgggatcctggggccggaagctctgggcctgggcaactgggtgaaggcgcaggagtgggcggccctccccggggggcaggccacttacttgggccccccggggccggggggcaccctgccaaccaccctggggataaaagttcttgtccatccccttcgccaagcaccagcgcccccatggtaaaaggacccctaaaaaaaaaaaagttccccggggggcgcccttccac

SEQ ID NO: 69413 - protein, 87 aa, Zea mays
  misc_feature: Ceres CLONE 1547541
MVMASSSGLRSCSAVGVPSLLAPSSRSGRLAPFCANATTSGRVTMSAEWMPGQPRPAHLDGSSPGDFGFDPLGLATAPEKGERFKES

SEQ ID NO: 69414 - DNA, 717 bp, Zea mays
  misc_feature: Ceres CLONE 1547542
  misc_feature: Encodes the peptide sequence at SEQ ID NO. 69415
aagctggagctccccgcggtggcggccgctctagaactagtggatcccccgggctgcaggaattcgtctcacccctagaaaaaagagcagcgagccatcgacacgatcgcgagcgcaagcacgtacgttgtcggaagctcaagttagaagaagcaccagtgcctgatcgatggcggcccaggctctcctctccggccgacagctgctgggccgccccgtgcagtcggccgtctctaggtcgtcggcgaggaaggcgcccttcgtcgtcagggccagctccagccctccagccaaggaaggtgccgacaggcatctgtggttcgcgtccaaccagtccctctcctaacctcgatggcactttgttttccccccccctggggggggggggggggggaggcctctccaaccccgagggccccccccccctttttttcaacccaaattgtcctggcctaatgggcgagggggatcaacgggcccctcaccgccatgcttgggccactgtggtgcgcccctccccccccgaataatctcccccccaacacgtcccatccccccccccgggaaaccggccctgcctgcggtgtctagatccgtgactcccactccccccccgggggcatctaaacattcagattccttactcctaacatgcctcttctgtcttaccccagggagtctcatggagtcccgcgtcagatattcgcccccctcccc

SEQ ID NO: 69415 - protein, 58 aa, Zea mays
  misc_feature: Ceres CLONE 1547542
MAAQALLSGRQLLGRPVQSAVSRSSARKAPFVVRASSSPPAKEGADRHLWFASNQSLS

SEQ ID NO: 69416 - DNA, 600 bp, Zea mays
  misc_feature: Ceres CLONE 1547543
  misc_feature: Encodes the peptide sequence at SEQ ID NO. 69417
ggagctccccgcggtggcggccgctctagaactagtggatcccccgggctgcaggaattcgtctcacccctagaaaaagtttataaactcccctggcgggtggctaatctcaggaatggcgatttttgatacgatgcaaacggtgacacctgatatatatacaatatgcctcggaatagccgcgtccatggcctccttcattctgcttggaggagaacccaccaagcgtatagcattccctcacgctaggattatgcttcaccaacctgctagtgcttattatcgggcaaggacaccagaatttttactagaagtggaagagttacacaaagttcgcgaaatgatcacaatggttcacgcactaagaacaggcggggctttttgggttgtatccgaagacatggaaagggatgtttttatgtcagcaaacgaagcccaagcttatggacttgtccatattgtaggggatgaaatgattgacgagcactgcgatactgatcccaggtgggttccaaaaatgtttaaggatttggtagtgggtggatttctttgaaaattaatccccaaacccaattccaggttttaggcctctacaaaaag

SEQ ID NO: 69417 - protein, 145 aa, Zea mays
  misc_feature: Ceres CLONE 1547543
  misc_feature (1)..(120): Pfam Name: CLP_protease Pfam Description: Clp protease
  misc_feature: SWISSPROT Homolog: EC 3.4.21.92 Endopeptidase Clp
MAIFDTMQTVTPDIYTICLGIAASMASFILLGGEPTKRIAFPHARIMLHQPASAYYRARTPEFLLEVEELHKVREMITMVHALRTGGAFWVVSEDMERDVFMSANEAQAYGLVHIVGDEMIDEHCDTDPRWVPKMFKDLVVGGFL

SEQ ID NO: 69418 - DNA, 511 bp, Zea mays
  misc_feature: Ceres CLONE 1547545
  misc_feature (280)..(280): n is a, c, t, g, unknown, or other
aagctggagctccccgcggtggcggccgctctagaactagtggatcccccgggctgcagaattcgtctccccctagaaaaagcactcgctcccttccattcccagcgaccccgcccgcccggaggcgtcgcacctgcacgccgcggcagcagccaagcctctctcgtctcgtgcggcaagcgccacaacagacaccgatggcgctctgctgctgcgcgctgcgcgcgccgccagcgtcacgcggcccggcgggtccggctgctcctcggcgctgcccagncgggggttcggggccgatgccttttcggcccctcctccgtcgggaaagggggtcttcttcccacaaaaaggtcccggcaacggaaacgggggggggccaagggcaacctttctcccccccaaaaaaacccaaatttccccccgccgttttaaaaaaaacccccccctaaaaaaaaagggggggggaatttttttttctaataaatatttcccccggcgtcttcttcaggta

SEQ ID NO: 69419 - DNA, 887 bp, Zea mays
  misc_feature: Ceres CLONE 1547547
  misc_feature (12)..(12): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (288)..(288): n is a, c, t, g, unknown, or other
  misc_feature (471)..(471): n is a, c, t, g, unknown, or other
  misc_feature (887)..(887): n is a, c, t, g, unknown, or other
gggggttgtttnttnnnntnnnnnntnnnnnnnnnnnnnnnnnnaaaannnnnnnaaaaataggctccccccggtggcggccgctctagaactagtggatcccccgggctgcaggaattcctctcacccctagaaaattaggcaggagtctggggctttaatcaaagtggctagctccaattcagaccctgatgatgactgcctaattactttttctgcgaaggagttctttgaagatcctgtatctccaacaattgatgctgccgttcgtttgcaacctaaatgcancgagaaaaatgatttacaatcccctgagcactccttacccaaccgctttgtttttgccaaaaatagagaaagaggccgcccaattggtttttttttttttccaacaattaccgcgagaaacgcaaaaaattttttttcttcccccccccccaggggggaaaaagaaaagggggaatttccccnatcttctccccccccccaccccaccccccaaatataaaaatacaaaaacacccttactccccctcctctctggcggacggggtgaaacaagtgtcccctcgttctcacccatctcgggtatttatgggctggccccaccatcccctatttcctctcttttacacgtagcaaaaccgggcggcaaacattttcaccacttcttctcctctctcccggtgtttttgtctcttgtagcgcttttgcgccgttccgctccttcgctgtgctcgctctaacgccacgacctgcatacaacacctacccacccccataaagtataaaccaccacacctctctgtccgcccgtacctcctctccctaccacgttgttctctctacatagtagcgcttcggcctcttcacatcccaccaaaccn

SEQ ID NO: 69420 - DNA, 730 bp, Zea mays
  misc_feature: Ceres CLONE 1547550
  misc_feature: SWISSPROT Homolog: EC 3.2.1.23 Beta-galactosidase
ggagctccccgcggtggcggccgctctagaactagtggatcccccgggctgcaggaattcgtctcacccctagaaaaaataataactaaaacgatggatcggatcatctgcatgcatgcatatgcagtatgcatgctgcttgcctgcctgtaacgaatatgaatgcataaaataacgcccctgctgctcccatgcatcagcagtgtgtaccactatgttatatatatatatactgtatttcgctcggcaacaaaaaaaaaaaaaaaaaaaaaaaaaaaaaaaaaagaaaaaaaaaaaaaaaaccgagacgctcgaggtacccaattccccctatagtgagtcgtattacgcgcgctcactggccgtcgttttacaacgtcgtgactgagaaaaccctggcgttacccaacttaatcgccttgcagcaaatccccctttcgccagctggcgtaatagcgaagaggcccgcaccgatcgcccttcccaacagttgcgcagcctgaatggcaaatggaaattgtaagcgttaatattttgttaaaattcgcgttaaatttttggtaaatcacctcatttttttaacaaaaggccaaaatcggcaaaatcccttataaatcaaaagaatacacccaaaatagggttgaatgttttttccagtttggaaacaagagtccacaattaaagaacgtggacatccaactttaaagaggcaaaaaaccccttctattag

SEQ ID NO: 69421 - DNA, 866 bp, Zea mays
  misc_feature: Ceres CLONE 1547552
  misc_feature: Encodes the peptide sequence at SEQ ID NO. 69422
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
nnnttttgtggtgcgtgaaccccttccctggggaaannnnnnnnntgtnnnnnttcatagctggagctccccgcggtggcggccgctctagaactagtggatcccccgggctgcaggaattcgtctcacccctagaaaaaatcttcgcatttccatctccccgtgggatcccagccgccgccgcaagaagaagagctcggggacttgcaggtctcgagagaagatgccgaaacagatacacgagatcaaggattttcttctcaccgcgaggaggaaggatgcccgatcagtgaagatcaagaggagcaaggatgttgtcaagttcaaggtccgctgctccaagtacttgtacaccctctgcgtattcgatggctgagaaggcaaacgagttgaagcaatctctcccccccaggcttgaagcgtccaggtaggcttgattggatacatggacaaccgtcgggtctgaaacctctagagcattctttatcattcggtctgagcgtggctgttttatggttagtctctgggtccttacagcgctacacggaaagtgcttgggatttgggtggatcctcagacaaactttcgagcagataatacccatatttgctcctcgggtccttcaaatgaccactcaaattagcggagtaccgctgcgtagggtaaccccgcattttcgcccttgatatgatggagtgccacaattaaccacggactcgtgcattgtgctcggtatctttattctataactgctccatgcgactatgggtatacaaccccgtgagcattcttaccctagccttgtatctcgcgcctaagcttgtgaccagctctcgcctttttcaccagcatctgctgcttgataa

SEQ ID NO: 69422 - protein, 50 aa, Zea mays
  misc_feature: Ceres CLONE 1547552
  misc_feature (2)..(51): Pfam Name: Ribosomal_L38e Pfam Description: Ribosomal L38e protein family
MPKQIHEIKDFLLTARRKDARSVKIKRSKDVVKFKVRCSKYLYTLCVFDG

SEQ ID NO: 69423 - DNA, 884 bp, Zea mays
  misc_feature: Ceres CLONE 1547555
  misc_feature: Encodes the peptide sequence at SEQ ID NO. 69424
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (884)..(884): n is a, c, t, g, unknown, or other
cctttcatgatgatggggtgcaccacccnnncnnttnnnnnggtaaaactggagctccccgcggtggcggccgctctagaactagtggatcccccgggctgcaggaattcgtctcacccctagaaaaaacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtccggattggccggctgctgcgtcggaaggctagggtctaagagctatcttctgttttaatcatggctctgtttctgtaagctagcaagtgaacgtggtcgagattttatctagattccgcagcacgcccccaacaccacaggagaaaatttgacggaactggggtcaggacccacaagacttccttggcaacaaactgggtaggctacaaagagcgaagacctattctcctttattctaacaatgtgtggtgccggagcagtgcatcggccgcggtcgcgctccataagtaaataagtagcgcggagcctgttccgcagggcccccaaattactgcccacgtgcgtcttggcacatggtacacgacgcagaccttagacgcgtcggcgagtagatacaaatgctgctctggactacgaacaaatagcttggagtatcgggccgcatcactaagtgcgaggtggctgggcacacggtccctgtttccgtgccggttgggcggtaaacaaggcaaataaaagatccaccttccagataaccgctcgtcttcccacacn

SEQ ID NO: 69424 - protein, 51 aa, Zea mays; identical to SEQ ID NO: 2355
  misc_feature: Ceres CLONE 1547555
  misc_feature (9)..(51): Pfam Name: Ribosomal_L39 Pfam Description: Ribosomal L39 protein

SEQ ID NO: 69425 - DNA, 924 bp, Zea mays
  misc_feature: Ceres CLONE 1547560
  misc_feature: Encodes the peptide sequence at SEQ ID NO. 69426
  misc_feature (27)..(27): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
ttcgctctttcctgcgcgtgcgcgggnggggggggtnnnnaaacccacgggcctagccgcgggggcggccgctctagaactagtggatcccccgggctgcaggaattcgtctcacccctagaaaaaccaaagccagagcctaagcctgaaccgaaaccgaaaccagagccagagcctaaacccgaaccaaaaccagagcatctacccgaaccaaaaccagagccaaaaccagagccccaaccaaaaccagaacctaagcccgaaccaaaaccacagccagaacgtaagcccgagccaaagccaaagcctgaccctcgacgcctcccgccggcaggtgtgaggtgagggacgggctattacccagtggttgggggcggtgcaagagaagcggcctgttgcagcttggttctcgcggcgccgagggagggggggggggcccaggcttccgccctcctgtggccctctctggggggcgtgggggatggggagccggccggggggggagggggtggggggccgcccctatgtcgcacggccgggttgatggccgggccacgggcgctgagtgcgggagggcgcgggtgcggttgtccggtggctgacccagggcggggggtccggagggggcggacggcggccaggtgtacacaggcgtgcgggcggggggcggagggccggccgcgtcgcgcgttgccccgtctcgtgtgcgacgacgtctcttcgtggccggggattggcttgcgatgcgtgttaactgcgatgggtgccacgggccctagccgtgggagagcgcagacgccgaacggggcgggcgcagatgcgcaccgcggaaggcgtgccccgacactagcggggttggcccgacgaactggagtggagacacagcgcgcttggctgcgggcgggcggccacgctggctccgcg

SEQ ID NO: 69426 - protein, 114 aa, Zea mays
  misc_feature: Ceres CLONE 1547560
  misc_feature (13)..(13): Xaa is any aa, unknown, or other
  misc_feature (14)..(14): Xaa is any aa, unknown, or other
FALSCACAGGGGXXTHGPSRGGGRSRTSGSPGLQEFVSPLEKPKPEPKPEPKPKPEPEPKPEPKPEHLPEPKPEPKPEPQPKPEPKPEPKPQPERKPEPKPKPDPRRLPPAGVR

SEQ ID NO: 69427 - DNA, 833 bp, Zea mays
  misc_feature: Ceres CLONE 1547561
  misc_feature: Encodes the peptide sequence at SEQ ID NO. 69428
ccccgcggtggcggccgctctagaactagtggatcccccgggctgcaggaattcgtctcacccctagaaaaacatggatggcttttggtgtacgagctgcatgctttgctagggctatctggtcatgtaagaaatggaagctctgctgtactttaagaaacttgatgaaacctttgtataactcaactgtacctctatctatcccttgtgtgtatttgagaacgatttccgagcatgtctggttcgggcgtctaaaacgcacgctcactggccgtcctttaacaagcgtctaggataggaaaaaccctggcgttcccctctaagtcccccattcccccaattcgcgctttttttattcccccccctcaggggggggaggggggtaccgcctctcgtctctcgcaaaaaccccccaccgtctccccagaaaaaatcgatattgtcccaccctccgcccttttccgtcaactggttgtatttaccccaaaagattctccttaccctatttccacccctctccaacacgattcgagacgcaatccccccgaggggagcgccccgcgaaccgtctgcgaaggtcacatatcaccttctgccttcaatatgttcctcgtttatcactttggtggcctcccactccccccgctttttattctgaacctagatcgttcgacccctctcctgccacctctcctcctcatcaaactcccatcttaattgctgccctactcaccccttggtactggtatcgctcccaaggtttcgtaagaggggtttacttctcctcgttatacaacccttgcaaactcctcaggactccattccgcttaaac

SEQ ID NO: 69428 - protein, 71 aa, Zea mays
  misc_feature: Ceres CLONE 1547561
MAFGVRAACFARAIWSCKKWKLCCTLRNLMKPLYNSTVPLSIPCVYLRTISEHVWFGRLKRTLTGRPLTSV

SEQ ID NO: 69429 - DNA, 986 bp, Zea mays
  misc_feature: Ceres CLONE 1547569
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (43)..(43): n is a, c, t, g, unknown, or other
tattttttttccccaccctccccccattttttnnnnnnnnntnttatactggcgctccccgcggtggcggccgctctagaactagtggatcccccgggctgcaggaattcgtctcacccctagaaaaaaggccgtaggccgtagggcgagctcccaggtcgacgtggcggggatggctgcgacggccggcggtggcggtggtggaggggctaacgccgcactgaccgagcagatagcacatgcagtgcggtccagcctccaacctcctccagctgatggagctcttctccccccctcaggtctccccgcccttctgcccccatctcgtcttgtttgggtctggtggggtccgtaattgtctgctgtgttttcccccgccctcttgccggctcccttgatacaccctccgttttctaaatctggttggactacccgtccctctcttcccgtctgccattctcgtcgtttctccatttctctgcatctcgctctcgcattctctccctatgtcttctctctctctttttcgttccctcggttcttgcccgcctcccgctttcctgttgtctcaccgctctattttttcctgtttcatctccgctgcacctagcgctcataaaccacccttctgctgactcctacacccctcttccctcctgtgatcgaccgtattcttagcgtccgccatgctctcactcctactctgtgcttatcttgccgcgcccttgtgttcattcacactcctcttcaacccctctctctcccctcttccctaatcttctcctcttctctctccataccaacctctcctccctcgtcttgcaccccctctttccctttccgccttcctcttccctctccgctctcttctccccctctcgtactccccacctctcttatcataccctctgtcctctcgttctgctttggtgatattcgtgttatctcctcttatgttttatttcttttcttcctgctcttccccg

SEQ ID NO: 69430 - DNA, 888 bp, Zea mays
  misc_feature: Ceres CLONE 1547571
aatataaatgcgacgatgctccgcgggtctcgctttttaattatatatcataactggagctccccgcggtggcggccgctctttactagtggatcccccgggctgcaggaattcgtctcacccctagaaaaaagacatcatcgtcctcaccagggtacagacgtgcccctcctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggattccattaggagtcctcctttttatttctttagccctttgttacacttcgaattggtgtgatcgtgtcgagggcgccatctactattataaattaacctgacgcgtttcatggtgctgatgtgatatttatcgatgaaacttggcgtgaccaccacagttattgtcctcttaggtggcatctgtcagtttctccccgaaaacccctgattgtctatataaatttcagtgtgtggtgtttaatatccgcgactttgtatcagtaatatatacacgttgtagcgatctcgcatgcctaccctccacttcccgctcctttttgttagtaggtgcgggtaatgacgctccgtgtttgctattgggtccgttcgcttttttagcgagttgttcttttgtcttggttaagtatcccttgccgcgttcgtctcagatagtatacatcgcatggtgcggcgctcgttgcccgcatttttggtgtagatgtgaagataccaaacagcactagagcg

SEQ ID NO: 69431 - DNA, 739 bp, Zea mays
  misc_feature: Ceres CLONE 1547576
  misc_feature: Encodes the peptide sequence at SEQ ID NO. 69432
gctctacaactagtggatcccccgggctgcaggaattcgtctcacccctagaaaaatcagaccactatgcgcgccaaatcaaaagcatctggtagctctgcccagattaagaacaaatctgttatagtatcagaggaagaagatttggaacagactttaaaggagaaggctcatcaattggagttagctaggaaggcagaggagttagataggaaggcagaggagttggcgcgcaaggaggaggaactaagaaaagagagggatgctgctgaaaaggagcggcttaggatggagcagaaggctaatgctaaggaggctgaggagaggaagaggcggaaagcagagaaggacaaggaaagagccgagttcaaagcacgcaaggaacctgaggaaaggtaaaaaaaaaaaaaaaaacgagacgctcgaggtacccaattcgccctatagtgagtcgtattacccgcgctcactggccgtcgttttacaacgtcgtgactggggaaaaccctggcgttacccaacttaatcgccttggcagaacttcccccctttcccccgctggggtaatagcgaagaggcccgtcccggatcgcccttcccaacttttgcgcaagcctgaatgggcaaatggaaattgttaggcctttattattttgttaaaaattccccgttaaaattttgtgtaaaaccacctcattttttgttaaccaatttgcccgaaatgcgggaaaaaatcccc

SEQ ID NO: 69432 - protein, 110 aa, Zea mays
  misc_feature: Ceres CLONE 1547576
MRAKSKASGSSAQIKNKSVIVSEEEDLEQTLKEKAHQLELARKAEELDRKAEELARKEEELRKERDAAEKERLRMEQKANAKEAEERKRRKAEKDKERAEFKARKEPEER

SEQ ID NO: 69433 - DNA, 749 bp, Zea mays
  misc_feature: Ceres CLONE 1547580
  misc_feature: Translation starting site: 94
  misc_feature: SWISSPROT Homolog: EC 3.2.1.23 Beta-galactosidase
atagctggagctccccgcggtggcggccgctctattactagtggatcccccgggctgcaggaattcgtctcacccctagaaaaaggagaaagaatggcgctgccgacagctaacccgggcttccgtctcggctgccaggagtctcccgcgatgggattgaggtcggcgccgcggttggcactgcgtcgtcccggcgcggtctccgggcacaggtttggacgtttggtatctgatgtcttagatttctgccctttgttccgttcatatggagggttgcagacttgcagtcggttgaagcgctaatctcattattcattttgcttgcctagtccgcccgcttacccatgcaattgcaagatcgtatagtccataattccataccctcaaatactgtactcgcaaaaaaaaaaaaaaaaacgagacgctcgaggtacccaattcgccctatagtgagtcgtattacgcgcgctcactggccgtcgttttacaaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatatcttgttaaaattcgcgttaaatttttgttaaatcggctcattttttttaccaaaggggcgaaatccgcaaaatctctttataaaccaaaagaatagtccgg

SEQ ID NO: 69434 - DNA, 829 bp, Zea mays
  misc_feature: Ceres CLONE 1547583
  misc_feature: Encodes the peptide sequence at SEQ ID NO. 69435
  misc_feature (31)..(31): n is a, c, t, g, unknown, or other
  misc_feature (41)..(41): n is a, c, t, g, unknown, or other
ttaatatgacatgcttgtatgtgcgaccgtngctccccccnctaatagctggggctccccgcggtggcggccgctctataactagtggatcccccgggctgcaggaattcgtctcacccctagaaaaaatcttccaccgcgcttcgcccactcgctccagccgcttcaccgcgccgccaccgccaccgcgaggatgccgttcaagaggttcgtggagatcgggcgcgtggccctggtgaactacgggaagaactgtaacaagtagtagtacgaatgtaccagggtgatgtgctttcgagtcacttgtgtatatattcatttttttatcgaaaaaaaaaaaaaaaaacgagacgctcgaggtacccaattcgccctatagtgagtcgtattacgcgcgctcactggccgtcggtttacaacgtcgggactggtaaaaccctggcgttacgcgagccccccccccttgcaacacatccccctttcgccggctggtgtaaaagcgaaaaggcccgcaccgaatgcccttcccaacagttgcgcagcctgaatggcgaatgggaaattgtgagcgtttaatattttggtaaaaattcccgagtaaatttttgataaaatcaaggtcaagtatatttgccgcataggcccaaatccggtggaagtccccttataaatcaaagaaaataaaccggagaaaagggctggagtgttgtgtcatagtttggaacgggaatcccaactgttaagaaaaccggggaactccaacctcgaaaggagccgaaacaacgttcttattagagggtggatgggcccacctacctgggatctctct

SEQ ID NO: 69435 - protein, 100 aa, Zea mays
  misc_feature: Ceres CLONE 1547583
  misc_feature: SWISSPROT Homolog: EC 3.2.1.23 Beta-galactosidase
MYQGDVLSSHLCIYSFFYRKKKKKTRRSRYPIRPIVSRITRAHWPSVYNVGTGKTLALREPPPLATHPPFAGWCKSEKARTECPSQQLRSLNGEWEIVSV

SEQ ID NO: 69436 - DNA, 822 bp, Zea mays
  misc_feature: Ceres CLONE 1547588
  misc_feature (822)..(822): n is a, c, t, g, unknown, or other
acagctggagctccccgcggtggcggccgctctagaactagtggatcccccgggctgcaggaattcgtctcacccctagaaaaaactatcctttccgaacgaaatgcaatcgtccccaatgtggagcagaaaagccatcacagacgaacaatgcaaatgaatcagcggaagatcaggtcaatcagtgagtcctagaacagtaatgagggtcaagaaggtccagcatcgtcgtcaaggttcagtctgaatgtggggtacatctgtgtcagtagtcgccgttacaagtttcttccccttgagaacttagttgagtcggggccttggagttggcaatggagtcttgccttccttaatcactgcggataatggccaagaacatcgatttgttatgtggttttgtcaagaacctccatcttgcctttcctggctgaacttggttacttggccttggttacgggtcactccgggctaaattacccatatgtttatatgaatggtctttttatttggggtccatacaatatcctcttcgccctggtattgaactaatcacaacccggtcctccattttttgttattgggcttgagaacacagctctctcctcttcgtgtacggcacgtgatcttcaattcatgatgtctccgcgtgcgccctctctggcgtccccccaattctcgcccccatagcggtagatgcgtaattacgcgctcggccttaaccggagtccgtcttatttgtatctaccctccgtggtatctggtgaaaacctcactttgctagtgtatactccacacaatctcgcccccttgtgtgtcttctcn

SEQ ID NO: 69437 - DNA, 813 bp, Zea mays
  misc_feature: Ceres CLONE 1547590
  misc_feature: Encodes the peptide sequence at SEQ ID NO. 69438
ctctcagaccgcgtctgggacgaccttaatctttattatttaaaaatggaactccccgcggtggcggccgctctagaactagtggatcccccgggctgcaggaattcgtctcacccctagaaaaagcgaccccaggtcagtcgggactacccgctgagtttaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaaggctaaatacaggcgaggaccgaaaaaatgaatgcaactctgatttacttacatgtttagttgtttacgtttccttcaaaaaaaaaaaaaaaacgagacgctcgaggtaccccaattcgccctatagggagtcgtattacgcgcgctccctggccgtcgttttacaacgtctggactgggaaaaccctggcgtttacccaacttaaatcgctctggcagcacatcccccttttcgccagttgtgccgtaatatcggaataggccccggaaccgatcgcccctttcccaaacatttgcgccagccctggaattgggggaaaggggtaaatttgtaaagcggtttaataaattttgtgttataaatgtgcgcagg

SEQ ID NO: 69438 - protein, 39 aa, Zea mays
  misc_feature: Ceres CLONE 1547590
LSDRVWDDLNLYYLKMELPAVAAALELVDPPGCRNSSHP

SEQ ID NO: 69439 - DNA, 637 bp, Zea mays
  misc_feature: Ceres CLONE 1547592
  misc_feature (39)..(39): n is a, c, t, g, unknown, or other
  misc_feature (107)..(107): n is a, c, t, g, unknown, or other
  misc_feature (176)..(176): n is a, c, t, g, unknown, or other
  misc_feature (359)..(359): n is a, c, t, g, unknown, or other
  misc_feature (424)..(424): n is a, c, t, g, unknown, or other
  misc_feature (606)..(606): n is a, c, t, g, unknown, or other
  misc_feature (607)..(607): n is a, c, t, g, unknown, or other
  misc_feature (637)..(637): n is a, c, t, g, unknown, or other
atagctggagctccccgcggtggcggccgctctagaacntagtggatcccccgggctgcaggaattcgtctcacccctagaaaaaaaaaaagaaacacaagtattantggcactactagtgtttttaggaacaaggaaagaggggttgcccctgctggctatatatatcaaatatnaaataaagctaaggggccgtagaacattgggtggaattaaaaaaaaaaaaaaaaaaaaaccgaaaacccctcccgaaggggacccaaaatttccgcacctataaaagggaggccccttatttattcccccccccccccccccgggggggggcgggcgggggtttttttttaaaaaacaacccnccttaacggcgggtaaaaaaaaaaaacccccccggggggggggggtgcctcccccccccccacanaaaaaaaaaaaacccccattttataaaaaaaaaaaaccccccccccccttttttttttataggggggggggggggggtggtagtataaaaaaaaaagaagaggggcccccccccccccaccccggtgtcgtccctctgtttatggtgaggaagaaaaaccccccgtcccccccccccgcctnnattttttttttttgaaaataaactcggcan

SEQ ID NO: 69440 - DNA, 786 bp, Zea mays
  misc_feature: Ceres CLONE 1547596
  misc_feature (244)..(244): n is a, c, t, g, unknown, or other
  misc_feature (320)..(320): n is a, c, t, g, unknown, or other
  misc_feature (329)..(329): n is a, c, t, g, unknown, or other
  misc_feature (360)..(360): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (442)..(442): n is a, c, t, g, unknown, or other
  misc_feature (492)..(492): n is a, c, t, g, unknown, or other
  misc_feature (494)..(494): n is a, c, t, g, unknown, or other
  misc_feature (529)..(529): n is a, c, t, g, unknown, or other
  misc_feature (530)..(530): n is a, c, t, g, unknown, or other
  misc_feature (546)..(546): n is a, c, t, g, unknown, or other
  misc_feature (583)..(583): n is a, c, t, g, unknown, or other
  misc_feature (584)..(584): n is a, c, t, g, unknown, or other
  misc_feature (594)..(594): n is a, c, t, g, unknown, or other
  misc_feature (595)..(595): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (644)..(644): n is a, c, t, g, unknown, or other
  misc_feature (667)..(667): n is a, c, t, g, unknown, or other
  misc_feature (705)..(705): n is a, c, t, g, unknown, or other
  misc_feature (750)..(750): n is a, c, t, g, unknown, or other
  misc_feature (751)..(751): n is a, c, t, g, unknown, or other
  misc_feature (784)..(784): n is a, c, t, g, unknown, or other
  misc_feature (786)..(786): n is a, c, t, g, unknown, or other
tggcggccgctctagaactagtggatcccccgggctgcaggaattcgtctcacccctagaaaaaatcagaaactagtcctctacttgctaggaggtgcttacacacccgaaaacctgcccccgccgccttggcctcacgtcacgatgtcttgcacggtgaccatcccgaactcgccagtcttctcgccttcacgccgcccgctgtcctgtaaggccgctcccgcgtctccggagcccgacgtcntcgtctccgcctcttccgttgcgcccgcggccggcgactcctgttcgccactccgtcccttaggacgtccgcgctntggtccggnaaggactttttttcccccccccccggggganacagaacaggggtctccnnnnttttcctcctttaccacccccgtgcccatgcttaaaatcatctccatacctcgcggccggngcatgggggcgccccccacaccgatgcccacatccagctccctccccgtngnatgctcgtcggccggtcgccatcccccaccgcacnnctccccaaggcacgcngcgcgcaccaagtgtaacacctccaccttccccccanngccctcccgnntctcacaccactccccccgctcannnagtcccggcccccccattagccngtcatccccctacccgtaccccngactctcaacggttccttcacccgtaccccccgcacancgcgccctccccaatgtccctcccggctccccccttctccgactnntctcctccccattcaccacaccctgcagaagcnan

SEQ ID NO: 69441 - DNA, 657 bp, Zea mays
  misc_feature: Ceres CLONE 1547597
  misc_feature: Encodes the peptide sequence at SEQ ID NO. 69442
  misc_feature (20)..(20): n is a, c, t, g, unknown, or other
  misc_feature (64)..(64): n is a, c, t, g, unknown, or other
  misc_feature (169)..(169): n is a, c, t, g, unknown, or other
cgcggtggcggccgctctanaactagtggatcccccgggctgcaggaattcgtctcacccctanaaaaaactccccagtccccatagactccagcctgagctgcaccgtgagcgctcgccgctccgcatcgccgtcccagtcccacaccccgaatccagcctgccccancgtaatggcgcttcgccaggccgtcctcctggccgtggtcctcaccgcgctgctcccgctcgccctctctcgcgggttgggtttggtgcacgggcatgtgcggccgcacactcacgggctggggctcggccaccaccacgcccagccgcacccacacccgcacgggcacacaccgctcatatgtagcgcgtggtcctctgctcacgccaccttctacggcggaggagaccccccccgcaccatgtactgttcatgcggctactgcaaactctacagccaggggttctgcaccaaaaccgccgctctaagcacggcactctttcacaacggactccactgcggcgcctgcttctacgtgcgcatgcaacgccctcgggtggcgggaaaccctccttgcctgccgcggctcctacaatgattgcccgccattaaacttcctgtatccccctaaaatgccactcccactccgaacgaagggcggggtgggg

SEQ ID NO: 69442 - protein, 137 aa, Zea mays
  misc_feature: Ceres CLONE 1547597
MALRQAVLLAVVLTALLPLALSRGLGLVHGHVRPHTHGLGLGHHHAQPHPHPHGHTPLICSAWSSAHATFYGGGDPPRTMYCSCGYCKLYSQGFCTKTAALSTALFHNGLHCGACFYVRMQRPRVAGNPPCLPRLLQ

SEQ ID NO: 69443 - DNA, 707 bp, Zea mays
  misc_feature: Ceres CLONE 1547604
  misc_feature (213)..(213): n is a, c, t, g, unknown, or other
  misc_feature (707)..(707): n is a, c, t, g, unknown, or other
tccccgcggtggcggccgctctagaactagtggatcccccgggctgcaggaattcgtctcacccctagaaaaagcactccgcaagacgcaagaccacctcaccagcctcctcgtccccgatctcctcccacccgcatccaagggtttccttctcgaccgtgcggaacgagccagagaacaggtatggcggcggcgcggcacctcagatacggnctccccctcctccgcgcccactcgcatcctccgaatccgcggccgtcgctcaagtttcgaagggctttcccgtcgcaagccgccaaagccccccgggaaagaaatcaaaggttccaaaaggttctgtttggggggcacaggcaacttatgccagtggaactggttgcctccccgacagcccaaaatcctaatggctttgggaccaaagtcggaatcccggaaaaatttaaaagcctttttggaacaagagcctttccacagaaaaaaaaccccccttgggttttccccaaatttcctttaaaaggaacttggcccgggtccccccaaaggccgacccagggcgaaaaaggcctctacacccccaaaataatttgcctaaaaaccgaggaattttcacaaaatataacaaaaaaaattctcccgcggccggccccggaggggataattgggcggccgctaaaaaattatttaaaaacccctgccccgacaaaatn

SEQ ID NO: 69444 - DNA, 730 bp, Zea mays
  misc_feature: Ceres CLONE 1547606
  misc_feature (47)..(47): n is a, c, t, g, unknown, or other
  misc_feature (48)..(48): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (56)..(56): n is a, c, t, g, unknown, or other
ttattaatttttttatatttttatataaacataaaaacactaaaacnngcannnancataaagccggagctccccgcggtggcggccgctctatactaatggatcccccgggctgcaggaattcgtctcacccctagaaaaagggttctacttctagcccgggccgactccactccaatccaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcgacgactgatgaaagcctctaggatgcgttcagcaaattcggcaacctcacttgaggcaaaggtggttcttgacaaattttcaggacgttctcgtggtttcggctttgtaacttttgatgagaagcaagccatggaggatgctattgagggaatgaatggactggaattgaacagaaggaacaccactggatgataaaagctcaaccacaagggaccttggcaaaagaacgttaatggtgaaccgacgatttatgaaccgccaaatagaaggaatcccccgattattgaaagcggtgggtaccttgacactaaatggcgagttatggcggctgactgcctaaccgaacgaaaagggttggagtg

SEQ ID NO: 69445 - DNA, 712 bp, Zea mays
  misc_feature: Ceres CLONE 1547623
  misc_feature: Encodes the peptide sequence at SEQ ID NO. 69446
aagctggagctccccgcggtggcggccgctctagaactagtggatcccccgggctgcaggaattcgtctcacccctagaaaaacgcacgcctgtggacgcgagtgagtgaacaccagccgtattgtcccgaccccgaccgatcctcgcctgctgcaggcatggcgacctccacggtgctctctaccgtcgccaatcccacccagctctgccggtcccgcgcttcgctgggcaagacggtgaaggggcttggcctgagcatgggccgcgagcgcgcccagcggagcattgtgtgccaggcggcgagcagcatctccgccgaccgcgtccccgacatgtataagcggaagctgatgaacctcctcctcctcggcgccatctcgttgcccaccgtcggcatggtcgtcccctacggcgccttcttcgtccctgccggctccgagaacgccagcggcgggacctacacgaatgacaagctgggcaacgacatcacggtggaggcgtggctcaacacacacggtcccaacgaccgcacgctcgcgcaggggctctagggtgaccccacgtacctggtgatgaagcacgacaagacgctgggcacctacgggatcaacgccgtgtgcactcacctcgactgcgtcgtgccgtggaacagcacctagaacaagttcatctccccatgccacggatcccagtacaacaacagggaaaggt

SEQ ID NO: 69446 - protein, 130 aa, Zea mays
  misc_feature: Ceres CLONE 1547623
  misc_feature (54)..(92): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSTVLSTVANPTQLCRSRASLGKTVKGLGLSMGRERAQRSIVCQAASSISADRVPDMYKRKLMNLLLLGAISLPTVGMVVPYGAFFVPAGSENASGGTYTNDKLGNDITVEAWLNTHGPNDRTLAQGL

SEQ ID NO: 69447 - DNA, 691 bp, Zea mays
  misc_feature: Ceres CLONE 1547626
  misc_feature: Encodes the peptide sequence at SEQ ID NO. 69448
  misc_feature (19)..(19): n is a, c, t, g, unknown, or other
gttggttgggtgttttatnatttcgatttttccccaaaaaaaactccataaccatatgcatacaacccagggggcggcggccgctctatttctattggatcccccgggctgcaggaattcgtctcacccctagaaaaaagtccatcgactcgctcgggccgcccctcccgtcgtccccgttcgaaggtgcggcagccggcaggcgagcgatttgattcgacatgaatcccgagtacgactaccttttcaaacttctgcttattggtgattctggtgttgggaaatcatgcttgcttctcagatttgcagacgattcttatttggacagctatatcagcacaattggggttgatttcaaaattcgcacagtggagcaagatgggaagaccataaaacttcagatttgggatactgctgggcaagagcgcttcaggacaatcactagcagctactaccgcggagctcatgcccccattattgtatatgacgtgacagacccagaaagcttcaataatgtgaagcaatggttgaacgacatagaccgttatgcaagtgataatgttaacaacctccttgttgggaacaaaagtgaccttactggccaacaagttgtggcaactgagacagcaaaggcgtttgctgatgagatgggcatccccttcatggaagacgaacgccctaaccgccatca

SEQ ID NO: 69448 - protein, 156 aa, Zea mays
  misc_feature: Ceres CLONE 1547626
  misc_feature (10)..(154): Pfam Name: Ras Pfam Description: Ras family
  misc_feature (10)..(124): Pfam Name: Miro Pfam Description: Miro-like protein
  misc_feature: SWISSPROT Homolog: EC 2.7.11.1 Non-specific serine/threonine protein kinase
MNPEYDYLFKLLLIGDSGVGKSCLLLRFADDSYLDSYISTIGVDFKIRTVEQDGKTIKLQIWDTAGQERFRTITSSYYRGAHAPIIVYDVTDPESFNNVKQWLNDIDRYASDNVNNLLVGNKSDLTGQQVVATETAKAFADEMGIPFMEDERPNRH

SEQ ID NO: 69449 - DNA, 648 bp, Zea mays
  misc_feature: Ceres CLONE 1547627
  misc_feature: Encodes the peptide sequence at SEQ ID NO. 69450
tggagctccccgcggtggcggccgctctgaactagtggatcccccgggctgcaggaattcgtctcacccctagaaaaaacgctctcagtctcactccccacggtcccactcctcaggagcgtccagagtttaggtggctcgtgaaagtctggtggaagtggtaggtgtccatggccttcaagctgggcccacaaaggcccccggcgggctccccccgttggttgtttccccccggggggttccccccgggggccgaagggaacaaaccccttttccctttggaaccaccccctaaaacaaagggggtctcccccgggcccaaaaaaaaatccccctaaaccccccgggggttaaaaaaaaaaaaaaaaagggtttttttccccccgtataaaaaaaaaatttttttgctccccccctttttagtagtgttgcacctattaaaaaaactttttttttttttattatagaaaaaacccccccccctttctttttcccccccttacgagaaaaaaaaaccccttttttttttttattttcggcggcactcttatataaaaaaaagggatccttctcccccatcaacttatttttttttccccccccccccttctttttggctttttcacgcggtgccttcaaaaaacacca

SEQ ID NO: 69450 - protein, 55 aa, Zea mays
  misc_feature: Ceres CLONE 1547627
MAFKLGPQRPPAGSPRWLFPPGGFPPGAEGNKPLFPLEPPPKTKGVSPGPKKKSP

SEQ ID NO: 69451 - DNA, 873 bp, Zea mays
  misc_feature: Ceres CLONE 1547632
  misc_feature: Pfam Name: DUF887 Pfam Description: Eukaryotic protein of unknown function (DUF887)
  misc_feature (873)..(873): n is a, c, t, g, unknown, or other
ttttttttgtgtgtcttgtaaagtctcccgccccaaaaaaatcacccaaaaactggaactccccgcggtggcggccgctctatttctagtggatcccccgggctgcaggaattcgtctcacccctagaaaatctctacactccatgcattggtagctgctgccgtttctttctacctggtcatgatctctgacctcttcaatgaagatgcgcacaatagcataataattgacagaaaatcatggctatccgattgcatgtttggggtctcgatcggatactttttgacagacttgacaatgatcatgctgcattttccttcatcatgagaaaatgaaagctagttttccaacatattgagggtccagctcgttgcatcacccgactttcctatgaatgcatgcaggtccttgcctatatacgatcgccaaaaatgcactatggaacactcccttcatggctcattattgaccgatagtccccccacctcccctctttgtgaaaaccccataaaggggaatttaggaacccttcgtcgtggtgaccagaaaggacgttgccgacatcctttttcactctataaccaacgggcggttaggcattcccttcctttatggattcgggattggattctggatcaacacacacaaactggcctcctcaaccaaactccaatcctgttttcccttctgtcaacagaaaacccaaatttctctaacaaccagacgcaattaacggcgatccatggaggacctcatgaaaaaagtatgtcccttcccacaactaggataaaaaacacttatgggcaattaatggtctagggctataaccttcgtcgccgggcttgtcataactacccctaactcatttttan

SEQ ID NO: 69452 - DNA, 724 bp, Zea mays
  misc_feature: Ceres CLONE 1547640
  misc_feature: Encodes the peptide sequence at SEQ ID NO. 69453
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (11)..(11): n is a, c, t, g, unknown, or other
  misc_feature (12)..(12): n is a, c, t, g, unknown, or other
  misc_feature (14)..(14): n is a, c, t, g, unknown, or other
  misc_feature (16)..(16): n is a, c, t, g, unknown, or other
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (48)..(48): n is a, c, t, g, unknown, or other
  misc_feature (724)..(724): n is a, c, t, g, unknown, or other
naaccccnngnngngnngnnnnnngacgcggaagcgcggaaacctttntttctaatttggggctccacgcggtggcggccgctctagactagtggatcccccgggctgcaggaattcgtctcacccctagaaaaaagccggcgtcgcgtttccaacaggccagtcccctcccactcccagtcccatctcgacgacatggccgcagccgcagggccatcaagctctgtgaaggagacgctcccgccggccctcggctccacctcccagccacctcccgtcttcgatggcaccaccaggctgtacatctgctacttctgcccgttcgctcagcgcgcctgggtcaccaggaacttgaagggtttgcaggacaagatggagctggtggccatcgatctgcaggacaaaccggcttggtacaaggacaaggtttacgcacagggcacggtgccttccctggagcacgacagcgaggtcaggggcgagagcttggacctgatcaggtacatcgacagcaactttgacggccccgcgctgctcccagaagatgctgcgaagaggcagtttgctgacgaactgttcgcgtctgccaacgcgttcaccaaagccctctactccccgttgctggccccacgcggccgggtcaaaacaaaagtttttgccggctctgggataaaactcgaaaactgaaaccttatccaaatttccgaacaaacggggccccttn

SEQ ID NO: 69453 - protein, 163 aa, Zea mays
  misc_feature: Ceres CLONE 1547640
  misc_feature: SWISSPROT Homolog: EC 2.5.1.18 Glutathione transferase
MAAAAGPSSSVKETLPPALGSTSQPPPVFDGTTRLYICYFCPFAQRAWVTRNLKGLQDKMELVAIDLQDKPAWYKDKVYAQGTVPSLEHDSEVRGESLDLIRYIDSNFDGPALLPEDAAKRQFADELFASANAFTKALYSPLLAPRGRVKTKVFAGSGIKLEN

SEQ ID NO: 69454 - DNA, 749 bp, Zea mays
  misc_feature: Ceres CLONE 1547643
  misc_feature: Encodes the peptide sequence at SEQ ID NO. 69455
  misc_feature (40)..(40): n is a, c, t, g, unknown, or other
ataaaaaagaaaaaaaatataataaccactctcctatccnaatttatttaaaattgagagctcccgcggtggcggccgctctatttctagtggatcccccgggctgcacgaattcgtctcacccctagaaaaattgcgagtctccgtttcatctcgccacctcacccccacacacactgcgaatccccgcgatctgaatccggcgccccccgccccgatccgcgccgaatcgtcgccgctcggggtggaaccctaccccgatctcgatccgtttctccgcgatgggcgccggccgtgtctgtcgcggaggcaactcctccgtctcccccgccgcagggcggacgttctcgacactcgccgcgtcctcctccgtctccccttcctcggctccttcatagacggcgtccacgtcagtcaccaaaacggtgaacggctcccaccacttaaataacacggggctaatctcccctccaatggaaacggggaggggaaagttctcgcttccgaatccttcacatgtgaggtggaatcaaactgggcgaactacttttcacccctaagggaaaaaacacaagaggaaagcgcttgcctaagatttcgacttcttcttatccccttgcctctcgaaggttaccccaaagatgccaccccaaccgctataaaaattcaaaattcccactaacccaaaaacaggcaagaggttcccggttaataaggtggccttacccccactcaccggaaaaggttat

SEQ ID NO: 69455 - protein, 38 aa, Zea mays
  misc_feature: Ceres CLONE 1547643
MGAGRVCRGGNSSVSPAAGRTFSTLAASSSVSPSSAPS

SEQ ID NO: 69456 - DNA, 647 bp, Zea mays
  misc_feature: Ceres CLONE 1547644
  misc_feature (209)..(209): n is a, c, t, g, unknown, or other
  misc_feature (214)..(214): n is a, c, t, g, unknown, or other
  misc_feature (409)..(409): n is a, c, t, g, unknown, or other
  misc_feature (411)..(411): n is a, c, t, g, unknown, or other
  misc_feature (412)..(412): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (525)..(525): n is a, c, t, g, unknown, or other
  misc_feature (527)..(527): n is a, c, t, g, unknown, or other
  misc_feature (528)..(528): n is a, c, t, g, unknown, or other
  misc_feature (535)..(535): n is a, c, t, g, unknown, or other
  misc_feature (547)..(547): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (554)..(554): n is a, c, t, g, unknown, or other
  misc_feature (557)..(557): n is a, c, t, g, unknown, or other
  misc_feature (560)..(560): n is a, c, t, g, unknown, or other
  misc_feature (562)..(562): n is a, c, t, g, unknown, or other
  misc_feature (568)..(568): n is a, c, t, g, unknown, or other
  misc_feature (569)..(569): n is a, c, t, g, unknown, or other
  misc_feature (582)..(582): n is a, c, t, g, unknown, or other
  misc_feature (593)..(593): n is a, c, t, g, unknown, or other
  misc_feature (600)..(600): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (613)..(613): n is a, c, t, g, unknown, or other
  misc_feature (631)..(631): n is a, c, t, g, unknown, or other
aagctggagctccccgcggtggcggccgctctagaactagtggatcccccgggctgcaggaattcgtctcacccctagaaaaagtccaaaaccctagccctcgcgccgccgccgccgtgcccagcgctcgagctcctcgcctgccgcgagctcgcgccgcaacgccaccatgaagttcaacatcgcgaacccgtctaccgggtgccagntaagnaaaagctagggaatatccgatggaacgaacccagaaactacgtggccttttatgaccgaggggatcctccccaggaaggtccaagtggggtgaatgcctcctggggtgaaggaagttttaaagggttaatggctttccaagaaaccttgggggggaatggggaacaaaacaggggcttcccccaagggaaaaaanannaatnnnnnnnnnnnnnnnnnnnnnnnnnnnnnnnnnnnnnnntnnnnnnnnntnnnnnnnnnnnnnnnnnnnnnnnnnnnnnnnnnnnnnnnnnnnnnnnnnnnnnnnntttntnnttttttntttttttttctntcnntnntcnctncncttccnntcctccctctctntcgctgtcggnggggggnaannnnaaaaaanccttcctccctttttcgngctgggccgggggggg

SEQ ID NO: 69457 - DNA, 862 bp, Zea mays
  misc_feature: Ceres CLONE 1547645
  misc_feature (15)..(15): n is a, c, t, g, unknown, or other
  misc_feature (48)..(48): n is a, c, t, g, unknown, or other
  misc_feature (51)..(51): n is a, c, t, g, unknown, or other
aataaaaaaaaagantccccaccccactccccccacttttataggttnganaaaaaagatggagctccacgcggtggcggccgctctatttctagtggatcccccgggctgcaggaattcctctcacccctagaaaaaatcagcctcatcaacctcgacgaaggaggaacgaacggacaggttgttgcacagaagcgacctggctttcgcgcctaaaacgacctcctcctcctcgctgacctctgagttgcaggccgttcagtccccgccgctgctcctgaagagagagctcttcgaaccgcgaaaacgagaacgggaggtatgtagctggccgcttttcttacctacccaccactccccggcaaagaaaagtcagtgagtagctgtttttttttttctggccgcccacaaaaaaaacgcaaaccacacacgacctttttttttttcctcccctgtctctggagtggggggggggcgctcgcacaccttttttaatttttactaggcatttgtctcacccacatgcaacaataaacactcagagcctataactctcatagaaccggacgataataataacccaaccatagcaaatacttcctgagtccaccctcttaaactcccctgacgatacttctcttatctccttcttgctcattcctattatatgatttaggcaacgatgttgaggagaaataactaccattttttcagtcccgcccgctcatttgccgcggaaagaccccacctcaaaacacaacacacacatttcccactcaccccccccagtacaccccccttccacccttgtaatcatttctccccacaagtatagactatacatacctactagccatttcca

SEQ ID NO: 69458 - DNA, 732 bp, Zea mays
  misc_feature: Ceres CLONE 1547651
  misc_feature: Encodes the peptide sequence at SEQ ID NO. 69459
  misc_feature (41)..(41): n is a, c, t, g, unknown, or other
  misc_feature (732)..(732): n is a, c, t, g, unknown, or other
tttttaaataaacctcgttcccccacttcaggaaaaaaaanaaaaccatcccaaaaaaaactggaactcaccgcggtggcggccgctctattctagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccgctgggccatgctgggcgcgttgggctgcctgttcccggaaatgctcgcccgcaacggcgtcaaagttcggcgaggccgtgtggtacaaaggccggggtcacagaatcttccacagaagggtggggcttggaataactttcggcaaaccccaaaccctggattataagcaaaaaaaacaaaccatccgccaaatctgggcccccgtcccagggtcgatggcn

SEQ ID NO: 69459 - protein, 157 aa, Zea mays
  misc_feature: Ceres CLONE 1547651
  misc_feature (64)..(158): Pfam Name: Chloroa_b-bind Pfam Description: Chlorophyll A-B binding protein
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELEVIHSRWAMLGALGCLFPEMLARNGVKVRRGRVVQRPGSQNLPQKGGAWNNFRQTPNPGL

SEQ ID NO: 69460 - DNA, 676 bp, Zea mays
  misc_feature: Ceres CLONE 1547654
  misc_feature (46)..(46): n is a, c, t, g, unknown, or other
  misc_feature (113)..(113): n is a, c, t, g, unknown, or other
  misc_feature (205)..(205): n is a, c, t, g, unknown, or other
  misc_feature (376)..(376): n is a, c, t, g, unknown, or other
  misc_feature (380)..(380): n is a, c, t, g, unknown, or other
  misc_feature (381)..(381): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (396)..(396): n is a, c, t, g, unknown, or other
ggcggccgctctagaactagtggatcccccgggctgcaggaattcntctcacccctagaaaaaaagaaactccgtttcgaattctagggttttgctgctctccgaccccgagntccgaaggccgcagcatcaggcgctccccccctcgcgtgtgaccgagatggcgctgcccaatcaggggaccgttgattaccccagcttcaanctcgtcatcgtcggcgatggtggaactggctaaactacatttgtgaagacgcatctctctggacagtttgagaagaaaatatgaacccccctttgttgtggaagttcatcccgttggatttcaccacaaatttttttctcccccccccctataaggaaaagaaaagggggncacnnccnnnanatttttcnttcccccccagaaatagaaaacaaaaatccttgggcccggggggggagcagcattgtcttcaatttaaccctccaggctttaccttacctagaatgctccctatcctgggcattaataaaccctcgtaccacggggcccccctaacaaactccccctcatttgtcccttaccgtgagaaaaaaaaagcgctgcacgtccacaaaaaccagcggcacggttccataatctccccacacgccttactctttccctctcactacaaaccaggaccacttctgg

SEQ ID NO: 69461 - DNA, 842 bp, Zea mays
  misc_feature: Ceres CLONE 1547657
  misc_feature (44)..(44): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
tttttttttctttttcttttttccctcttagtaatataaaaaanattannnntccacaactggactccacgcggtggcggccgctctatatctagtggatcccccgggctgcacgaatgcgtctcacccctagaaaaaaaccgaaaccaagcaacccaatccaaaccagacaagcaaggaatcccccgatggctcatcgcgttctcctcctcctctctctcgcgtccgccgctgcggttgccgccgccgccgacccgcaggacccgcctgatccggccggtgcttcccggcggatatcacaacgatttggagcttgaacgctgagaaccccctcccgagcttcatgcatcggattctccaaccccctacaaagcaagccgtaccaaatccccgtaacgagcctgtttgtttttttatgatcaatccttgtaaccacagttaccaacgtaccaaagctatccgggaacccatctcgaatacaacgaacccgaaccttatacctaaaccttccccctttaccctcctatccccacccgccaattttccccacctcaacacagctaccgccccgagaacaccgccgaaaatgacccccgaaacacgaaatcaccaatcccaaaacgattatctcacaccccgcaacccccccgcaccaccagagatagtgtcacagaggaaatagaccattaggtaatggaggccctcctgccgggaccctattttcaacgacatagaaaataaaaacaccgcagcaacaacaattaacaaacccgttactacatttttattaagtcctccccccttactgcgccgccgtccagttatgcatcataccctacttg

SEQ ID NO: 69462 - DNA, 644 bp, Zea mays
  misc_feature: Ceres CLONE 1547658
  misc_feature: SWISSPROT Homolog: EC 3.2.1.23 Beta-galactosidase
cgcggtggcggccgctctagaactagtggatcccccgggctgcaggaattcgtctcacccctagaaaaaacccgcaaagatataggcggatagcgtctatccccccaatcctcccgccgcggggacgccttcccctccctccttcctccgtcccatgctccggcgctgacacgttgggccgacttgacctttcgatggacgccgcctccgccatcaccgccgtctccggcgttgtgcttccccaaaccttcctatccccccggacgccgccgccgcaggtcctagccgtggcctcctctttccgccgggtctccttgtgcgcttcccctcgccggatcatctcgcatgatcccccctaaaaaaacaacaaaaaactagacgctcgaggtacccaattcgccctatagtgagtcggattacgcgcgatcactggccgtcggtttacaacgtcgtgactggaaaaaccctggcgttacccaacttactcgccttgcagctcatccccctttcgcctgctggcgtaataacgaagaggcccgcaccgatcgcccttcccaacagttgcgcaacctgaatggcgaatggaacttgttagcgctattattttgttaaaatttcacgttaaattcttgtttaactctccc

SEQ ID NO: 69463 - DNA, 795 bp, Zea mays
  misc_feature: Ceres CLONE 1547662
  misc_feature: Encodes the peptide sequence at SEQ ID NO. 69464
  misc_feature (21)..(21): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
tggtggcatagtaatttgctntatctcacctacaagannnnnccgtctttttttaaacactggagctccccgcggtggcggccgctctataatagtggatcccccgggctgcaggaattcgtctcacccctagaaaaatccgcatccgcataaatcccagtcaaattgaacgagagcgccactcccctctgctaatcccagtcaaatcgaagcaagcatggccatggcggccgtgggcgtgggcggcgcagtggcgttcctcctcccgcagcgccgccagggcgccgtcccctggagcggcgggcggcggcgggcgcccgtggcggtgcgcgcgtcatacgaagccgggatggacgtgatggcagacaaagtgggggatgatgacctacttcgatccgggaaacggggaaaaccgggtgccagtgaaccgtgagacgggttcccgggaagggcgcgaaaagtggttgatataaagacacccccggctcgcgcaaggaaggggatatgaacgcccatccaagctccggggtaccccacagccgtgacgccaaggaactaagtctccacccatccacgggaaacatggcgcccatcctgaggacaaagggtcaggcagccccccgtacgactggagtccaagatgggaaacaaaatatcccggaacttaaccgccgcggtactaacccccttacagtagctataaataacaacttataataagacctccccccacgtatcattctatccaagaaaagggagtagagcccaccacctggagacgagcccaccgggaag

SEQ ID NO: 69464 - protein, 69 aa, Zea mays
  misc_feature: Ceres CLONE 1547662
MAAVGVGGAVAFLLPQRRQGAVPWSGGRRRAPVAVRASYEAGMDVMADKVGDDDLLRSGKRGKPGASEP

SEQ ID NO: 69465 - DNA, 739 bp, Zea mays
  misc_feature: Ceres CLONE 1547664
  misc_feature: Translation starting site: 191
  misc_feature (705)..(705): n is a, c, t, g, unknown, or other
aaagctggagctccccgcggtggcggccgctctagaactagtggatcccccgggctgcaggaattcgtctcacccctagaaaaacccaatatatcccccatctcttcgactcctttctggagcagctagggttccgtcctcgatccgatccgccgagtgcacaccacctttccccactccgatcgaatcgatggccgccgagggcgagaagaagatgataaccctcaaaagctccgatggcgaggagttcgaggtggaagaggcggtggcgatggagtcgcagaccatccgccacatgatcgaggatgactgcgccgacaacggcatccctcttcctaacgtcaactccaagatcctatccaaggtaatcgagtactgcaacaagcacgtacatgccgccgcagccgcagccgccgcctcgaaggccggttccgacgacgtgggtgccgcctccgccaacagcaccgccgcctccggtgaggacctcaagaactgggatgcggacttcgtcaaggtcgaccaggccacgcttttcgacctcatcttggctgcaactatctgaacatcaagggtctgctcgacctgacctgtcagactgttgctgacatgatcagggccaagacacccgaagagattccccagactttcaacatcaagaatgacttcccccctgaggagaaagaagagatccgcagggaaaaccantggggcttcaaggaaggaggggctggaactatta

SEQ ID NO: 69466 - DNA, 534 bp, Zea mays
  misc_feature: Ceres CLONE 1547669
  misc_feature (534)..(534): n is a, c, t, g, unknown, or other
aagctggactccccgcggtggcggccgctctagaactagtggatcccccgggctgcaggattcgtctcacccctagaaaaagtgctttcttagaggtgggttggcttctcctccccctccggttcgggttcgggttcgtgaggttctccgggttcggtttcgtgggtgacggatcgagatggggctcggatgttgatacgctgcttcgtcggcggcctcgcctggcacgacgacactcctcacacgccttagcactacggcgaggtctcgagtccaagatcatcctcgatcggagacccaaaaggtccggcgggtttcggtttcttaccctttttccaggaaggaagggcaattccgaaacccccctttcgaggggttttaaaaccgcaaaaaaatttgaaaggcccaaaaattccccggttaaaaaaaaggggggcccctttcccccccccggggggggctctttttgaaaaaaaggccccccccccccccccgagggggaaaaacaacggggggggggggccccccccccan

SEQ ID NO: 69467 - DNA, 722 bp, Zea mays
  misc_feature: Ceres CLONE 1547670
  misc_feature: SWISSPROT Homolog: EC 3.2.1.23 Beta-galactosidase
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (30)..(30): n is a, c, t, g, unknown, or other
  misc_feature (35)..(35): n is a, c, t, g, unknown, or other
  misc_feature (36)..(36): n is a, c, t, g, unknown, or other
ttatttttnnnnnnnnnnttttttttaatngtatnnaacagattttaaaaagctggagctccccgcggtggcggccgctctagaactagtggatcccccgggctgcaggaattcgtctcacccctagaaaaagtgatgctccttctatgctgctaccggacactactttcgttactgaccgcatatgtagaaacgtatttcttatttagtatgtattttttaggatataaataaaaagatggtgcatattaatgggaaataagttcccttgtatgcattgcgatgtaattttgggaagatttggcaaggaacttaattatactgctacataaccaaaaaaaaaaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcaactcattttttttaaccaataggcccgaaatcggcaaaatccccttataaatcaaaagaatagacccgagatagggttc

SEQ ID NO: 69468 - DNA, 873 bp, Zea mays
  misc_feature: Ceres CLONE 1547677-R
  misc_feature (802)..(802): n is a, c, t, g, unknown, or other
ttgggtacctcgagcgtctcgtttttttttttttttttcgttttttttttttttttttttttttttttttttttttttttgggcgcaatttgcctccgttttatttaacagtacaagatcaacaaaacattttacatttacatcgtccaacgaacgaaccccaaggaataatataaagaaccagcctgtagtataacacgtgttctcctctacaggggggctagatctacccagaccccagaacgggaatcctacattccctttcattcatcatcaattcaacgacatcttcaccgtcgatcccacgcacctgtaacctggaacttcttcttcttcttcttctcgcgcctctcagggctctccatccgtggatctggaggagaccgggcgcaaaaggcacccgcaaccgcgagacgctgcctaatgccccatggcgtggcccgtgtggtggaaactctgccgctgcacgtaggcgaaaaacgccacccgcttgcactggaccctgtgcgccccccaggcccacgaaaaccgcagggactgctgcttttgcctgggggggaaccaattccccaacaccaccaggggggggaccccggaccccatctttaaaaggaagtggggccccggggcactggtctggggggcccaggcgggggacctccctcctcgtttatttcagagggccccgggcaaaccggggttttttgggaaaggaaggcaaccgaagccccccctgtgccccacaggccttaaggggagggcccccccccccggggaaagggggggccccaaagggaggggnccccaccctctggagcgggggggaaacgccccacctcggtggggcccaaaaatgagaaggaaaaagggctg

SEQ ID NO: 69469 - DNA, 852 bp, Zea mays
  misc_feature: Ceres CLONE 1547678
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (12)..(12): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnnnnnggggngggccccctccccctnnanannnnnngggtaaannnnnnagataatggagaatcccgcggtggcggccgctctaaaatagtggatcccccgggctgcaggaattcctctcacccctagaaaaagaacagagcatagagctagcaatacatcgctagctcacttgatatacatattgcatcggcataaaaactgaatttattatggcccacgtggtgtcttctgcaatcccaggcgcgggccaatttgcccctgatggaaccactggtgtaccaggcgaaacccccccctttttaaaagacaacccggaccacttaaagccactatctttttttccctccacggggggggggcaacattcaccccctcctttttttttgccccacaaacctgccctcctaagcgcacaacctttttttttccccccccccccgcgggggggggggggggggggcccaccccccccccctaccttttccccccccacccaccttttcccacaacaacacactccccatctccccccactttgcgcctggggaagatgcctatcacaccaatccctccccgttacagcgctccccctatccccgccaaaaaaacgattcaccgaactcactacctttccttacccgaaacagacccccgccgctcttcacttcgttatttcactccacaccaaccgactaaatttcaccttatgaagatccaaacgccgtcgctctctctatctccttccctcctccgcctcctcccccatcgagcaacggagccacggacgtgattcctacatcccccccacaataaaccacctatatttatcctagacctcaccccgcacg

SEQ ID NO: 69470 - DNA, 740 bp, Zea mays
  misc_feature: Ceres CLONE 1547680
  misc_feature: Encodes the peptide sequence at SEQ ID NO. 69471
ccccgcggtggcggccgctctagaactagtggatcccccgggctgcaggaattcgtctcacccctagaaaaaaatgcaacagatacacacacactcgggtaaagctatctcgagctagctagctgctgtaagccgttgccatggccaaaatggtgttgctctgcgtgctcgtctccttcctcctgatgcccttggcctccctagccctgacgcaggacttctgcgtcgccgacctgacctgcagcgacacgccggcggggtacccgtgcaagtccagcgtcaccgccaacgacttctacttccacggcctggccggccagggcaaaataaacccactcatcaaggccgccgtcaccccggccttcgtgggccagttcccgggcgtcaacgggcttggcatctctgcggccaggctcgacatcgaggtgggcggcgtcgtgccgctgcacacccacccggcgggctcagagctcctcttcgtgacccagggcaccgtcgccgccggcttcatcagctccggcttcaacaccgtctacaccaagacgctgtacgccggcgacatcatggtgttcccgcagggcctgctccactaccagtacaacgcccggaccggcgctgccgttggcctcctcccctttcaacagccctaaccccggcctggagatcaccgaatttgcgcctctttgccaacaacctccccgtcccccctcctggaaaaaaggccactctcttggacgaag

SEQ ID NO: 69471 - protein, 169 aa, Zea mays
  misc_feature: Ceres CLONE 1547680
  misc_feature (55)..(169): Pfam Name: Cupin_1 Pfam Description: Cupin
  misc_feature: SWISSPROT Homolog: EC 1.15.1.1 Superoxide dismutase
MAKMVLLCVLVSFLLMPLASLALTQDFCVADLTCSDTPAGYPCKSSVTANDFYFHGLAGQGKINPLIKAAVTPAFVGQFPGVNGLGISAARLDIEVGGVVPLHTHPAGSELLFVTQGTVAAGFISSGFNTVYTKTLYAGDIMVFPQGLLHYQYNARTGAAVGLLPFQQP

SEQ ID NO: 69472 - DNA, 774 bp, Zea mays
  misc_feature: Ceres CLONE 1547683
  misc_feature: Encodes the peptide sequence at SEQ ID NO. 69473
  misc_feature (1)..(1): n is a, c, t, g, unknown, or other
  misc_feature (9)..(9): n is a, c, t, g, unknown, or other
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nttttcccnttgggggcccnnttccaaaaattannnnnggggccctnnnagcactgtggagctccacgcggtggcggccgctctattactagtggatcccccgggctgcaggaattcgtctcacccctagaaaaaaatcagatcggcaaggccaatccgaaatctcgagctttcgcgccggcgaccacagcaaagaggaggccacagcacgacagcgccccagggttcctactctcgtcgcagcggcagcagtgaggggaagatgtcgtcggtgttcagcggcgatgagaccgcccccttcttcggcttccttggcgccgccgccgctctcgttttctcatgcatgggggcggcgtacgggacggccaagagtggcgtcggcgtggcgtccatgggtgtcatgcgccccagagctcgtcatgaagtccatcgtgccgcgtggtcatggcttggtgtgctcagaatcccccccccccaccatcgacagtcatcatcaacccctgggaatcaacccccagggccaagcccactactaccctcttttgaacggctaagaccccaccgtgtcggtcccggacctttgccctggtggctccttgcctggggcccggcctgtccgggccaggggccatttgggcatacatttgggacgaagctcccgcagtctccggccccaaaccgccccaatatatcccccagcctggtttcgcggagggaatagaatccccgcatatccgggaattttcccaccgaaaaaccgccccccccctttat

SEQ ID NO: 69473 - protein, 152 aa, Zea mays
  misc_feature: Ceres CLONE 1547683
  misc_feature: SWISSPROT Homolog: EC 3.6.3.14 H(+)-transporting two-sector ATPase
MSSVFSGDETAPFFGFLGAAAALVFSCMGAAYGTAKSGVGVASMGVMRPRARHEVHRAAWSWLGVLRIPPPHHRQSSSTPGNQPPGPSPLLPSFERLRPHRVGPGPLPWWLLAWGPACPGQGPFGHTFGTKLPQSPAPNRPNISPSLVSRRE

SEQ ID NO: 69474 - DNA, 716 bp, Zea mays
  misc_feature: Ceres CLONE 1547686
  misc_feature: Encodes the peptide sequence at SEQ ID NO. 69475
aagctggagctccccgcggtggcggccgctctagaactagtggatcccccgggctgcaggaattcgtctcacccctagaaaaatctatctgtattgcccctaaaccttcgtgcccgtttcgcctcgcgcctgcgttgctctgctatttccatttccattgcacccatttccggggtctcctgggttgcttctcgtgggagcgtgattcgtttaggcctctcgcctattgcgaagggcaacggctacgtgctttctgcgggcgggcagagaaaatctagagagtcttgggtttgccagacgcgcctttgtgggagacagacacttgctctcgcctccaatggccgagatctgctgcgaggaaacccagtcgacgccggcaaccgccgtgactgcagcttcagtctccaccaccgccagcagcgtgccgcagccgtggcagtggcctcctcggcgttagagaggaggcaacgcatgctggagatgacgaggttccgcgtcgcgagcgatcccgaggagctggtcgcggaggacgtccgcgctgcccagcggcagaggctggcgcgcacgctgtccagctcctgccccgacgcgggctccgactccgacaggccggccctgcccaagtactgagtcacctccgtctgcggccgactgcgcgagatggaggacacggtctccatcagggcggacttgctgcacggcaccatcaagcacag

SEQ ID NO: 69475 - protein, 52 aa, Zea mays
  misc_feature: Ceres CLONE 1547686
MLEMTRFRVASDPEELVAEDVRAAQRQRLARTLSSSCPDAGSDSDRPALPKY

SEQ ID NO: 69476 - DNA, 669 bp, Zea mays
  misc_feature: Ceres CLONE 1547687
  misc_feature: Encodes the peptide sequence at SEQ ID NO. 69477
  misc_feature (669)..(669): n is a, c, t, g, unknown, or other
cgcggtggcggccgctctttcctagtggatcccccgggctgcaggaattcgtctcacccctagaaaaattttgggtccacaattccgcattgccatctagtccagttccagtccgagcagcagcaagcggcggcggcgatgggctctggatccaactccaaggagggagaggagcgggtgctgagccacggtgacgtggtgctcatccgctccgacctcgcaatccttcgcggtccctgcttcatcaacgaccgcatcattgccttctacttcgcacacctctccgccagcctccaggacgacgacctcctcctgcttccgccctccatcccctacctcctctccaacctccctgactcggccgccgtcgccgccgtcgccgagccgctccgcctcgcctcccgccgcctcgtgctgcttcctgtcaacgacaatcccgatgcctccatcgtcgagggcggttcccactggaacctcctcatccttgataacatcactagcccctccgtgccccgcttttgtcccccacgaacagcatcccttggagccccccaaccttcccaattcgctggcccggccttcttctaaagcaacacccgccccccttggcttgtcctgggcaagccaattctccaaaaagcgaataactgtttcccccatttaatctan

SEQ ID NO: 69477 - protein, 149 aa, Zea mays
  misc_feature: Ceres CLONE 1547687
MGSGSNSKEGEERVLSHGDVVLIRSDLAILRGPCFINDRIIAFYFAHLSASLQDDDLLLLPPSIPYLLSNLPDSAAVAAVAEPLRLASRRLVLLPVNDNPDASIVEGGSHWNLLILDNITSPSVPRFCPPRTASLGAPQPSQFAGPAFF

SEQ ID NO: 69478 - DNA, 766 bp, Zea mays
  misc_feature: Ceres CLONE 1547688
  misc_feature: Encodes the peptide sequence at SEQ ID NO. 69479
  misc_feature (31)..(31): n is a, c, t, g, unknown, or other
  misc_feature (37)..(37): n is a, c, t, g, unknown, or other
  misc_feature (39)..(39): n is a, c, t, g, unknown, or other
  misc_feature (766)..(766): n is a, c, t, g, unknown, or other
tatatttaaaaattattatattatggacccncattcncncacaacaaactaagctggggctcaccgcggtggcggccgctctttactagtggatcccccgggttgtaggcattcgtctcacccctagaaaaccgcttccacaccactcctcaccagtagcccagatggatatagcaaggccacacacccacacgcaccactaggctaggttagccttttaaacgccatccatacacatgaagggcgcgcacagccccccgctagcaagaagagagccgatcgacctagagctagcacgcgatggcgaggacttccaagatgatggtggcggcagctctgctgaccttgaccctggccgagtcaaacgtaaatgcgaggaacatcaagaccgcgatgacggagatgactggagatacggtggtgcagccgcagaccttcccgcccttcaaccgccttagaggcggcacgaccccggctatcggcggcctcccccggcggcagcattctggtacacactattcctagggtttatggtagctcggcgtcgtgaagaaaaccaaaccggggaaaagctatgtccggcaaccggccaggagggcacatatttcggctggggggtttccccgcgggattcgctccgatgctccacgggggccggggctatgggctagatcccctccatttcaagcgttcccacgcacaatgaaagactgcttccagttcataacgccttggtcaactcgcaccacacaaactttaatggttn

SEQ ID NO: 69479 - protein, 74 aa, Zea mays
  misc_feature: Ceres CLONE 1547688
MARTSKMMVAAALLTLTLAESNVNARNIKTAMTEMTGDTVVQPQTFPPFNRLRGGTTPAIGGLPRRQHSGTHYS

SEQ ID NO: 69480 - DNA, 735 bp, Zea mays
  misc_feature: Ceres CLONE 1547691
  misc_feature: Encodes the peptide sequence at SEQ ID NO. 69481
  misc_feature (665)..(665): n is a, c, t, g, unknown, or other
  misc_feature (675)..(675): n is a, c, t, g, unknown, or other
  misc_feature (676)..(676): n is a, c, t, g, unknown, or other
  misc_feature (727)..(727): n is a, c, t, g, unknown, or other
aagctggagctccccgcggtggcggccgctctagaactagtggatcccccgggctgcaggaattcgtctcacccctagaaaaatcgtcgctcggtccaccacctcagctccgccgcttgcccgcttttgctctctccctcccggctctcggcttcttctacacgctaccgtctcacagccgtaaacgcccctcccggatcccgctagttcgccaccgccgcccgcccgcccgccgttcgcctcatcatggccgcctcgtcgaccgccacctccgtccacgacttcatcgtcaaggatgcgagcggcaaagacgttgacctcagcacctacaaggggaaggttcttctcattgttaacgccgcatcccagtgtggcttaaccaactccaactacactgagctggcccagctctatgagaagtacaaggaccaaggctttgaaatcctggctttcccatgcaaccagtttggtgggcaggagcctggtaccaatgaggagattgtccagtttgcctgcacacgcttcaaggctgagtaccccatcttcgacaaggttgatgtcaacggtagcaatgctgcgccccatctacagttcttgaaatctagcaaaggtgggcctttcggcgacagcatcaagtggaacttttcaaaagtctggttgacaangagggacgtnngtgtgatcgctatgctccaacacttcacccctgagcattgagaaggatatncagaagct

SEQ ID NO: 69481 - protein, 156 aa, Zea mays
  misc_feature: Ceres CLONE 1547691
  misc_feature (10)..(118): Pfam Name: GSHPx Pfam Description: Glutathione peroxidase
  misc_feature: SWISSPROT Homolog: EC 1.11.1.12 Phospholipid-hydroperoxide glutathione peroxidase
  misc_feature (140)..(140): Xaa is any aa, unknown, or other
  misc_feature (144)..(144): Xaa is any aa, unknown, or other
MAASSTATSVHDFIVKDASGKDVDLSTYKGKVLLIVNAASQCGLTNSNYTELAQLYEKYKDQGFEILAFPCNQFGGQEPGTNEEIVQFACTRFKAEYPIFDKVDVNGSNAAPHLQFLKSSKGGPFGDSIKWNFSKVWLTXRDVXVIAMLQHFTPEH

SEQ ID NO: 69482 - DNA, 902 bp, Zea mays
  misc_feature: Ceres CLONE 1547696
  misc_feature: Encodes the peptide sequence at SEQ ID NO. 69483
ttcctccgatccgagtgcggttcgacctatttatctctttttcctcgagcgggaggtccccacggtgggtgtccgctctataactagtggatcccccgggcgtgaggaattcgtctcacccctggaaaaaagctcagtcctcttcagccccgtttctccgcccctagcccaaatcctccacttactcgccgccggcgccgtctcagcctcatccttctccgctagccatggtcgtcgcgggtcccgggctctactccgagatcgggaagaaggccggagatctcctatataaggactaccacacggaccagaagttcacgctcaccacctacgccgtcaacggatctgccattactgctgcaagcacgtaggaatgatgaagcttatctttaatgaaatccggagccagctgatgcaccatcaatgtgacttgtggatgtgaaagcaactttcaggattcaaatgtggataaactacaattacaagttcatgaacctgggacacatccaagtgcttgaaaggcaattatataatggcgtttcccttttcccggtaacccaacaaatccttggcatatggcctgaaaccttcccaagaattttggtcacccacccattgtccgtgttggttggccagccaagttggtttgggccctaaaatagcaaaaccccctggtatgattaaaccctttatctcggatggtatttccggaaacttaaaagcttatttgcttgattgtgcgtcttaagagcatacattttggatacctttcattcagggagactttaacccaaattctagagggctggggctggggcttagagttgacgccggtaacattggttggctggtgcgttcctttggaaccaacgaaggggaaataaagtttggccccctttacg

SEQ ID NO: 69483 - protein, 47 aa, Zea mays
  misc_feature: Ceres CLONE 1547696
MVVAGPGLYSEIGKKAGDLLYKDYHTDQKFTLTTYAVNGSAITAAST

SEQ ID NO: 69484 - DNA, 705 bp, Zea mays
  misc_feature: Ceres CLONE 1547699
  misc_feature: Encodes the peptide sequence at SEQ ID NO. 69485
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (20)..(20): n is a, c, t, g, unknown, or other
  misc_feature (21)..(21): n is a, c, t, g, unknown, or other
  misc_feature (26)..(26): n is a, c, t, g, unknown, or other
  misc_feature (27)..(27): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (128)..(128): n is a, c, t, g, unknown, or other
  misc_feature (151)..(151): n is a, c, t, g, unknown, or other
  misc_feature (348)..(348): n is a, c, t, g, unknown, or other
  misc_feature (451)..(451): n is a, c, t, g, unknown, or other
ttgggggcnnnnnnnnnccnnccccnnccttnnnnnttnncccnnnnnnaaaaactggaactccacgcggtggcggccgctctttactactggatcccccgggctgcaagaattcctctcacccctanaaaaccaacctcgtgttcgttcnaagcgcacacacacacaatcacatctcccccaaatccacccgtcggcacctccgcttcaagatgcaaatctttgtgaaaaccctgaccggcaagactatcaccctccaggtggactcatctgacaccattgacaacgttaaggccaacatccaagacaaggaaggcatccccccagaccagcagcggctcatcttcnatggcaaacagcttgaggacgggcgcacgcttgctgactacaacatccaaaacgaaagcaccctccaccttgtgctccgcctcaggggaggcatggagatccntgtgaaaacccccaccggcaagactatcaccctcaaggtggagtcctctgacaccattgaacacgtccaagccaagatccaggacaaagagggcatccctccagaccagcaacggctcatctttgctgggaagcatcttgaggacgggcgcacgcttgccgactaccattccacaaagagagcaccctcccacttggtggctgcccctcaaggtgaggcttgccagaattttcctggaagacccctgagcgggg

SEQ ID NO: 69485 - protein, 164 aa, Zea mays
  misc_feature: Ceres CLONE 1547699
  misc_feature (6)..(74): Pfam Name: ubiquitin Pfam Description: Ubiquitin family
  misc_feature (82)..(150): Pfam Name: ubiquitin Pfam Description: Ubiquitin family
  misc_feature (46)..(46): Xaa is any aa, unknown, or other
  misc_feature (80)..(80): Xaa is any aa, unknown, or other
MQIFVKTLTGKTITLQVDSSDTIDNVKANIQDKEGIPPDQQRLIFXGKQLEDGRTLADYNIQNESTLHLVLRLRGGMEIXVKTPTGKTITLKVESSDTIEHVQAKIQDKEGIPPDQQRLIFAGKHLEDGRTLADYHSTKRAPSHLVAAPQGEACQNFPGRPLSG

SEQ ID NO: 69486 - DNA, 730 bp, Zea mays
  misc_feature: Ceres CLONE 1547711
  misc_feature: SWISSPROT Homolog: EC 3.2.1.23 Beta-galactosidase
  misc_feature (19)..(19): n is a, c, t, g, unknown, or other
  misc_feature (20)..(20): n is a, c, t, g, unknown, or other
  misc_feature (32)..(32): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (63)..(63): n is a, c, t, g, unknown, or other
taaataaaataaaaaaaanngtgggttgacgnggnnnnnnnnngnngnnnaaaaagtggaacntcccgcggtggcggccgctctagaactagtggatcccccgggctgcaggaattcgtctcacccctagaaaaatattgctgctgcccattggttacttggcagtacatactgatcatgttttgtcatatcctgcattctaatctgtagcctacgggatttttttggagtgtaggccctacatgatatgaggatacacagggtcggcactttgcatactgatcagcaggattattaaaactttcagttacaaaaaaaaaaaaaaaaacgagacgctcgaggtacccaattcgccctatagtgagtcgtattacgcgcgctcactggccgtcgttttacaacatcgtgactggcaaaaccctggcgttacccaacttaatcgccttgcagcacatccccctttcgcctgatagcttaatagcgaagaggcccgcacctatcgcccttcccaacagttgcccaacctgaatggcgaatggaaattgtaagcgttaatattttgttaaaattcacgttaaatttttgttaaatcagctcatttttttaaccaattaggccaaaatccgcacaatccccttataactccaaaagaatagcaccgagaaaagggcttgatttgttgttcccaggttggaaaacaagagtaccactctttaaaaagaacctggca

SEQ ID NO: 69487 - DNA, 778 bp, Zea mays
  misc_feature: Ceres CLONE 1547712
  misc_feature: Encodes the peptide sequence at SEQ ID NO. 69488
  misc_feature (57)..(57): n is a, c, t, g, unknown, or other
  misc_feature (748)..(748): n is a, c, t, g, unknown, or other
aatggtgatatattgatttgtaacgcacgatcacagtactagaaacacgcccgtggngcatagctgggactccccgcggtggcggccgctctagaatagtggatcccccgggctgcaggaattcgtctcacccctagaaaaagcccctctctcccaccccgcagccgccctagcacccgacgacgagcaggatctcgccgcagttgcgtcttgcggtagttcccccaactgtcaccatgcataacgaggagggtaagactgtggacctctatgtccccaggaagtgctcggccacaaacaggaatcaatccagctggcccaagggaccctgtccccgtgccaaaataaaaattgggcccctttggaatgcccaaagggcccggttttaaatggcccacttcccaaaggttgggcccccccccgggggttgggcccgggcccccggggggaacagaaaaaaacgcctctttggaaacaggggggggggagaaaaaaaaaaaaaaagggcgggaaattccaacccccgcccaaaaattttcttaacccctcgcgggctttccccccaaaaaattggggggaaaacccccccccccttataaaaaaaggggggtgtttaaaaaaatatcccggggggcaaccacacttttagcgcctcacaaaaagggttgggtgaggggcttccccccatgggggtgtgggcaccttcctctttatctctcctccagaaaaaatacattgtgtgtctcgnccctcatcaaaacacgcaaataaaccaaac

SEQ ID NO: 69488 - protein, 50 aa, Zea mays
  misc_feature: Ceres CLONE 1547712
MHNEEGKTVDLYVPRKCSATNRNQSSWPKGPCPRAKIKIGPLWNAQRARF

SEQ ID NO: 69489 - DNA, 760 bp, Zea mays
  misc_feature: Ceres CLONE 1547713
  misc_feature: Encodes the peptide sequence at SEQ ID NO. 69490
  misc_feature (38)..(38): n is a, c, t, g, unknown, or other
  misc_feature (41)..(41): n is a, c, t, g, unknown, or other
aaataaaaatatataaaacgacttcctccccttcccanagnaaaaaaaaaagccaaaaactggggctccccgcggtggcggccgctctatactagtggatcccccgggctgcaggaattcgtctcacccctagaaaaagttgcggataacggggaggaggcggagcgaccaacggcacaggcaccatggcgatgcgagcagctacagcggcggcgacaggcttcttctctccatccaccgtccctccgaggcgcttctcgtccgttacaccgccggcgtcactctgcaccgcgcgctgcatccagcgacaccgtctccgcgccttcccaagcttggaaatacctctagaggaactcaacccatccgtcgatctacttaagagacctgcggaggccgttggcgatttcaggagaacgccaatctatatttgttggtacggattgcacagccaagcgcaacatcgccaagctgcttgcgaattccctactatgccgctacctcatcagtgaggaactgcctggaggaaatgttccttggcggccaaggaagcccctccgagccttacagggaatctgaagtaaaaagggttattcttgaaatcgaaaacccaaagggtaaaaggcacgatcgcggtcccatggggaaaggcctttggaacttgtggcccgggggaaaaatggcggacccctcttgtggaaacatcccaccccccactcttttttcgccctgcctttgaaaggccatagggggcgcgttctcc

SEQ ID NO: 69490 - protein, 69 aa, Zea mays
  misc_feature: Ceres CLONE 1547713
MFLGGQGSPSEPYRESEVKRVILEIENPKGKRHDRGPMGKGLWNLWPGGKMADPSCGNIPPPTLFSPCL

SEQ ID NO: 69491 - DNA, 630 bp, Zea mays
  misc_feature: Ceres CLONE 1547719
  misc_feature: Encodes the peptide sequence at SEQ ID NO. 69492
ggagctccccgcggtggcggccgctctagaactagtggatcccccgggctgcaggaattcgtctcacccctagaaaaatgtgtatacacgtcaggtagcttgcaaaacaacagtacgacgtatcccggccgtctaccatgcctgaggcgtatataggctataggcttatgcaaagcatgtaccattaattaattattacatagtctttttatgtcaaagtagtggaggcaaccatgatcttccttcaccgctcctcccccctgttctatccccggtggttgatggtatgtcggttgtaccagactcagagtaacagatgtcgtggccctcgggtacccttcctcctttctcctctcggtggttgttggctccatgttgtagcaatgattgttgttgccgtaaatttagatttatgtttccttacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagtg

SEQ ID NO: 69492 - protein, 104 aa, Zea mays
  misc_feature: Ceres CLONE 1547719
  misc_feature: SWISSPROT Homolog: EC 3.2.1.23 Beta-galactosidase
MSWPSGTLPPFSSRWLLAPCCSNDCCCRKFRFMFPYKKKKKNETLEVPNSPYSESYYARSLAVVLQRRDWENPGVTQLNRLAAHPPFASWRNSEEARTDRPSQQ

SEQ ID NO: 69493 - DNA, 749 bp, Zea mays
  misc_feature: Ceres CLONE 1547721
  misc_feature: Encodes the peptide sequence at SEQ ID NO. 69494
ttttttttttttttttttttttattgtctccctcattcttctttacaccccctacaccatctcatggaactcaccgcggtggcggccgctctagactagtggatcccccgggctgcaggaattcgtctcacccctagaaaaatgtctctacagttggtgaagttcaagagcagtcgaacttcccatgctagcagttgtgttgtggtcaagtgtggtttgtgcatcgctaaggttctgggactgaagctatgtcacatttgttcacttctcattgacgcaaagggaacagacgaaacaacagttgtcttggaagtggtagtgggtctgatatatctgcgagagtattaaaacaccacagagtgcaatgattgaagtaagattctttagggaaattttaaatccgccctcaaaacctccctaataataactgagaaggtttgaaattttgttcccacagcaacaccccatgggtttttggccccgaaaaaaacccgaaaaactttttggatctttccacaaaaaacaaaaaaatcttccgctcccccggagaaaaacttcttttttttttgtggcgcccccccctttttttcctgcctgggggtaaaaatatctccttctctttttttattttctacaaataattttcccaccaacaaatattactcaacctccctcccataattgagaaacgaaacaaataacattttcttcctctcccacccctctggaatatttctggagggtggacc

SEQ ID NO: 69494 - protein, 68 aa, Zea mays
  misc_feature: Ceres CLONE 1547721
MSLQLVKFKSSRTSHASSCVVVKCGLCIAKVLGLKLCHICSLLIDAKGTDETTVVLEVVVGLIYLREY

SEQ ID NO: 69495 - DNA, 624 bp, Zea mays
  misc_feature: Ceres CLONE 1547727
  misc_feature: Encodes the peptide sequence at SEQ ID NO. 69496
cgcggtggcggccgctctagaactagtggatcccccgggctgcaggaattcgtctcacccctagaaaaaattgggggtatttgctataccaccacacccacaccccatcccagcacacaacaagcagactgctttacggtagctgctagcaaaacaatgagagaaccctgctcagatcatcatagagatcatcctctcccccttgcggatccgatctcgagaagctcaccttccgtgctgctgtatatacgcagaagatgatcatgacgccgaggagatgaatgatgccaccaatgtcatcccaccagctggacaagatagtcttcactgacaaccccgtgtacgacggcagtagcatcaacacccgcctcgtggctcagcatacacgatagtcacgtgtcctgctccgaaacgcatacgccttgttcaccatggtgttctacatcgacatgctaatgggctcctcgctcgtcatcaatgtaatggtcacggatggattcgacaaatggtcgatctactatctgaaccagtctgttcgtcatggccatcggtgtcatgaagagaagaaaccttgccggcggtagcaacgacgggaactctgacgagcttgccctgaaagttttc

SEQ ID NO: 69496 - protein, 28 aa, Zea mays
  misc_feature: Ceres CLONE 1547727
MAIGVMKRRNLAGGSNDGNSDELALKVF

SEQ ID NO: 69497 - DNA, 644 bp, Zea mays
  misc_feature: Ceres CLONE 1547728
tagctggagctccccgcggtggcggccgctctaccaatagtggatcccccgggctgcaggaattcgtctcacccctagaaaaaaccatcaagaccaacaaacccacttctagactgaccactgtagtccgcagaagagatctcgcggacggacactcagacatactgatggccgcgtgtagcgctgcaccaaaggacctgctgcctcgagagtagccctgagtctcccgcgccgacggcatcaatagctgttgccgcattacctggggccccaccaatcaagaccgtcccccagagcatatggtactgccctgatcccaccaagtatcttggcccggtctccgaggagacgccctcctacctgacctgcgagatactcggctactaccgatggaactccgcgggcctctcggcctacccggagacattcgcgcgcaaccggtagctggagctgatccactcccagcgggcgatgctgggcacgatgggctgcgtgttcccggagatactgacctagaaccgcgtcaagttcggcgaggcggtgtggttctaggccggcgcgcagatcttctccgagggcgggctggactacctggggaaccccaacctggtgcacgcactgagcatcctggccatctgggcgtg

SEQ ID NO: 69498 - DNA, 610 bp, Zea mays
  misc_feature: Ceres CLONE 1547729
  misc_feature (359)..(359): n is a, c, t, g, unknown, or other
  misc_feature (610)..(610): n is a, c, t, g, unknown, or other
ggatcccccgggctgcaggaattcgtctcacccctagaaaaaaaaatttcggaactaccagtggcagactggcagtacaggctaccagcccacatgcttttctttccctcccgttccccgtctgtctccctctcgtcgcatcgcgcaccgcttccccagttcccccagctccccccaccttccgttgccttctcgaactcaacccccgcccccgtcgcggatcgtcatggccgccggcctcttcttccccgtcgcctcctttccactcacctgcgtctcctcacctccccaccccgggcaccgcatctgctgttttttccccccccccggggggaaagaagggggggatatcctctccncctccccttctactaccagtcctctccaaaagaacgactggggcaggggcgggggcgcggaccctattgttgccccgtccaaggcccagaacccgaactatcctagtcccaaatgtgatcaaatccaacatgggctatcactccttgttcgcaaaagcaatctttcctgtcctgtataaaaattcttcggcgagatttggaggagtgcctttgctgaaattgagacaaacgcgtttttggcacacctcctn

SEQ ID NO: 69499 - DNA, 722 bp, Zea mays
  misc_feature: Ceres CLONE 1547731
atagctggagctccccgcggtggcggccgctctagaactagtggatcccccgggctgcaggaattcgtctcacccctagaaaaaatcgtcctaacaacttctgctggaattatggaccatgaggaggcccgccgtaagaatgttggtggcaaggttctaggtttcttttattgaaaatgtgtttttttgagccacagatgcgtccaagaactcgtctgatgttttgaggtttgttaagactgggtgtctgagcctttgcggtttgttaagacagcgatgtgtcatgtatttcagaaattgggatttttatgagatgtacctgctagagccctgtctgtttcgattttcagatattggttttgatttatgcgatacaaacaggtcctttagtccaaaaaaagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccagccggcggcggcgtccgggagcccgtggtaccccggaccgcgtgctgtacctgggcccactgtccggcgaagccgccaagctacctgacgggcgagtttctgggcgactacggctgggacaccgcggggctgtcg

SEQ ID NO: 69500 - DNA, 704 bp, Zea mays
  misc_feature: Ceres CLONE 1547732
  misc_feature: Encodes the peptide sequence at SEQ ID NO. 69501
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (33)..(33): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
nnnaaacccccnnnnaaggaaaaaaactaaccncccctcnnnncaacnnnntcaaactggaactcacgcggtggcggccgctctacactagtggatcccccgggctgcaggaattcgtctcacccctagaaaaaaacgacgggagagagtggccatggcgtcatccgccgccgccgcctcctcggcttccgcgctcttccgcctcccggggtcgggtcacctgcgtgcaccgccacgaagcgggtggcgagaccacaggcggtcccgtcgcgcgaccgtgcggtgctcgttcgcgccggtggagacggcccggataaaggtggtgggcgttggcggaggcggcaacaacgccgtcaaccgtatgatcggcagcggcctccagggcatcgaattttatgctataaacaccgattcccaagcccttattaattcacaagcgcaatatcctctgcaaattggagagcacctgacccgcggcttaggtaccggtggaaatcccgaatttgggagagccaggctgctgaggaatcaagagaaaccatagccactgccctgagggattcagatcttgtcttcctaacagctgggatggggaggggggtactgggatccgggtggctgctccaactgttggcccgtaaatcaaaaggaaagctgggttatccttacctggttgggtggtgggccaccctaatcccattcaa

SEQ ID NO: 69501 - protein, 129 aa, Zea mays
  misc_feature: Ceres CLONE 1547732
MASSAAAASSASALFRLPGSGHLRAPPRSGWRDHRRSRRATVRCSFAPVETARIKVVGVGGGGNNAVNRMIGSGLQGIEFYAINTDSQALINSQAQYPLQIGEHLTRGLGTGGNPEFGRARLLRNQEKP

SEQ ID NO: 69502 - DNA, 798 bp, Zea mays
  misc_feature: Ceres CLONE 1547734
  misc_feature (7)..(7): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (27)..(27): n is a, c, t, g, unknown, or other
  misc_feature (28)..(28): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
ttttttnagttnnattncagttccccnnatataannnggnnntccaaatnnaaccctcgagctccccgcggtggcggccgctctatactactggatcccccgggctgcaggaatgcgtctcacccctagaaaagctagcgcgagtggtggcacccacgcacactcttctccccccagtccggaccctacgagagccaagccatggcgtccacctcctgctgcctcctccaccagtcaaccgcccgcctcggcgcgtcgccgcgcctggccgccgccccgccgcgcagcgcccaactgctcttctgccaggcccggaagcaggacgccgcccccgtacctgagcgacgatttcgcgccgcgccgcgcttcgcgcttcctcgccgggcataccggtcgtccccaggccccctaggtgtgttcccccccccccccctgctttggggggggaagcggcccaacctcgtttccgtaaacccccagggccccaccccgctaatacatcctcctatcccccctccccaccctctttcaaagctcgcccggatgccccctcccgtccggggaaaccccccgtccaacgggcacctgggtaacttcccccccgtgcactactcgctttctgccttccttatcaacgcacttttcgtttggccctacctgttccaattgtgtctctcccttctcaccctctcacgatctccccccttgttcccgtaaatacaccattccccccctaaacctccgcggtatgcacaacccctatgaggtctcaacccatctcgcccgcatataggattg

SEQ ID NO: 69503 - DNA, 823 bp, Zea mays
  misc_feature: Ceres CLONE 1547736
  misc_feature: Encodes the peptide sequence at SEQ ID NO. 69504
  misc_feature (1)..(1): n is a, c, t, g, unknown, or other
  misc_feature (2)..(2): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (48)..(48): n is a, c, t, g, unknown, or other
  misc_feature (49)..(49): n is a, c, t, g, unknown, or other
  misc_feature (130)..(130): n is a, c, t, g, unknown, or other
  misc_feature (823)..(823): n is a, c, t, g, unknown, or other
nntttttttccgagggcccccactcaaccttaccnnnnttgcaacacnncccaatacaggactccccgcggtggcggccgctctataactaatggatcccccgggctgcaggaattcgtctcacccctangaaaaacaaggcccaagctcagcgaccaccaagcagagcaagccagtgaggtctctcagagcgtagccagccagctacaatggcggggaacgcgctagccaactatgtccaggtctacgtcatgctcccgctggatgtcatcactgtcgacaacacgttcgagaaggaggacaagacgagggcgcaactgaaaaagctgaccgaggccggcgccgaccgggtcatgatccacgcctggcgggggcttggtggaagggaaggagccgggaatcctacaattgcatccccctacacccccgtgttcgggggggggggaccgaagccccgtcattaaatttccccccccctccagtcccttgccaacatatggcgacgatacaacactccttgcaacggtacaaaaaaccatcccccgaaatccccccacatggaggtccgcgcgaaaactcccttaaaaaagctaaactcccgctctattgatctctttgctcgctaaatgtggagatgcgggttttgcccaaaacccccccccgatgacctcccctccatcatggacgaggaaaaaacacacactctcctcctttttccgatggcccaaaccccatccccttttcaaatattcactcatctcccaactttcacctccaacccccctttaccctcgactatacaaatgacttacacccacgacan

SEQ ID NO: 69504 - protein, 84 aa, Zea mays
  misc_feature: Ceres CLONE 1547736
  misc_feature: SWISSPROT Homolog: EC 3.2.1.2 Beta-amylase
MAGNALANYVQVYVMLPLDVITVDNTFEKEDKTRAQLKKLTEAGADRVMIHAWRGLGGREGAGNPTIASPYTPVFGGGGPKPRH

SEQ ID NO: 69505 - DNA, 653 bp, Zea mays
  misc_feature: Ceres CLONE 1547738
  misc_feature: Encodes the peptide sequence at SEQ ID NO. 69506
aaagctggagctcaccgcggtggcggccgctctagaactagtggatcccccgggctgcaagaattcgtctcacccctagaaaaaagcagccacgtccatgacgttctcccgtttcgcccgccatcggtcagcctgtgtccgtggctctcgcctgccacagtgccacccaagcagccatggcggccgcgctgctccgccgtgcgctccacctccgccgcgtgctcccctcgcccctcgcctccgcacagcgcctctcccccgccttctcggccactccgaccccgaagacctcccagcagaacgccgccatcaccacgatcgacctctcctccgacgagagtcgccgccgcctcctcaacaggttggtgtaccggagcaagcagcggggtttcctggagctcgacctggtgctgggcacctgggtcgaacatcacgtgcacgccatggacgagcccaacatccgcgcccttctacaagtgctcgacctcgaaaacccagatttgtggaaatggttgactagtcaggagcagccaccagaggatctgaattctaatccggtgttttctgccatcaaatcaaaggtcacagataacctgatcaagcatgcttctcccgagaaccgatcaacacctggccaaccttgggttagagga

SEQ ID NO: 69506 - protein, 159 aa, Zea mays
  misc_feature: Ceres CLONE 1547738
  misc_feature (55)..(139): Pfam Name: DUF339 Pfam Description: Protein of unknown function (DUF339)
MAAALLRRALHLRRVLPSPLASAQRLSPAFSATPTPKTSQQNAAITTIDLSSDESRRRLLNRLVYRSKQRGFLELDLVLGTWVEHHVHAMDEPNIRALLQVLDLENPDLWKWLTSQEQPPEDLNSNPVFSAIKSKVTDNLIKHASPENRSTPGQPWVRG

SEQ ID NO: 69507 - DNA, 645 bp, Zea mays
  misc_feature: Ceres CLONE 1547739
  misc_feature: Encodes the peptide sequence at SEQ ID NO. 69508
ccccgcggtggcggccgctctagaactagtggatcccccgggctgcaggaattcgtctcacccctagaaaaaaccacgccgccactcacgaccacgccgcgcctccgcctggaaccctttagccgagcggagcaaggaaagaaatggggaagggtacgggcagcttcggcaagcgccggaacaagacgcacacgctctgcatccgctgcggccgccgcagcttccacctccagaagaacacctgctcctcctgcggctaccccgccgcccgcatccgcaagtataactggagtgggaaggccatccggcgtaagacaactgggacccgaaagatgaaggacatgccacacgtgcctccccctttccagaaccacttccgaaaaaggactgaagctgcccccaaaaaaggtggtgctgctgcccactaaatggggtcttactgccctccaaaaacccctaaacctgaaaacttttgaatgaattggacttccgaaccatttaacccataatactatgcctgaattaatttcagaacccccggaaaagtatatgtaaaaaaaaaaaaaaaaaccagacgctcgaaggaccccattccccctataatgaagcggattacccgcgctcactggccctcgttttacaacg

SEQ ID NO: 69508 - protein, 94 aa, Zea mays
  misc_feature: Ceres CLONE 1547739
  misc_feature (2)..(55): Pfam Name: Ribosomal_L37e Pfam Description: Ribosomal protein L37e
MGKGTGSFGKRRNKTHTLCIRCGRRSFHLQKNTCSSCGYPAARIRKYNWSGKAIRRKTTGTRKMKDMPHVPPPFQNHFRKRTEAAPKKGGAAAH

SEQ ID NO: 69509 - DNA, 725 bp, Zea mays
  misc_feature: Ceres CLONE 1547743
  misc_feature: Pfam Name: FAD_binding_8 Pfam Description: FAD-binding domain
  misc_feature: SWISSPROT Homolog: EC 1.6.3.1 NAD(P)H oxidase
  misc_feature (321)..(321): n is a, c, t, g, unknown, or other
  misc_feature (382)..(382): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (393)..(393): n is a, c, t, g, unknown, or other
  misc_feature (396)..(396): n is a, c, t, g, unknown, or other
  misc_feature (397)..(397): n is a, c, t, g, unknown, or other
tccccgcggtggcggccgctctagaactagtggatcccccgggctgcaggaattcgtctcacccctagaaaaattgttcaatgtccagcagtgtcaccctttgaatggcatccgttctcaattacttcagcgcctggggatgattatctaagcattcatgtgcgacaacttggtgactggacacgagagctcaggagggtttttgcagcagcttgtgaacccccagtgggcggtaaaagtggccttcttagagcagacgagacaaccaagaaagccttaccaaaacttctgattgatggaccttatggttctcctgctcangattacagcaagtatgatgttcttcttttttttcccccccccagaggaaagaaagggggtntcnncnnnctnaannatcttcttaccaatattataaagaaggaggaagaggaggatgcttcccccggtctttatcccccccctggcccaaacaaaccccaaccttatttcacacaccttttgacgcccccctccccggcccaaaaagggttgcaaaggaccccaaacgctttactttcattggggttcccgcagagccaaggctcctttttaatgggggccagagcacctccgaacctaaaattgctcaacttctccccccaggtgtgttcaatacctcccttcccctcacctttctgggttttaatatccctgtcgtccacttcgcccaaactcccaccttg

SEQ ID NO: 69510 - DNA, 679 bp, Zea mays
  misc_feature: Ceres CLONE 1547744
  misc_feature: Encodes the peptide sequence at SEQ ID NO. 69511
  misc_feature (338)..(338): n is a, c, t, g, unknown, or other
  misc_feature (351)..(351): n is a, c, t, g, unknown, or other
  misc_feature (373)..(373): n is a, c, t, g, unknown, or other
  misc_feature (434)..(434): n is a, c, t, g, unknown, or other
  misc_feature (438)..(438): n is a, c, t, g, unknown, or other
  misc_feature (442)..(442): n is a, c, t, g, unknown, or other
  misc_feature (472)..(472): n is a, c, t, g, unknown, or other
  misc_feature (480)..(480): n is a, c, t, g, unknown, or other
  misc_feature (486)..(486): n is a, c, t, g, unknown, or other
  misc_feature (492)..(492): n is a, c, t, g, unknown, or other
  misc_feature (493)..(493): n is a, c, t, g, unknown, or other
  misc_feature (516)..(516): n is a, c, t, g, unknown, or other
  misc_feature (523)..(523): n is a, c, t, g, unknown, or other
  misc_feature (526)..(526): n is a, c, t, g, unknown, or other
  misc_feature (624)..(624): n is a, c, t, g, unknown, or other
atactggagctccccgcggtggcggccgctctagaactagtggatcccccgggctgcaggaattcgtctcacccctagaaaaaagaggtccgcgagcaaacgccttcaagcccatctcggtagccggagaacgagcagcagcggaggcgatggcgtccccggatcccggccacacgccggcgcaaggcgaggaatctgcctccccctcctcgtggcctccccgaaagctccagagtttcacaccaaggctgtggtcacaatacaaagcttatgaggatgcagttgttgggagaacattaaaggaactattggggatgctctggttcttgtgagagagnttcagggggaggnaattggatgtggctctgttgcnggattctttgggtggggagggcctcgaagatttttatgccgcaatacctttggccggtttnagantganaaggatttactgaatgatgcgaaggaaagnatgatggngtaccnaacacnnattcagaaccttggagaaggaancaaattnccnccctggccacgtagctatcccccgacccccccgtcgcacccaagccccaacccccccccccatcctttgggcgaacaacaaacgaccccccctctccncagccctttttaccgaagcacaatatcaacagctctccaggtttcttatcttaat

SEQ ID NO: 69511 - protein, 60 aa, Zea mays
  misc_feature: Ceres CLONE 1547744
MASPDPGHTPAQGEESASPSSWPPRKLQSFTPRLWSQYKAYEDAVVGRTLKELLGMLWFL

SEQ ID NO: 69512 - DNA, 682 bp, Zea mays
  misc_feature: Ceres CLONE 1547752
  misc_feature: Encodes the peptide sequence at SEQ ID NO. 69513
  misc_feature (6)..(6): n is a, c, t, g, unknown, or other
  misc_feature (42)..(42): n is a, c, t, g, unknown, or other
  misc_feature (44)..(44): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
tttttntttaccatttcattagaattatataaatacgcacantngggccacnnnnnnnnaaaatggagctccccgcggtggcggcagcacttttcctaatcaacccccgggctgcaggatttcccctcacccctagaaaaaatcgccaccagtggccgcgtcctcttcatttccgccatccgtatcgtctccctagggtttggcactttggccgccgccatggcgtcggcgtcgcgtgcgctcctcatctctcgtgcgctccaggccggcgccgtgtctcgccgcgtccccgccctcctgcgccctgtcgctgctgccgcgagcctcctcccagcggtggcggggccggcaggggccgccctcggcgctagggtgcggtgcttcgcgacccagccggcgacgtcctcgctgcgggactcgtccccgaactggagcaatcgcccgcccaaggagacgatcctcctcgacggctgcgacttcgagcactggctcgtcatcatggagccgccgcctggtgacgcctccaaccccgacatcacacgcgacgagatcatcgatagctatatcaagactctcgcccaaatcctccgggaatgaggaaaaaaactaggcaaaaagaaataactctggtatcgaactcgtcaattacttttgggcttttggaggccccttggaaatcaaa

SEQ ID NO: 69513 - protein, 125 aa, Zea mays
  misc_feature: Ceres CLONE 1547752
MASASRALLISRALQAGAVSRRVPALLRPVAAAASLLPAVAGPAGAALGARVRCFATQPATSSLRDSSPNWSNRPPKETILLDGCDFEHWLVIMEPPPGDASNPDITRDEIIDSYIKTLAQILRE

SEQ ID NO: 69514 - DNA, 676 bp, Zea mays
  misc_feature: Ceres CLONE 1547753
  misc_feature: Translation starting site: 129
  misc_feature (411)..(411): n is a, c, t, g, unknown, or other
caagctggagctccccgcggtggcggccgctctagaactagtggatcccccgggctgcaggaattcgtctcacccctagaaaaatccccgactgtagtttgcccggcaagcaaacatctccggcagccatggcgtccactgtaacagccgccaatagcagccatggaagcgccctgcgtacccgtaccgcctccccaaggccggtcgcgggctggagctgcagacgcacgctttccacgcctgcacaccaccaccacgcgcggccgtcacccagagctcgggttgtcgccgtccgagccgccggcactcagcgggcgacctggttgcccggactggacccgcccccatacctcgacggcacactaccaggtgacttcggcttcgaccctctgggcctcggcgaggagcccnacacccttgaagtggtacgttcaggccgagctcgtgcactgccggttcgccatggcaggggtcgccggcatccttttcactgacttgctccgcgtatcaggggaacagcgacctcctcgtgtggttccaaagcaagggcccgcggaaattccgacttccccaaacaccaccggcgcttcttctttcgttccagcttcttctttgatgggggtttctcttaaaaacctaagaggttacaatggacctttccaaaaaatcccaggaa

SEQ ID NO: 69515 - DNA, 749 bp, Zea mays
  misc_feature: Ceres CLONE 1547754
  misc_feature: Translation starting site: 325
  misc_feature: Pfam Name: UPF0047 Pfam Description: Uncharacterised protein family UPF0047
  misc_feature (1)..(1): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (749)..(749): n is a, c, t, g, unknown, or other
nttttttttttggccccgcgcccctctacaaaannnnnnnttttttnnnntcaatactaggactccccgcggtggcggccgctctataatagtggatcccccgggctgcaggaattcgtctcacccctagaaaaagccacagcaccacttgctcctgcctcctgctgcttcttcccgagttcccgtgccgccgcgagcgctcccaaccaagcaacgagacaacaacaacaaccctgcaccgccgcagcacttgcgccgtccggtcctgtcctcccgcggtctcgacgccgtcccctaccgtcctaccttatcgcgcaccgctccatggccgccaagtgggcccagaagaccgtcgttatcccggcgcatcggcggggctgccacctcatcacccccaagattctgagggagatcgagggcgacctggccgggttcaagtgcggtctcacgcatttcttccttcaacacacaaagcgcatcgctgaccatcaacgagaactatgactctgatgtgcaggctgacactgagacttttcttaacagaattgttccagaaggccacaatgctcccttggaaacacactatgggaaggaccttgatgaactggcctgcacataattaaaacctcctaaggtttgggttagttccccaatacaattccccaaaaactgaatggacacctcccccaataccggagcacctttgggccacgggccattatagggtctaaagacacaaaccaaccacn

SEQ ID NO: 69516 - DNA, 627 bp, Zea mays
  misc_feature: Ceres CLONE 1547757
  misc_feature: Encodes the peptide sequence at SEQ ID NO. 69517
ctggagctccccgcggtggcggccgctctagaactagtggatcccccgggctgcaggaattcgtctcacccctagaaaaaaagatatttgttgccctcgtcgcgtcttgtgcccttcttaaaccttagcagggcaagggcaaggacaatcgcagccagcagcctcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgacggacatgatcacctacgccgacaccgacgtcgtcatcgtgggcgccggctccgcggggctgtcctgcgcgtacgagctctccaaggaccccgccgtgagcatcgccatcgtggagcagtcggtgtcgccgggcggcggcgcgt

SEQ ID NO: 69517 - protein, 129 aa, Zea mays
  misc_feature: Ceres CLONE 1547757
  misc_feature: SWISSPROT Homolog: EC 1.5.5.1 Electron-transferring-flavoprotein dehydrogenase
MATAAASSLLKSSFAGSRLPAATRTTPASLVVATGPRGAGAGPICASMSMSSSNPPYDLTSFRFSPIKESIVSREMTRRYMTDMITYADTDVVIVGAGSAGLSCAYELSKDPAVSIAIVEQSVSPGGGA

SEQ ID NO: 69518 - DNA, 829 bp, Zea mays
  misc_feature: Ceres CLONE 1547760
  misc_feature (18)..(18): n is a, c, t, g, unknown, or other
  misc_feature (19)..(19): n is a, c, t, g, unknown, or other
  misc_feature (43)..(43): n is a, c, t, g, unknown, or other
ttttttttttttttttcnnttccactattggcagttcaacaanaacaaaaaaaaaaaataggaactccaccgccggtgggggccgctctaaaactagtggatccaccgggctgcaggaaagcgtctcacccctagaaaaaaggccaacgcgtaaaaaaaaataaaaaaaaaaaaaaaaaggttttgtctccccccccaccctacccacccctctcctctcctcaaaggcttggcttgcctcgtgccgtgagtccctccaccgcccgccatgccaacaaggcttgccccccaccgccgatcgcacacggacatatgaatgaaacgaaacttgaaatggcactattgatcttggaaaaaaatatccaccaaacggaccgaaactgagaaaacactaaaaaaccacgatagccattgggaaaggaatagaaacaaagcggaattagcagcctcaacagggagaaaggatagcccaattaaaggccaaaggaaaggagccccccactctatacttcaaaggaaagggaaaacaccagaaaaaagttttataggcacaaacaactgataaacaaaaacccaaaaaaacaaagcaaccaaaagaaaaaaagagagtgcgagcaagtaacacccacagaacatacaccaaaaaaaaaggacacacaaaacggacacaacaataaaacctatatgaaaatatataacaaaaaacatgagcaaaagtacaagaaaaacaaaaaacacggaacagtgactgaacaaacaaataacaacttcaaatcaaaaaagacaaaaagacgacacaatgaggtaagaacacaggacaaggacaaaa

SEQ ID NO: 69519 - DNA, 601 bp, Zea mays
  misc_feature: Ceres CLONE 1547773
  misc_feature: Encodes the peptide sequence at SEQ ID NO. 69520
tgtggatcccccgggctgcaggaattcgtctcacccctagaaaaagtcttattgccacctctccacgtctccaccaaacaaggcaacaagggagaagtagatctgcatctgcgagaggaggcagcgggggtggtgatgatggagagccagccgctgcaggccccgacggccacggctccggcccccggatctgcggagccagccggagctccgccggccgtcacccccggcaaggagttcacgcgcacctgcaagggcctcgtcgtcgtgctcatcggaggatacgtgctgctccagctcctcccttcgtcactcaactacctcgccatcatcccctccaagacaatcccctatgtatggaccgtctttaccgctggttacatcgagcaagtcctcccagggggccattggcagttctcttggtcttctcttttgttggaaaaggacatttgaaaccagcattggggccgcaaagaaattccttgaagttccattatttttgatccaactcccttcttgggggcatttccttgcatttttggcttttgctatttggaacctccaccttacttcccctgggaaaaagaaaaaactttccccg

SEQ ID NO: 69520 - protein, 105 aa, Zea mays
  misc_feature: Ceres CLONE 1547773
MMESQPLQAPTATAPAPGSAEPAGAPPAVTPGKEFTRTCKGLVVVLIGGYVLLQLLPSSLNYLAIIPSKTIPYVWTVFTAGYIEQVLPGGHWQFSWSSLLLEKDI

SEQ ID NO: 69521 - DNA, 645 bp, Zea mays
  misc_feature: Ceres CLONE 1547774
  misc_feature: Translation starting site: 498
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaaagtttctgccttttttaagtgtgattgacctgatatgtttctcagtccatgactccccgctgcttcagataaatgcttctgattgcgaggcgaggcgagggaccgcgtgtaatgttcacaaattctggtagtgcgccatgtgccttaactcttttgacgatggcgacaaccactttcaactaaatttggtgccatcttatacctagaactactctccggatatcacatatcggaagtgttttctgtcaactacctaattgaattacggccgtcgttgcacggaggctattttaaaatgttgcattgtatgtggtatggactcgccaatgataagaaccaaacgataccctcgatgtacccaattcgccctgtagtgagtcccattactcgcgctcactgaccctcgttttacaccctcatgactggtaaaatcctggcgttgccaagcttaatcgccttgcagcacatccccctttcgccaactggcacattagccaataggcccgcaccgatcgaccttcccagcacttgcccatcctgaatgccaaatggaaattgtcctcgtt

SEQ ID NO: 69522 - DNA, 606 bp, Zea mays
  misc_feature: Ceres CLONE 1547776
  misc_feature: Translation starting site: 149
aagctggagctccccgcggtggcggccgctctagaactagtggatcccccgggctgcaggaattcgtctcacccctagaaaaattcatgatgatgaatcatcaggttaagatcgatctaaaccaatccattttatatatacatacgacatgccaacggttaaacaacttattagaaatgcaagacagccaatacgaaatgctagaaaatcggccgcgcttaagggatgtcctcagcgtcgaggaacatgtgctagggtgtatactatcaaccccaaaaaacccaactctgccttacgtaaagttgccagagtacgattaacctctggatttgaaatcactgcttatatacctggtattgccataatttacaagaacattctgtagtattagtaagaggaggaagggttaaggatttacccggtgtgagatatcgcattattcgaggaaccctagatgctgtcgcagtaaagaatcgtcaacaagggcgttctaaatatggggcccaaaaagcaaaaaaataagtgattcgttttttagcccttataaaaaaaaaacggatccttgaaccttctttcacctcatgtcacgtcaaaggactgcaaaaa

SEQ ID NO: 69523 - DNA, 730 bp, Zea mays
  misc_feature: Ceres CLONE 1547777
  misc_feature: Encodes the peptide sequence at SEQ ID NO. 69524
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (31)..(31): n is a, c, t, g, unknown, or other
  misc_feature (34)..(34): n is a, c, t, g, unknown, or other
  misc_feature (35)..(35): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ccaaaannnnggggcgccagggtaannnntnttnnttttttnnnnnnnccaaagctggactccccgcggtggcggccgctctatactagtggatcccccgggctgcaggaattcgtctcacccctagaaaactcgttgtcttggcggctgcggcggagcacggaggcgaaggaggaggagcagcagcagcaggcggcgccgaggagcggcatcccactcagtgcttgcaaccatggctaggggattgaagaagcacttgaagaggctcaatgcgcccaagcattggatgctcgacaagcttggcggagcttttgctcccaagccatcttctggacctcacaagtccagggagtgccttcctctgatcctcatcatcaggaacaggctcaagtatgctctgaactaccgtgaggtcatttctatcctgatgcaacgccatgtacttgttgatggcaaggtcaggaccgacaagacctaccctgctgggttcatggatgtcatttccatccctaagacaatggagaactacaggctgctttatgacaccaagggccgcttcccgtctttaccccaatcaggggatgaaggatggccaagtttcaagctcctgcaaaggtgaaggtcccgttccagtttgggccagaaaaggccatcccccttaccctggaacacccttccgaacgggcccgcacccattcccgccttacccccgaaacccggctccaatcaa

SEQ ID NO: 69524 - protein, 128 aa, Zea mays
  misc_feature: Ceres CLONE 1547777
  misc_feature (3)..(40): Pfam Name: RS4NT Pfam Description: RS4NT (NUC023) domain
MARGLKKHLKRLNAPKHWMLDKLGGAFAPKPSSGPHKSRECLPLILIIRNRLKYALNYREVISILMQRHVLVDGKVRTDKTYPAGFMDVISIPKTMENYRLLYDTKGRFPSLPQSGDEGWPSFKLLQR

SEQ ID NO: 69525 - DNA, 617 bp, Zea mays
  misc_feature: Ceres CLONE 1547778
  misc_feature: SWISSPROT Homolog: EC 3.2.1.23 Beta-galactosidase
tggagctccccgcggtggcggccgctctagaactagtggatcccccgggctgcaggaattcgtctcacccctagaaaaaagaaaatcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgttttgaagttcatgctaccttttaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcggcagctggcgtaataacgaagaggcccgcaccgatcgcctttccaacaagtgcccagccctgatggccaaaggaaat

SEQ ID NO: 69526 - DNA, 750 bp, Zea mays
  misc_feature: Ceres CLONE 1547780
  misc_feature: Encodes the peptide sequence at SEQ ID NO. 69527
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
nnnnnnnnnnnnnnnnnnttgcttgggcaggtggggagnnncgccnnnnntcaaaactgggactcaccgcggtggcggccgctctagaactaatggatcccccgggctgcaggaattcgtctcacccctagaaaaacccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtctcgcgctacgccgggggcgccggcggcggggaagagctctcgggggaagagcgcaacctgctgtccggcgcctgacaagaaggtcctccggggcccgcaggggcctcatgggcggaaccttctacctccattttagcaaaaaggatggaatggccgcggggaaaccaaggcgcaccgccgtattccatcccgcggcctaaacagcttccaagaatctaaggcccaaacttcgcccgccattattgccaaaagggaatcctcctagcgttcccctcagacttccgccaactctcttccccctttcccggtcgggggggcaacccgagagtcccctaaggctccttctctaacctctccagagatggagaaaggcgccgtgattaccccct

SEQ ID NO: 69527 - protein, 58 aa, Zea mays
  misc_feature: Ceres CLONE 1547780
MSPSEPTREESVYMAKLAEQAERYEEMVEFMERVSRYAGGAGGGEELSGEERNLLSGA

SEQ ID NO: 69528 - DNA, 600 bp, Zea mays
  misc_feature: Ceres CLONE 1547781
  misc_feature: Encodes the peptide sequence at SEQ ID NO. 69529
  misc_feature (235)..(235): n is a, c, t, g, unknown, or other
  misc_feature (296)..(296): n is a, c, t, g, unknown, or other
  misc_feature (333)..(333): n is a, c, t, g, unknown, or other
tccccgcggtggcggccgctctagaactagtggatcccccgggctgcaggaattcgtctcacccctagaaaaaattggggtcgcgtccaacaagaggctggccagccatcccgcgcgagccacttcctctctcctccccatcggatccagcgccacgcggatccgcaaggcaatccatggcctctacccaggcggaagcggaggcgggggcaccgtgccccgtctcccgtaaggnctggcgtgtagggcgaaggagaagggcaagcaggggcggggtggctgggggagggtgtggncgggcgcttccttcggtgggccgcgaaggactttcgnagaagcgggcttgccagttaccctgtcccaaaggaagaaaggcaagccggtgccaccgccgccggaatggccgccccggcgggaacccaaattttcttcggcggcccgccggccccatgggggggagaaacccccccattcccgtaatacttctctccgcggtccccctccccccccaaaaagggggttttaaaccccttggtttggtttttatttggcccccttcctctgggcagccaacaccaaaaaaaaaattggtggggggga

SEQ ID NO: 69529 - protein, 76 aa, Zea mays
  misc_feature: Ceres CLONE 1547781
PRGGGRSRTSGSPGLQEFVSPLEKIGVASNKRLASHPARATSSLLPIGSSATRIRKAIHGLYPGGSGGGGTVPRLP

SEQ ID NO: 69530 - DNA, 613 bp, Zea mays
  misc_feature: Ceres CLONE 1547785
  misc_feature: Encodes the peptide sequence at SEQ ID NO. 69531
aagctggagctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtgccccagcaacaacggggcagagcagctggaagaacgcctggaagaaggccggcgcctgctccggcctcagcgagaagactacttcgagactgccctctcccttcgtagccggatcaacccactcgtttcgcctcaaagccaaaagtatccgagcccggaatttcgggggtttaacggggcccccaggggg

SEQ ID NO: 69531 - protein, 170 aa, Zea mays
  misc_feature: Ceres CLONE 1547785
  misc_feature: SWISSPROT Homolog: EC 3.1.27.1 Ribonuclease T(2)
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRCPSNNGAEQLEERLEEGRRLLRPQREDYFETALSLRSRINPLVSPQSQKYPSPEFRGFNGAPRG

SEQ ID NO: 69532 - DNA, 619 bp, Zea mays
  misc_feature: Ceres CLONE 1547786
  misc_feature: Encodes the peptide sequence at SEQ ID NO. 69533
  misc_feature (358)..(358): n is a, c, t, g, unknown, or other
  misc_feature (428)..(428): n is a, c, t, g, unknown, or other
  misc_feature (541)..(541): n is a, c, t, g, unknown, or other
tggagctccccgcggtggcggccgctctagaactagtggatcccccgggctgcaggaattcgtctcacccctagaaaaactgtccaaaactgtctcttccacgtccttccgggtcctatcgctcctctccgtcgccggtggagctcatggcatcctccatggccgccgccgccaccgccctcccgctgccgtccgggacgacgcagaggccgtctgcccagggccgcctcctcttcaccgccgcacccgcccgctcccgctgccgctccctccgcctccgccccgccggccgccggtcggcccgctcctcgcctcgggccaccaaggctgtggtggcagcgttggctgatcctctcanggtcatgatatcaggagctccggcgtccggcaagggcacacagtgcgagctcatcaagaccaaatatcanctgggcgcacatctcccgctggagattttgtttgcgggcggaaaaatcgcctgcttggcttctgagaaatgggggaggcggggccaaagggatttccttggaaaaaggggccncctcccggccctgaaagaaaattggccccttaaaatttgggggaaaaggaaaagccccttttggggaaaaccaaaaaa

SEQ ID NO: 69533 - protein, 157 aa, Zea mays
  misc_feature: Ceres CLONE 1547786
  misc_feature: SWISSPROT Homolog: EC 2.7.4.3 Adenylate kinase
  misc_feature (71)..(71): Xaa is any aa, unknown, or other
  misc_feature (94)..(94): Xaa is any aa, unknown, or other
  misc_feature (132)..(132): Xaa is any aa, unknown, or other
MASSMAAAATALPLPSGTTQRPSAQGRLLFTAAPARSRCRSLRLRPAGRRSARSSPRATKAVVAALADPLXVMISGAPASGKGTQCELIKTKYXLGAHLPLEILFAGGKIACLASEKWGRRGQRDFLGKRGXLPALKENWPLKIWGKRKSPFWGKPK

SEQ ID NO: 69534 - DNA, 621 bp, Zea mays
  misc_feature: Ceres CLONE 1547790
  misc_feature: SWISSPROT Homolog: EC 3.2.1.23 Beta-galactosidase
  misc_feature (240)..(240): n is a, c, t, g, unknown, or other
  misc_feature (243)..(243): n is a, c, t, g, unknown, or other
aagctggagctccccgcggtggcggccgctctagaactagtggatcccccgggctgcaggaattcgtctcacccctagaaaaacttcatctcatccagcgtgtgtcctgcgactttgtaccttcatatatagagacaagagttctcgcttgtgagcataattgcatgatcgtgtggtgtatgtaacccgaaactgtttaccttttcgcaaaaacttcagtcttcaggcattgttccgaanaanaaaaaaaaaaaaaaaaaaaaaaaaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagacggaga

SEQ ID NO: 69535 - DNA, 674 bp, Zea mays
  misc_feature: Ceres CLONE 1547794
  misc_feature: Encodes the peptide sequence at SEQ ID NO. 69536
ggagctcaccgcggtggcggccgctctagaactagtggatcccccgggctgcaggaattcgtctcacccctagaaaaaggcgagctacggactcagcagatcaccgtcgctcgagttgtacctgaaggcgcgcccgtggaaccggccgcgagataagggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcatatcatgcaaacaaaagaacttggcacatgccctgttcgtcaaataggaggctgctccttcctttatatgaggatcagtaatgtttacattgtgatcgtagttagcagcaatgctaatgttgcatgtgcttttcaatttgttgtcaagggggtggctctccttcagtcctactttcggtggagcttttgatgaagacgctatcaggaataactttgttttgatatatgaaccttccttgatgacaccctggattttttggttattctttaaaaccttggtcccctgaaaattttttgaagttggattaaaaacttcaaagaaagggggttcccggtcccccccttttctcccccaaaagccccttccaaaaaaagcctctgt

SEQ ID NO: 69536 - protein, 100 aa, Zea mays
  misc_feature: Ceres CLONE 1547794
MPVAASAIYFLNLRGDVLINRLYRDDVGGNMVDAFRMHIMQTKELGTCPVRQIGGCSFLYMRISNVYIVIVVSSNANVACAFQFVVKGVALLQSYFRWSF

SEQ ID NO: 69537 - DNA, 625 bp, Zea mays
  misc_feature: Ceres CLONE 1547804
  misc_feature: Encodes the peptide sequence at SEQ ID NO. 69538
  misc_feature (625)..(625): n is a, c, t, g, unknown, or other
atagctggagctccccgcggtggcggccgctctagaactagtggatcccccgggctgcaggaattcgtctcacccctagaaaactcccggctcagacttctgctgcagcgcctccgccgccgccgccgcatctaacgcagttccctccgccgcagcccgaggcaagatggttctccagaacgacattgatctgctcaacccgccggcagaactcgagaagctcaagcacaagaaaaagagactcgtccagtcgcccaactccttcttcatggatgttaagtgccaggggtgcttcagcataaccactgttttcagccactcccagactgttgttgtgtgccctggctgccaaactgtcctctgccaacccacaggaagaaaggcaaggctcactgagggctgcctctttccgcaggaaggggagactagagcggatgtgggccttccaaagttttgctcctttgccaaaaaacctagccggtccttgaaactggcccttttaagcctaaaaaaaattttcccccacaaaaaaattgtggttctcccccaaaaaaaaaaccccttattttttgtttttttacaaccaaaattttggcgccagcatcccttctctctccccaaaaan

SEQ ID NO: 69538 - protein, 152 aa, Zea mays
  misc_feature: Ceres CLONE 1547804
  misc_feature (30)..(84): Pfam Name: Ribosomal_S27e Pfam Description: Ribosomal protein S27
MVLQNDIDLLNPPAELEKLKHKKKRLVQSPNSFFMDVKCQGCFSITTVFSHSQTVVVCPGCQTVLCQPTGRKARLTEGCLFPQEGETRADVGLPKFCSFAKKPSRSLKLALLSLKKIFPHKKIVVLPQKKNPLFFVFLQPKFWRQHPFSLPK

SEQ ID NO: 69539 - DNA, 847 bp, Zea mays
  misc_feature: Ceres CLONE 1547805
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (46)..(46): n is a, c, t, g, unknown, or other
  misc_feature (54)..(54): n is a, c, t, g, unknown, or other
  misc_feature (318)..(318): n is a, c, t, g, unknown, or other
  misc_feature (847)..(847): n is a, c, t, g, unknown, or other
nnnnnnnnnnnnaaaaaaaaaaagaaaaaaaaaaagaggggtcccnctccttcncccaaactggaactccccgcggtggcggccgctctagaatagtggatcccccgggctgcaagaattcgtctcacccctagaaaaactattacgacggcgtgatgttaaatgtcaagtaacttaaggcctgtttggcatggctctagagcaaaactccaaggaggagctgcatgtcaaacatccagactccaaagttgtaaattctatggagtttttggagctgcggagtagctcttttgctgatctgaaaactctaaaatagcntactctttttccaaattatcataaaaaaaaataacacaaacctcctccctcctaccctcaataaaactacctatatattatacacttactaccttaataatttataatttttcttatcggataaataatttatatattaataaatttataattttcgttacccttacgaccaccttggccgccacactccaatcacccccacaaaatatgtacgtttttaaacttatgcgggcactatattttttgagtaactcccatcattttaacaactcaaactcgttgaccccatagacagactaaaaccgccttgagaattaaaaaactcaactttataaaatacctacttcttcatacatatacaatcacccccttcttcccaccccttgctttttggatattaccgacataaataaaccccccccactatattctacaccacgtctcaaaaatattaatatttggaatccttctggtacggagcactattcataaccaaattataaccattattgtttttcttatataaaan

SEQ ID NO: 69540 - DNA, 734 bp, Zea mays
  misc_feature: Ceres CLONE 1547806
  misc_feature: Encodes the peptide sequence at SEQ ID NO. 69541
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (45)..(45): n is a, c, t, g, unknown, or other
  misc_feature (46)..(46): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
nnnnnnnnnnnggagccgggatgttcccaagcctcaacccaactnntacttnnnnctcctagctggagctccccgcggtggcggccgctctagaatagtggatcccccgggctgcaggaattcgtctcacccctagaaaaagcctcctgtcgctcgctctccctgtctcccgcacgccgacccgcagccgccgccgttcgccatgggtttcctcgacgcgctctaccgtgtggtgatgcgccgcaacgccgtctacgttaccttcgtcgtcgccggcgctttcgcgggcgagcgggcggtggactacggcgttcacaagatctgggagatgaacaacctcgggaaaaggtacgaagacatatcggttttggggcagaggccagctgaggaatgataaattttggtcaccagtttgctttcggtttgaccgtttcattttggcacagtaataaacgatgtaaacttacgctgctcctatgacctccttctcattcctttactcctgaaaatgcttttgtggggggaaaaaaccacacctatatatgttatatataataaaaaatactacaaaaaaaccgaaacccctccgaagggaccccttttcccccccttttagggaactcctaatttacgcgcgcgcccacctgggcccgtccgatttttaccaaccgcctgtgacccgggagaaataacccctggcgcgtgtttaccacccaaccttaatacccaccctg

SEQ ID NO: 69541 - protein, 63 aa, Zea mays; identical to SEQ ID NO: 7503
  misc_feature: Ceres CLONE 1547806
  misc_feature (4)..(58): Pfam Name: UCR_UQCRX_QCR9 Pfam Description: Ubiquinol-cytochrome C reductase, UQCRX/QCR9 like

SEQ ID NO: 69542 - DNA, 623 bp, Zea mays
  misc_feature: Ceres CLONE 1547808
  misc_feature: Encodes the peptide sequence at SEQ ID NO. 69543
atagctggagctccccgcggtggcggccgctctagaactagtggatcccccgggctgcaggaattcgtctcacccctagaaaaaacactgcgacacacagtaggcgaggcgaaggagaggcaaggcggcgcggcgggcaagatgtttgacgatcaagacctgggcttctttgccaatttcctgggcatcttcatctttgtcttggttattgcgtaccacttcgtgatggcagacccgaagtacgaaggaaactgatgtcctctagtgcaaagatcctattatctgcaggccgaaatagggctatactgttagctaatgctagtgagatcgcttgacactttgagtgcatatcatggaagctggacatgcagttcctggcattttggttttgcccatgttttaatctgctgaattagtaaatcctggagaattcaaaagcgttttcaagtactgcagttggtggttgtttctggtcctagtgtatgcatgccagaatcttatgaataatattctttgttttgttgcctatttagctgtttagttggttgttagcctgtcaagaaaaaaaaaaaaaaaacgagacgctcgaggtacccaattcgccctatagtgagtcgtattac

SEQ ID NO: 69543 - protein, 37 aa, Zea mays; identical to SEQ ID NO: 60895
  misc_feature: Ceres CLONE 1547808

SEQ ID NO: 69544 - DNA, 738 bp, Zea mays
  misc_feature: Ceres CLONE 1547822
  misc_feature: Encodes the peptide sequence at SEQ ID NO. 69545
  misc_feature (1)..(1): n is a, c, t, g, unknown, or other
  misc_feature (13)..(13): n is a, c, t, g, unknown, or other
  misc_feature (14)..(14): n is a, c, t, g, unknown, or other
ntttttttttttnnccaattttaatttcgttatataaatgaagcctttccccatacaattttaaatactggagctcaccgcggtggcggccgctctagactagtggatcccccgggctgcaggaattcgtctcacccctagaaaaaaaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccagggagctcgcccgcttcgccgtcgatgagcacaaccaagaaggccaatgctcttctgggggttcgagaagcttgtgaaggccaagacacaagtggttgctggcaccaatgtacttattctcacctattgaaagtgaagggatgggcgaaaatcaaaaaagcctcttaccaaacctaaaggcccggggaagaaagccattgggaagaaaccctccaggggggcttgcaaggaaatttcaaaccctggttgaaaaaagggggggctaaacccccctaaagaggatgtcctccctttcctcccttgggggcgaaacccctgaaagcctcccaaagaccaaagatttttccaaaaaaatataaggaaaccccttggcctccccccttgagggtgaaatttttccaaaaggaaatataaaaaccccccttatttt

SEQ ID NO: 69545 - protein, 33 aa, Zea mays
  misc_feature: Ceres CLONE 1547822
MANNTGTLVGGIQDVPGSENDLHLQGARPLRRR

SEQ ID NO: 69546 - DNA, 486 bp, Zea mays
  misc_feature: Ceres CLONE 1547828
  misc_feature (265)..(265): n is a, c, t, g, unknown, or other
  misc_feature (266)..(266): n is a, c, t, g, unknown, or other
  misc_feature (287)..(287): n is a, c, t, g, unknown, or other
  misc_feature (391)..(391): n is a, c, t, g, unknown, or other
  misc_feature (455)..(455): n is a, c, t, g, unknown, or other
aaactggagctccccgcggtggcggccgctctagaactagtggacccccgggctgcaggaattcgtctcacccctagaaaaaacagattccttcgattcccgctgacagcgaagctgaggagaatcccaagaaacagagccggtgaaattgcattgtcgcacaggcagagaaaggaaagaaagaaatggctgcaatacctgcagcgatcccgggctgctgctcttcgtctcgcctgcctcagcttgctggcctcctgcctccaannaaaagcagaaggcgccttcanggtcacggccatggcgccccaaaaagaaaaaagggggtgaaaaaacccccggccctttaccccaaaccaaaagaactgggttcgaaagcaagttgggtttttcnggggggggcgccgggggcaattccttttcccccgggaaaaagggggcccacacaaccccccccnaaaaaggaaaagggtggtccccgttgggaat

SEQ ID NO: 69547 - DNA, 650 bp, Zea mays
  misc_feature: Ceres CLONE 1547839
  misc_feature: Encodes the peptide sequence at SEQ ID NO. 69548
  misc_feature (504)..(504): n is a, c, t, g, unknown, or other
  misc_feature (505)..(505): n is a, c, t, g, unknown, or other
tctgaactagtggatcccccgggctgcaggaattcgtctcacccctagaaaaaaagacactacagtcaccgggcgaggcggctaggacccctcaccgtccaccggcgactgggacggccgtccctgccaccctgcctctccgccgtcgccggagaccagcaccactacgtgtttttgagtctgttaccagtgttgcggccatgtccatgttcaatatcatcctcggcaagcccaaggagcacgacaactccaatgctttggtcactctggacaacctaaatgagacacttgtatttgctggagaaaaaaagaaaaaggtgctggaaaaaaaaagctaaacgctgaactttgaaaggaacccaggggaggttctccgaaaaggccaagaaattaaaacgaaccggggtaaatccaattccctttgaaggagggcaaagaaattttttttttaacccaaccaaattttttacccaaccttttggaaaaaatttttttccttttggnnagaaaaccccgcgggaaccccaaacttctcccagttttttaaaaacctcccccttaaaacccttcccccacccaaaaaaaaagttttttacaccccttttggaaatatttgggaaatcttcccccccccattttaaaaaacccat

SEQ ID NO: 69548 - protein, 45 aa, Zea mays
  misc_feature: Ceres CLONE 1547839
MSMFNIILGKPKEHDNSNALVTLDNLNETLVFAGEKKKKVLEKKS

SEQ ID NO: 69549 - DNA, 642 bp, Zea mays
  misc_feature: Ceres CLONE 1547844
  misc_feature: Encodes the peptide sequence at SEQ ID NO. 69550
  misc_feature (130)..(130): n is a, c, t, g, unknown, or other
aagctggagctccccgcggtggcggccgctctagaactagtggatcccccgggctgcaggaattcgtctcacccctagaaaaactctctctacagctacctagctagagctagtatctctatctacccgncattgcattgcaccacctctgtcctcgatatctcttgctcgaccacacacacacacacacaaacacacgatcgactggggtcgtctgctagtagcttggactaataacccttctgtatctgtatggatacggcaatgagccagcacagctccgacacctcgtccacgtcctcctactcgtccgacccctcctccacgtcgtccaccaccagcggcaagaagcgcccgcgcccgcacgccgccgccgccgccgccgccccggcgtaccgcggcgtccgcatgcgcgcgtggggcaagtgcgtgtcggagatcagggagccccgcaagaagtcgcgcatctggctgggcaccttcacgcacccggagatggcggcgcgcgcgcacgacgccgccgcgctcagcgtcaaaggcgcgcgcgccgtgctcaacttccggctctcgcgcgcaacttccgcgcccggactccctggtgcctcgccacgtcaaagcagctgcgcgcgcgtcaacattatg

SEQ ID NO: 69550 - protein, 78 aa, Zea mays
  misc_feature: Ceres CLONE 1547844
  misc_feature (2)..(45): Pfam Name: AP2 Pfam Description: AP2 domain
  misc_feature: The sequence is a functional homolog of SEQ ID NO 2848 in the 10/374,780 US patent application
  misc_feature: The sequence is a functional homolog of SEQ ID NO 456 in the 10/225,066 US patent application
  misc_feature: The sequence is a functional homolog of SEQ ID NO 2596 in the 10/374,780 US patent application
  misc_feature: The sequence is a functional homolog of SEQ ID NO 644 in the 10/225,066 US patent application
  misc_feature: The sequence is a functional homolog of SEQ ID NO 1234 in the 10/374,780 US patent application
  misc_feature: The sequence is a functional homolog of SEQ ID NO 1233 in the 10/374,780 US patent application
  misc_feature: The sequence is a functional homolog of SEQ ID NO 182 in the 11/375,241 US patent application
  misc_feature: The sequence is a functional homolog of SEQ ID NO 1318 in the 11/479,226 US patent application
  misc_feature: The sequence is a functional homolog of SEQ ID NO 164 in the 10/225,068 US patent application
  misc_feature: The sequence is a functional homolog of SEQ ID NO 1816 in the 10/412,699 US patent application
  misc_feature: The sequence is a functional homolog of SEQ ID NO 188 in the 10/374,780 US patent application
  misc_feature: The sequence is a functional homolog of SEQ ID NO 28 in the 10/225,068 US patent application
  misc_feature: The sequence is a functional homolog of SEQ ID NO 740 in the 10/225,066 US patent application
  misc_feature: The sequence is a functional homolog of SEQ ID NO 1239 in the 10/374,780 US patent application
  misc_feature: The sequence is a functional homolog of SEQ ID NO 764 in the 11/435,388 US patent application
  misc_feature: The sequence is a functional homolog of SEQ ID NO 1050 in the 10/666,642 US patent application
  misc_feature: The sequence is a functional homolog of SEQ ID NO 2820 in the 10/374,780 US patent application
  misc_feature: The sequence is a functional homolog of SEQ ID NO 442 in the 10/225,066 US patent application
  misc_feature: The sequence is a functional homolog of SEQ ID NO 1756 in the 10/374,780 US patent application
  misc_feature: The sequence is a functional homolog of SEQ ID NO 1237 in the 10/374,780 US patent application
  misc_feature: The sequence is a functional homolog of SEQ ID NO 774 in the 11/435,388 US patent application
  misc_feature: The sequence is a functional homolog of SEQ ID NO 1226 in the 10/374,780 US patent application
  misc_feature: The sequence is a functional homolog of SEQ ID NO 10 in the 10/666,642 US patent application
  misc_feature: The sequence is a functional homolog of SEQ ID NO 54 in the 10/412,699 US patent application
  misc_feature: The sequence is a functional homolog of SEQ ID NO 160 in the 10/714,887 US patent application
  misc_feature: The sequence is a functional homolog of SEQ ID NO 160 in the 11/435,388 US patent application
  misc_feature: The sequence is a functional homolog of SEQ ID NO 28 in the 10/903,236 US patent application
  misc_feature: The sequence is a functional homolog of SEQ ID NO 1222 in the 10/374,780 US patent application
  misc_feature: The sequence is a functional homolog of SEQ ID NO 1411 in the 10/412,699 US patent application
  misc_feature: The sequence is a functional homolog of SEQ ID NO 712 in the 11/435,388 US patent application
  misc_feature: The sequence is a functional homolog of SEQ ID NO 1755 in the 10/374,780 US patent application
  misc_feature: The sequence is a functional homolog of SEQ ID NO 2386 in the 10/374,780 US patent application
  misc_feature: The sequence is a functional homolog of SEQ ID NO 542 in the 10/225,066 US patent application
  misc_feature: The sequence is a functional homolog of SEQ ID NO 698 in the 11/435,388 US patent application
  misc_feature: The sequence is a functional homolog of SEQ ID NO 1241 in the 10/374,780 US patent application
  misc_feature: The sequence is a functional homolog of SEQ ID NO 762 in the 11/435,388 US patent application
  misc_feature: The sequence is a functional homolog of SEQ ID NO 160 in the 11/375,241 US patent application
  misc_feature: The sequence is a functional homolog of SEQ ID NO 183 in the 11/479,226 US patent application
  misc_feature: The sequence is a functional homolog of SEQ ID NO 2226 in the 10/374,780 US patent application
  misc_feature: The sequence is a functional homolog of SEQ ID NO 4 in US patent 7259297
  misc_feature: The sequence is a functional homolog of SEQ ID NO 42 in the 10/412,699 US patent application
  misc_feature: The sequence is a functional homolog of SEQ ID NO 786 in the 10/225,066 US patent application
  misc_feature: The sequence is a functional homolog of SEQ ID NO 826 in the 11/435,388 US patent application
MRAWGKCVSEIREPRKKSRIWLGTFTHPEMAARAHDAAALSVKGARAVLNFRLSRATSAPGLPGASPRQSSCARVNIM

SEQ ID NO: 69551 - DNA, 649 bp, Zea mays
  misc_feature: Ceres CLONE 1547845
  misc_feature: Encodes the peptide sequence at SEQ ID NO. 69552
caagctggagctccccgcggtggcggccgctctagaactagtggatcccccgggctgcaggaattcgtctcacccctagaaaaacattacagggggcatgttcagtacagattcctatagtactgttcgaggagttgataagttaattcctgtggacgtctacctgccgggttgcccgcctaaaccagaggctgttatagatgccctaacaaaacttcgtaagaagatagcgcgagaaataattgaggatcgaactctatgtcaaagtcaaaagaaaaatagatcttttactacccgtcacaaactttatgttcggcgcagtactcacacttggaacttacgaaacagaattgctctatcaatcaccatctactttaaatatatccttctgaaaacttttttcaaatcccaaacctccagaatctttcctacaaattaagggaattaggaaggggttctttttgtaaaaaaaaaaaaaaaaaaccccaccccctcgaaggtaccccaatttcacccttataagtgagggcgatattaccgcgcccccccccctggcccctccgtttttacaaacgtccgttgacttggggaaaaccccttggccgcttaccccaaatttaattcccccttgtgaggcgcaatccccccc

SEQ ID NO: 69552 - protein, 113 aa, Zea mays
  misc_feature: Ceres CLONE 1547845
  misc_feature: SWISSPROT Homolog: EC 1.6.99.5 NADH dehydrogenase (quinone)
MFSTDSYSTVRGVDKLIPVDVYLPGCPPKPEAVIDALTKLRKKIAREIIEDRTLCQSQKKNRSFTTRHKLYVRRSTHTWNLRNRIALSITIYFKYILLKTFFKSQTSRIFPTN

SEQ ID NO: 69553 - DNA, 590 bp, Zea mays
  misc_feature: Ceres CLONE 1547850
  misc_feature: Encodes the peptide sequence at SEQ ID NO. 69554
agtggatcccccgggctgcaggaattcgtctcacccctagaaaaactctcgccatttttactcgtcggctggtccggccccagcgattcggtttggtgcgcctcgtggtccacgtgcgcgggctttgtgctctctcttccctctgtgtgtgtgtcagttcgtcgggtaggttggtgccggcgtgagagatgaagagctgcggcgggggaggagcggacgggcagcagtgcccgtgcgactactgcggggaggcggcggcggctctgcactgccgcgcggacgccgcgcgcctctgcgtcgcgtgcgaccgccacgtgcacgccgccaacgcgctttcgcggaggcacgtgcgggcgccgctctgcgcagggtgcgccgcgcgcccggccgccgcgcgcgtctccctcggcgccgacccggcgttcctctgcgcggactgctgcgagggctgcgccgccgcttccgcggcccgcgtgtcggttgagggcttctcagggtggccctcggcggccgagctcgcccccgtctggggggattggactccccccgccccggtcgttggccgtggggcgaacacaggctacccgcgg

SEQ ID NO: 69554 - protein, 134 aa, Zea mays
  misc_feature: Ceres CLONE 1547850
  misc_feature (11)..(58): Pfam Name: zf-B_box Pfam Description: B-box zinc finger
MKSCGGGGADGQQCPCDYCGEAAAALHCRADAARLCVACDRHVHAANALSRRHVRAPLCAGCAARPAAARVSLGADPAFLCADCCEGCAAASAARVSVEGFSGWPSAAELAPVWGDWTPPAPVVGRGANTGYPR

SEQ ID NO: 69555 - DNA, 650 bp, Zea mays
  misc_feature: Ceres CLONE 1547853
  misc_feature: Encodes the peptide sequence at SEQ ID NO. 69556
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
atattatataaanatnnntnattaattcaattattatcattttttttttattttcgggctcccaaagtggtactccccgcggtggcggccgctctaaaactagtggatcccccgggctgcaggaattcgtctcacccctagaaaaaactcgcctattcatccgttcgcctctgtgcctctctgagctcgcactcgctcgtgaacgctccccgacctccgtccgtctccgtgtggtccggctcactttagcagttcagcctgctaggactctctgcgagtagcatagcagcagcttcttgcgaggcagaggcagagccttgtgttgcgttgcgtcttccttcctgcttgagcttattagttggctcgcgatggccggcggcgtggtggtgagctccggcgggggcaaggactaccccggcaagctcaccatgttcgtgctcttcgcctgcatcgtcgccgccaccggcgggctcatctttggatacaacatcggcatctctgggggcgtgacgtcaatgaacccgttcctgatgaagttcttcccgtcggtgttccccaaggagcaggaggcggaagcggaacccgagcaaccagtactggcaatttctacagccaagctggatcaccatgtttccccttccttcggttcg

SEQ ID NO: 69556 - protein, 94 aa, Zea mays
  misc_feature: Ceres CLONE 1547853
MAGGVVVSSGGGKDYPGKLTMFVLFACIVAATGGLIFGYNIGISGGVTSMNPFLMKFFPSVFPKEQEAEAEPEQPVLAISTAKLDHHVSPSFGS

SEQ ID NO: 69557 - DNA, 643 bp, Zea mays
  misc_feature: Ceres CLONE 1547857
  misc_feature: Translation starting site: 170
  misc_feature: SWISSPROT Homolog: EC 1.4.1.2 Glutamate dehydrogenase
gctctagacctagtggatcccccgggctgcaggaattcgtctcacccctagaaaaaatctcgagtccctattactctgttacttctcccgccgccgtctatcgcctcccgttctccgccaccgccgatcccctgaccgtcctccgccacctctgctgacagcaaaagagatggccggcaagggtgatgggccggcgatccgtatcgatatctgcacgacctactcttgcgtcggtgtgtggcatgacgttggtgtcgagatcttcgctgacgaccagtggagccgccccacaccctcttacctcgcctgctccgactccgagcacctgatggtagatgcggccataaatcatgtcgccatgaactccctctctaccgtctttgatgccccacgtctctgtgccaggagtggtaatgatgcctcctgtcctagtgatatttagctgtggccctgcagagtcattcctggtcccggtccgaagcccatgtcactcgctcaccctgctgggcaacgacaaacagtttgctccccgaagacatccccctccatgggtgctcaccacggcggccctggcatccattgaacccttagccttggcccaaccctatccaatcactgcctttctgccaagagacccctgtcg

SEQ ID NO: 69558 - DNA, 554 bp, Zea mays
  misc_feature: Ceres CLONE 1547865
  misc_feature (343)..(343): n is a, c, t, g, unknown, or other
ggagtccccgcggtggcggcgctctatactagtggatcccccgggctgcaggaattcgtctcacccctagaaaaagtctttcctagggtttcgtcgcttccagccgccgccgcgtccgcctcgccaagcgcagcagccgccgcagcacatcgctctctcgatctcagccatggcggagtggagcacaacggacacgccgaactcttcaccgctggaccttcgatgatgtcaggtgaacgacatctcgctgaacactacctcgctgtgaacgcgacgaagcacgcgatgtacctgccgcacaccgcgggacgttactccaaagaaagcggttccgcaagggggnattgccccatccccccagcggcgtgggggagggggtcatgatgccacgggcccaccaacggcaaaaagggcctggcttgtcccccttctccaagaaacccctggaaaacatcccccctgggtcccccaaggccaacccccttccaggggcgtcctctcaacccaaattattaaaagggggaacccccggggggaatgccccccccgtttgg

SEQ ID NO: 69559 - DNA, 642 bp, Zea mays
  misc_feature: Ceres CLONE 1547866
  misc_feature: Encodes the peptide sequence at SEQ ID NO. 69560
  misc_feature (629)..(629): n is a, c, t, g, unknown, or other
aagctggagctccccgcggtggcggccgctctagaactagtggatcccccgggctgcaggaattcgtctcacccctagaaaaatccctcctcctgtcctccacccaagccaaagcccctcggatcggatccggtctcctccgtgtcccattcgccacgcagcggcgccacaggagacggagacggagatgaagctgtccatccagtcgctcgccaggaagctgtccctgccgtccccgaagcggggcggcggcggcatcgtcgaggacgggaagaagaagaagaagcgctcgctgtcgcgcggcgaggcgccgtcgttcgcgtcctcttcttcatcctcctcctcctcctccgccaccacgacgccgcggtccgtgctggcggcggcgccggcgctggagatcccgcggcgggagctggaggccgtgctgcggcgcctgggccacgcggagccgtccgacgccgagctcgacgccgtggccgctctcgccgcgcagcccccgccgggcgacgccgacgcggacgccgacgccgacctcatggaggcgttccgcgtgttcgacgcggacggcgacggccgcatcaccgccgaggagctccgcgccgtcctggacgccgtccctcggcgcnggtgcagcctcga

SEQ ID NO: 69560 - protein, 151 aa, Zea mays
  misc_feature: Ceres CLONE 1547866
  misc_feature (116)..(144): Pfam Name: efhand Pfam Description: EF hand
  misc_feature (148)..(148): Xaa is any aa, unknown, or other
MKLSIQSLARKLSLPSPKRGGGGIVEDGKKKKKRSLSRGEAPSFASSSSSSSSSSATTTPRSVLAAAPALEIPRRELEAVLRRLGHAEPSDAELDAVAALAAQPPPGDADADADADLMEAFRVFDADGDGRITAEELRAVLDAVPRRXCSL

SEQ ID NO: 69561 - DNA, 667 bp, Zea mays
  misc_feature: Ceres CLONE 1547870
  misc_feature: Encodes the peptide sequence at SEQ ID NO. 69562
aaaagctggagctccccgcggtggcggccgctctagaactagtggatcccccgggctgcaggaattcgtctcacccctagaaaaaagaggaaacgccctgcacagcacgactcctccccatctaccgctacctttctacctacccatctagcacccctcgctcgcaaatcgcaatggcgctggccaccaactccgccgcagcagccgcggccgtgtccggtggcgtggcatcgcagccgcgccgcgcggccgtgttcctcccgctgaagaggcgtaccatctccgccatccacgccgccgacccgtccaagaacaacgggcccgcggtccccgcggccgcaggcgccaactcctccgcctcggcggtggccacgccggagaagaagccggcagcgcacgggaagtgggcggtctacagctggaggtcgaagaaggcgttgcagctccccgagtacccgaacgcggaggagctggacgcggtgctgaagaccatcgagacgttcccgccggtggtgttcgccggagaggcgcgccgcctcgaggagcgcatggccgaggccgccatgggccgcgccttcgtcctccagggtggcgactgcgccgagagtttcaaggagttccacgccaacaacatccgtgacaccttccgcgtccttctccagatggg

SEQ ID NO: 69562 - protein, 164 aa, Zea mays
  misc_feature: Ceres CLONE 1547870
  misc_feature: SWISSPROT Homolog: EC 2.5.1.54 3-deoxy-7-phosphoheptulonate synthase
MALATNSAAAAAAVSGGVASQPRRAAVFLPLKRRTISAIHAADPSKNNGPAVPAAAGANSSASAVATPEKKPAAHGKWAVYSWRSKKALQLPEYPNAEELDAVLKTIETFPPVVFAGEARRLEERMAEAAMGRAFVLQGGDCAESFKEFHANNIRDTFRVLLQM

SEQ ID NO: 69563 - DNA, 811 bp, Zea mays
  misc_feature: Ceres CLONE 1547876
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (44)..(44): n is a, c, t, g, unknown, or other
  misc_feature (494)..(494): n is a, c, t, g, unknown, or other
  misc_feature (672)..(672): n is a, c, t, g, unknown, or other
ttttttttaagttgaannnggggatgattcaagagagttgcggntgcaggtaaaaaacaccttattctgttgctccccgcggtggcggccgctctttaactagatagatcccccgggctgcaggaattcgtctcacccctagaaaattctatgttctgctagtttatgttcggagtccgtgggaatatactagctaattaataaaaagaaaaactgatgtgatgccataatagtataatgtcatggctttttgttatgtttggagaagtgatgttgtaagctattgattctgaataccactgcggcattgttggcatcaatctatttccaaacacttgccatgtgaaagcttgtttttggctgggtttatgtgaagtaaaaaacgcgctgaaaaaagacagagaaaatgaagcaactggaggttgcgcaaagttcggcccaaaagttgaagcggtaaatacggaaattatcactggcgccgtcgcgattttttnaccgccctgaattggattaaatcccgtaagccccgacgccccggattaacatagaaagtccgcaaaataacaactaacactatactaactgtgttagcgagctaaaaaagaacaacactaaatgcggcgagactcggaatgaaacaacttaagaacgcctaagacgcatagcacggancaagctaaccgacgcggaagggccaaacatctaaaacaaccagtacatattaatggaaggagggagagaacacaacgattactatatagagtgcccattctataatatacgaatgacgttacacaaaccaaacgaaaaa

SEQ ID NO: 69564 - DNA, 663 bp, Zea mays
  misc_feature: Ceres CLONE 1547878
aaagctggagctccccgcggtggcggccgctctagaactagtggatcccccgggctgcaggaattcgtctcacccctacaaatcacccttctgacttttgcacaccctgaatggccaatggaagttgtcagcgctaatattctgtctaaaattcgagttaaatttttgttcaatcatgtcatttttttaaccaatacgcccaaatccggaaaatcccttataaatcaaaagaacataccgagatagggctgagtgttgttccatttaggaacaagagtccactattaatgaacgtgcactccaacgtcaaaggagagaaaaaccgtctatcagggcgacggcccactacatgaaccaacaccctaatcaacctctttggagtctaagcgcctcacagcactaaatcgcaaccctaacggcaacccccgaatttagagattgacaggtagagaccgtcaacgaggcgacaaaggaagggaacatagccaaaggagccgactctacgccgctggcaagtgtagcggtcacgctccgcgaaaccaacacacacgccgcgctcaatgcgccgctacatgccgagtcctgcgacacttttccgcgaaatgtgccccctaacccctacttggttatttttctaaatacattcaaatatgtatgcgctca

SEQ ID NO: 69565 - DNA, 776 bp, Zea mays
  misc_feature: Ceres CLONE 1547898
  misc_feature (1)..(1): n is a, c, t, g, unknown, or other
  misc_feature (15)..(15): n is a, c, t, g, unknown, or other
  misc_feature (21)..(21): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
nccttttctttattnctggcnctctcggccctcttttattatatnnnnntcaaaactgggactccccgcggtggcggccgctctagaactagtggatcccccgggctgcaggaattcgtctcacccatagaaaaaattcctccccaaccaaacatagtttagatataaaaatatagcatcgcccgcgctctggagagtctggatcctcctgaacctccaggtagtaagcgatgaaaggagggacgcaagcagttagcctgatggtgcaccttgctgtgccatggctctgccttgcttcatgggcagctctgcaaccagcgctagcatctggaaatgtgggtgcagtagctccgatactgatagtagattacataaaattgaacttcagtaccgcttcggcgacccccgacaagtaagagagcttcatcgcttctgttcgtgctggcttggtggacaaagcggggatccaaatcttcggtgttcccgtgctggtctactaataaaaaccgctcgaggatcaatcacttctaaaacatcactactggtgaactatggcccggccgctccttttgtttttaatatggatgtattcctaaagcccacttccgtggggctacatataaaaaagagtaaacagcctccgttgcactacttcaaggaaagtcatgctactcgaccttcaccctgatttgattcatcatggtattacttcccggtgaatctcccgtggggaggattatgagtgatttcttgtcataccggcaccctcccccatc

SEQ ID NO: 69566 - DNA, 857 bp, Zea mays
  misc_feature: Ceres CLONE 1547900
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (27)..(27): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
aaaaaaattacgaccctcnnnagccgnttccatacaaaannnnnnnnnnnnncaaaatggaactcaccgcggtggcggccgctctagaactagtggatcccccgggctgcaggaattcgtctcacccctagaaaaaaacttacctagaagtgacagtgacattttctctgtacctcacgaaaggagtgatgtatcatgtcgagccctctcgttcccaattccagtggaaacacgttcgatttcaggatagccaagctaatgccatggaaggaaccaggaaccggggggcatggccatgggacgaaaaatgattattataaggatgtggataccatagcttttggactttctcaagcttgaaacataaggtttggggcatttccacattaagcccattctctgttccaatctttttccaataaaaactggtttccacccccccccccccacctgggggtgggggaactaccttaatctcctcgctctttagtatacagctcgcaaacacatcactattatttccccaaaaaatggcacactattatccaccacctctcttgcgcctaggttgtagcagtccatataaccccgcacctaccctctctcgccgtgtgtatactatcacaccgtatccaccacccctgttgtggttccaccattacaacaggacaggcctacgctgggccgtggtgactcagtaagaaccgagtcccattgatataaggatagaaaacatgtacgtcctttttgtacctcaccctttttgcgcgcgtatatggacccccgctttgttcgacagcgcgtgagtgcggcggggttagcgtgcgggggtaggtcaagtgagcgttctcttctat

SEQ ID NO: 69567 - DNA, 651 bp, Zea mays
  misc_feature: Ceres CLONE 1547905
  misc_feature: Encodes the peptide sequence at SEQ ID NO. 69568
atagctggagctccccgcggtggcggccgctctagaactagtggatcccccgggctgcaggaattcgtctcacccctagaaaaacccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttacactcggaccaaagggaaggaatgttgttttggagagcaagtatggttctcctaaaattgttaacgatggtgttacagttgccagagaggttgagctggaggaccctgtggagaacattggtgctaaattggtcaggcaagcagcagctaagaccaatgatctagctggagatgggacaaccaccctctgtggtccttgctcaggggctgatcgctgaaggtgttaaggttgtggcagctggtgctaatcctgttcagattactcgtggtatc

SEQ ID NO: 69568 - protein, 135 aa, Zea mays
  misc_feature: Ceres CLONE 1547905
MASTFGATSTVGLMAAPTGKNVRLQRRVNFRVRAAKELYFNKDGSAIKKLQTGVNKLADLVGVTLGPKGRNVVLESKYGSPKIVNDGVTVAREVELEDPVENIGAKLVRQAAAKTNDLAGDGTTTLCGPCSGADR

SEQ ID NO: 69569 - DNA, 654 bp, Zea mays
  misc_feature: Ceres CLONE 1547915
  misc_feature: Encodes the peptide sequence at SEQ ID NO. 69570
  misc_feature (654)..(654): n is a, c, t, g, unknown, or other
aaagctggagctcaccgcggtggcggccgctctagaactagtggatcccccgggctgcaggaattcgtctcacccctagaaaaagttcgttgccgtccccccccccccctctcgggtcacacatacgggctggcaattctctgctccctgcttcgttttccagcggccacgcacgcggtcgggttgcgtttgcgtctcccctccggcacccaagcttccgtcacctcttccttccccaagccgtcggtctccgccgctggcctgccgggtgggactcggcgtgggcgcgcctggaccggaccggacccgcccgcgaggatgcggagatgctaagtaggaattcttctcggacctccaccaagcacctgttatctgtgtatgcggagaagttagattattaagtgcagttgggcctgacttgttttatggctcgaaataatgagggccatctcgagctgccagagatggatcaaattcaacccaagaacatcccacacaatgaatcactgcctctaggccagaagcttctcctgcatcatggaagtgatgcgccccttagaattggtcattcaagtcatggaaatatgggacttagaataaatgatcttccatcttcaagtcgcactgtgcagactctaggttatagagttgggn

SEQ ID NO: 69570 - protein, 76 aa, Zea mays
  misc_feature: Ceres CLONE 1547915
MARNNEGHLELPEMDQIQPKNIPHNESLPLGQKLLLHHGSDAPLRIGHSSHGNMGLRINDLPSSSRTVQTLGYRVG

SEQ ID NO: 69571 - DNA, 666 bp, Zea mays
  misc_feature: Ceres CLONE 1547922
  misc_feature: Encodes the peptide sequence at SEQ ID NO. 69572
  misc_feature (470)..(470): n is a, c, t, g, unknown, or other
aaagctggagctccccgcggtggcggccgctctagaactagtggatcccccgggctgcaggaattcgtctcacccctagaaaaaatggccggaaaaggagacgggccggcgatcggcatcgacctcggtacgacctactcgtgcgtcggggtgtggcagcatgaccgagtcgagatcatcgccaacgaccagggcaaccgtacaacgccgtcttatgtcgcgttcaccgattcggagaggctcgtcggcgacgccgccaagaaccaggtcgccatgaaccccatcaacaccgtcttcgacgcgaagcggctcatcggccggcgcttctctgacgcgtcggtgcagagtgacgccaagctatggcctttcaaggtgatcccgggctccggcgacaagcccatgatcggggtgcagttcaggggcgaggagaaacagttctcggccgaggagatcagctccatgatcctgancaagatgaaggaaacgggcgaagtttacctcggcaccacatcaagaacgctgtcgtcaccgtccccggccattttaaagattcccaaccccgggccccaaggaacccggggttatttccgggcctaaaggtattggggttttttaaaaaagccccccgcccggggcatttaataaaggggctcaaaaaaaaaacaa

SEQ ID NO: 69572 - protein, 170 aa, Zea mays
  misc_feature: Ceres CLONE 1547922
  misc_feature (129)..(129): Xaa is any aa, unknown, or other
MAGKGDGPAIGIDLGTTYSCVGVWQHDRVEIIANDQGNRTTPSYVAFTDSERLVGDAAKNQVAMNPINTVFDAKRLIGRRFSDASVQSDAKLWPFKVIPGSGDKPMIGVQFRGEEKQFSAEEISSMILXKMKETGEVYLGTTSRTLSSPSPAILKIPNPGPQGTRGYFRA

SEQ ID NO: 69573 - DNA, 654 bp, Zea mays
  misc_feature: Ceres CLONE 1547927
  misc_feature: Encodes the peptide sequence at SEQ ID NO. 69574
  misc_feature (523)..(523): n is a, c, t, g, unknown, or other
  misc_feature (524)..(524): n is a, c, t, g, unknown, or other
atagctggagctccccgcggtggcggccgctctagaactagtggatcccccgggctgcaggaattcgtctcacccctagaaaaagttttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgccgcggcccgtcgaggttagcccgcaggcgtggcagctcctctccatcttcctctccacaatcgcggggctggtgcttggccctctccctgtcggcgcatgggccttccnntcgggctcacaagccggcccgtcgccaatccggaagggttccccttttaaacgggccgcccttttcccccccctttacaccaaacaaaagaggggcccccgggggggccaaacccacaatatttcctccc

SEQ ID NO: 69574 - protein, 184 aa, Zea mays
  misc_feature: Ceres CLONE 1547927
  misc_feature (141)..(141): Xaa is any aa, unknown, or other
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIAIGLAVRFLAPRPVEVSPQAWQLLSIFLSTIAGLVLGPLPVGAWAFXSGSQAGPSPIRKGSPFKRAALFPPLYTKQKRGPRGGQTHNISS

SEQ ID NO: 69575 - DNA, 632 bp, Zea mays
  misc_feature: Ceres CLONE 1547929
  misc_feature: Encodes the peptide sequence at SEQ ID NO. 69576
  misc_feature (208)..(208): n is a, c, t, g, unknown, or other
  misc_feature (272)..(272): n is a, c, t, g, unknown, or other
  misc_feature (287)..(287): n is a, c, t, g, unknown, or other
  misc_feature (289)..(289): n is a, c, t, g, unknown, or other
aagctggagctccccgcggtggcggccgctctagaactagtggatcccccgggctgcaggaattcgtctcacccctagaaaaaaagtcacaacaaacaccaccatccctttgctcagagcatcacactccctctctctcgcgcgcgctcacaagcacgtcgtcaaccatggttgtcgagatgaaggagaacggcggaaccgcgttggncgcgggcgaaaaggcgccgcagctgggcgtgaaagcgcgcgagccgacgctgttgccgcccggncgagcaacgccgacngncgggcagtactacctgtcccacctgaacaaaacaatccgggtgatcctgcaaacggggtacgtgtaaaaccttccctcccccgggggggaaaagcaaaggaaacttggaactggaaaggcccccccccaaccccttggccccgtgttggggtccatccccccccttgggggggggtgggggggccccccccaaaaaaaacccccccggagaaaaaaacccggaggggccccctttttttagaggaaaacaccccctgaaacaccaaccaccggggggaaacacaaaaaaaaaccccccccccccgggggggaaaattttttttaccccccccccccggggaaa

SEQ ID NO: 69576 - protein, 62 aa, Zea mays
  misc_feature: Ceres CLONE 1547929
  misc_feature (14)..(14): Xaa is any aa, unknown, or other
  misc_feature (41)..(41): Xaa is any aa, unknown, or other
MVVEMKENGGTALXAGEKAPQLGVKAREPTLLPPGRATPTXGQYYLSHLNKTIRVILQTGYV

SEQ ID NO: 69577 - DNA, 655 bp, Zea mays
  misc_feature: Ceres CLONE 1547930
  misc_feature: Encodes the peptide sequence at SEQ ID NO. 69578
caaagctggagctccccgcggtggcggccgctctagaactagtggatcccccgggctgcaggaattcgtctcacccctagaaaaaaggtcggggctggggagcacacacccatcacccatggcctgactgacctccggactctccctgcttccgtcgccgccgcgggccgcccagctgactgctcctgccctccgcccgccctccatggcgtccgtcaagctcggctccaagcctgacgccttcaagcggcaaggccaggcatggttctgcacaacaggacttcctagcgatgtcaccgttgaggttggggatatgtctttccaccttcacaagttccctttactttcaaaaagtgcctttcttgaacggtcaattgaagaaaattctgaccaagaagaatgcatcatcaaactaaatgacattcctgggggtgccaagtcatttgagctagttgcaaggttctgctatggtgtgaaaatagagctttcacctgcaaatgttgtctacctacggtgtgcctcagagcatctagaaatgactgaagaagtagctgaggaaaacctgattgcacagtcagaaatgttcctcaaccaagtggttctccgtaactggaaagattccttggcagcattggaaacatgtgatgacctactc

SEQ ID NO: 69578 - protein, 150 aa, Zea mays
  misc_feature: Ceres CLONE 1547930
  misc_feature (23)..(124): Pfam Name: BTB Pfam Description: BTB/POZ domain
MASVKLGSKPDAFKRQGQAWFCTTGLPSDVTVEVGDMSFHLHKFPLLSKSAFLERSIEENSDQEECIIKLNDIPGGAKSFELVARFCYGVKIELSPANVVYLRCASEHLEMTEEVAEENLIAQSEMFLNQVVLRNWKDSLAALETCDDLL

SEQ ID NO: 69579 - DNA, 638 bp, Zea mays
  misc_feature: Ceres CLONE 1547933
  misc_feature: Encodes the peptide sequence at SEQ ID NO. 69580
aaagctggagctccccgcggtggcggccgctctagaactagtggatcccccgggctgcaggaattcgtctcacccctagaaaaagctcgctgccgtcgccgcgccgcattcgcatcaccgcatcgcgccgccgaggctgcttactagacggacgaggagtggactggagtaacttgcagcaaccctatcccggcaggtcccatcgcgaaaccctagacttcgccgccggcggtcgccggagatggcctcctcgccgccgcgcgccccgcagctattccctttcgaccttaacgtcgcgcaggaggaggtagatgaggagccgattgaggttcttgaggaggatgtcgatgaggagggagccccgttggcgcaacccgaggaggttgtcgtcgaggaggtcgttgagaaattggtcgagcacgcggtgcctaccacggaggatgaacctgcggaagacgtgatcatggaggagccttcggaggaggtgatcatggaggacgaggagcctacgccgtcgccggcggaggaggtggttggggaggggaagaggaggaaaaagagggtggactatgaggtcttcgtgtccgggctgccgcaggacgccgctgatgaggacgtggcgcaggcgctggcggatg

SEQ ID NO: 69580 - protein, 132 aa, Zea mays
  misc_feature: Ceres CLONE 1547933
MASSPPRAPQLFPFDLNVAQEEVDEEPIEVLEEDVDEEGAPLAQPEEVVVEEVVEKLVEHAVPTTEDEPAEDVIMEEPSEEVIMEDEEPTPSPAEEVVGEGKRRKKRVDYEVFVSGLPQDAADEDVAQALAD

SEQ ID NO: 69581 - DNA, 820 bp, Zea mays
  misc_feature: Ceres CLONE 1547936
  misc_feature (20)..(20): n is a, c, t, g, unknown, or other
  misc_feature (21)..(21): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (68)..(68): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
tttgtgtttaacgcgggggnnacccccatttccnnnnnnnnngggagggnnnnnaaaacaaaaactcnccnnnggggcggccgctctttactagtggatcccccgggctgcaggaattcgtctcacccctagaaaaacatttatctaatctgtcatctattgtgtcaggatccttggaaaaccaccctgctgctcagggcgaagaacgagctgaagaaaaaggaggacgatgaggacgaccttacataagtattgtagtaaacagaaatggtaccatatgttttggtttgtgcctccattgcattggaggcatcgtgttccttacaaacgagccatgatgaaattaatccgctggtctggttgtacagaacgtcaattttgggttcctactgttgattgtgactgcccgttttcctttttttttttcccccccccctaaagggggggggggggggggaggctttcctctcctggcggctcctagttaattttctcaaagacccttaaaaaccttaatttctcctaaattgctacccttcttgacccccctacctcttcatactagactcctcatccctgcgcctctcaaagctgcgcacttcgcactccacgcacatagaaaaaagacaccaaactccgaataccgctacgatagggccacccctacttatccaccccccaatacactcctcactcactcaatgcccagctcacgcaacctcgcgtggccaccaactttctctcctccccccgcgcccgccgccaagtgggtccaataaacccccccagtcctctacacctacacctatctctcaccctg

SEQ ID NO: 69582 - DNA, 647 bp, Zea mays
  misc_feature: Ceres CLONE 1547937
  misc_feature: Encodes the peptide sequence at SEQ ID NO. 69583
aaagctggagctccccgcggtggcggccgctctagaactagtggatcccccgggctgcaggaattcgtctcacccctagaaaaaatacccccccgtctcccttgtgttcttttcgttcgttcccctcgccctcctccctcctccctccctccccgtcggttctttcacaacaccaccaggcaccagcggaccagcagcaagcaatcgcgcttaatcactcgcccccgttacaaatccgcgatattcccaaatatcttctcttgccctccgcctccgcctccgcctccacctcggattccatcgccgcccttttccttccttctccccttgcccgcccgcccgcccgtccaggactgtccttggcgtttcttacgcagctcgtccttcgcgcttctttgccggccattagagagaaagagagagagtgagacaggatcactcggtagtcgggatcgcgcggcgccaccgtaccccgcccgggacatgtgcgtggaggggctagacgacgcagcagggacgctcgccttcggagaccacgagaacgacaggcgcgacggtgccgcgatggagagggtttgtgagaacacggtgtctgttgagttgaagcaaactaagccgaacaacttcgtcccgttcatccggtcagg

SEQ ID NO: 69583 - protein, 54 aa, Zea mays
  misc_feature: Ceres CLONE 1547937
MCVEGLDDAAGTLAFGDHENDRRDGAAMERVCENTVSVELKQTKPNNFVPFIRS

SEQ ID NO: 69584 - DNA, 646 bp, Zea mays
  misc_feature: Ceres CLONE 1547939
  misc_feature: Encodes the peptide sequence at SEQ ID NO. 69585
  misc_feature (646)..(646): n is a, c, t, g, unknown, or other
atagctggagctccccgcggtggcggccgctctataactagtggatcccccgggctgcaggaattcgtctcacccctagaaaaaaagtcacaacaaacaccaccatccctttgctcagagcatcacactccctctctctcgcgcgcgctcacaagcacgtcgtcgaccatggttgtcgagatgaaggagaacggcggagcggcgttggcggcgggcgagaaggcgccgcagctgggcgtgaagcgcggcgagccgacgctggtgccgccggcggaggcgacgccgacgggcgggcagtactacctgtccaacctggaccagaacatcgcggtgatcgtgcagacggtgtactgctacaagccttcctcgcccggcggcggcgaaggcaacgaggacgtggacgtggcaagcgcgctccgcgacgcgctggcgcgcgtgctggtgcactaccacccgctggcggggcggctgggcgtcagcccggagatgaagctcaccgtggagctgaccggcgagggcgccgtgttcgtggaggccgacgccgcctgcgacctcgacgccgtcggcgacctcaccaagcccgaccccgccgcgctcggccagctcgtctactccgtccccggcgctaagcacatcctcgagatgn

SEQ ID NO: 69585 - protein, 159 aa, Zea mays
  misc_feature: Ceres CLONE 1547939
  misc_feature: SWISSPROT Homolog: EC 2.3.1.167 10-deacetylbaccatin III 10-O-acetyltransferase
MVVEMKENGGAALAAGEKAPQLGVKRGEPTLVPPAEATPTGGQYYLSNLDQNIAVIVQTVYCYKPSSPGGGEGNEDVDVASALRDALARVLVHYHPLAGRLGVSPEMKLTVELTGEGAVFVEADAACDLDAVGDLTKPDPAALGQLVYSVPGAKHILEM

SEQ ID NO: 69586 - DNA, 670 bp, Zea mays
  misc_feature: Ceres CLONE 1547943
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (326)..(326): n is a, c, t, g, unknown, or other
  misc_feature (327)..(327): n is a, c, t, g, unknown, or other
  misc_feature (336)..(336): n is a, c, t, g, unknown, or other
  misc_feature (341)..(341): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (349)..(349): n is a, c, t, g, unknown, or other
  misc_feature (350)..(350): n is a, c, t, g, unknown, or other
  misc_feature (353)..(353): n is a, c, t, g, unknown, or other
  misc_feature (355)..(355): n is a, c, t, g, unknown, or other
  misc_feature (356)..(356): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (373)..(373): n is a, c, t, g, unknown, or other
  misc_feature (378)..(378): n is a, c, t, g, unknown, or other
  misc_feature (395)..(395): n is a, c, t, g, unknown, or other
tggagctccccgcggtggcggccgctctagaactagtggatcccccgggctgcaggaattcgtctcacccctagaaaaaccgtgccgggaacctacggcttctactgcgagccgcatcaaggagccggaatggtcggcaagatcaccgtcaactaattaagctagctatcgatcgatatccattcatgtattagctgttgcttcctgctttgtactccgccgatctgtccatctctacatgttttcgtcttcacacaacaacctctgctacgactacgtatatatgcatgctactagctgattgattttaaaaaannnnnnnnaannaaaaaaaanaaaanaannnaannaanannannnnnccccccccccnaaggncgggggggggccccccnggaaaaaaaaaaacccgccccctcccggggaccccatttcccccttaatggggggccgtattaacccggcctccttgggccgttgttttccaaccggtggggaggggaaaaaaccccggggcttccccacaattaaaggccctttggggaacaatccccctttttcgccgtgggggagaaaaaacaaaaaaaagcccccccccaaatccccctttcccaaaatttggcccccccccggaggggaaaatgggaaatttgtaccccctttaattttg

SEQ ID NO: 69587 - DNA, 618 bp, Zea mays
  misc_feature: Ceres CLONE 1547954
  misc_feature: Encodes the peptide sequence at SEQ ID NO. 69588
ggagctccccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgaccgccgctcctccagaagcctcagcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcggcttcgtgtaccgcgagaactccacctccccgtgctactacgacggccgctactggaccatgtggaagctgcccatgttcggctgcaacgacgccaccccagtgtacgaggagctgcaggaggccatcgaatactacccggacgacttccaccgcgtcatcggcttccacacgatcagcagacgcagtgcgtcagct

SEQ ID NO: 69588 - protein, 160 aa, Zea mays
  misc_feature: Ceres CLONE 1547954
  misc_feature (58)..(159): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPVDRRSSRSLSNVSNGGRIRCMQVWPAYGNKKFETLSYLPPLSTDDLLKQVDYLLRNGWIPCLEFSKVGFVYRENSTSPCYYDGRYWTMWKLPMFGCNDATPVYEELQEAIEYYPDDFHRVIGFHTISRRSASA

SEQ ID NO: 69589 - DNA, 652 bp, Zea mays
  misc_feature: Ceres CLONE 1547970
  misc_feature: Encodes the peptide sequence at SEQ ID NO. 69590
aaactggagctccccgcggtggcggccgctctagaactagtggatcccccgggctgcaggaattcgtctcacccctagaaaaatccgcatctcgcattctcgccggtgctgctgcaattaacgccgcctccggccaaccacccgaaacctacctccgccgccgtcgtcgccaccgtcaacatggcgagccaaggggagccctcggcctctgcttccgatccgaaggagaagaaggacttctcgacggcgatcctggagaggaaaaagtcaccgaaccgccttgtcgtcgacgaggccaccaacgacgataactccgtcgtcgctctgcaccctgacaccatggagaggctgcagctcttccgcggcgacaccgtgctcctcaagggtaagaagaggaaagacactatttgcattgtccttgcggacgaaacctgtgaggagccaaaggttcggatgaacaaggttgtccgccagaacctaagggtgaggcttggtgatgtggtttctgtccaccagtgccaggatgtgaaatatgggaagcgtgtccacattcttccaattgatgatacagttgaaggcattacagggaacctgtttgatgccttcttgaaaccatatttcctagaagcatacaggccgttgaggaaaggaa

SEQ ID NO: 69590 - protein, 157 aa, Zea mays
  misc_feature: Ceres CLONE 1547970
  misc_feature (30)..(116): Pfam Name: CDC48_N Pfam Description: Cell division protein 48 (CDC48), N-terminal domain
MASQGEPSASASDPKEKKDFSTAILERKKSPNRLVVDEATNDDNSVVALHPDTMERLQLFRGDTVLLKGKKRKDTICIVLADETCEEPKVRMNKVVRQNLRVRLGDVVSVHQCQDVKYGKRVHILPIDDTVEGITGNLFDAFLKPYFLEAYRPLRKG

SEQ ID NO: 69591 - DNA, 652 bp, Zea mays
  misc_feature: Ceres CLONE 1548002
  misc_feature: Encodes the peptide sequence at SEQ ID NO. 69592
  misc_feature (652)..(652): n is a, c, t, g, unknown, or other
aaagctggagctccccgcggtggcggccgctctagaactagtggatcccccgggctgcaggaattcgtctcacccctagaaaaagtacatgccgtgcggtggtagagtcctgagtcctaggtcaattggtcaaatccccgctcgagcttgataaaacacgcaaggctgtctgcctgtctggctgtctctgctcccatctcaagaaatccacttcgattcgccctgggacgctcctgcctcctgctagtcgacgcgcaatccttggcactctggcagacaggtgaggcgctgagcctgctactactaactaggagcccgggaaatgagggatgcggaggcggaggcggcgtcgcgccggcggtggacgctggtgctggtgaacatggcgtcggtgctggagaaggcagacgaggtgttgctgcccgccgtgtacaaggaggtgggcacggcgctgggcgcttctccgaccgcgctgggctccctcaccctctgccgcgcgctcgtccaggccgcctgctacccgctcgccgcctacgcctccgcgcgccacgatcgggcccgtgtcgtcgccgtcggagccttcctctgggccgccgccaccttcctcgtcgccgtctccggcagcttcctccagatggcgatctcgcggggn

SEQ ID NO: 69592 - protein, 110 aa, Zea mays
  misc_feature: Ceres CLONE 1548002
MRDAEAEAASRRRWTLVLVNMASVLEKADEVLLPAVYKEVGTALGASPTALGSLTLCRALVQAACYPLAAYASARHDRARVVAVGAFLWAAATFLVAVSGSFLQMAISRG

SEQ ID NO: 69593 - DNA, 646 bp, Zea mays
  misc_feature: Ceres CLONE 1548011
  misc_feature: Translation starting site: 193
  misc_feature (307)..(307): n is a, c, t, g, unknown, or other
  misc_feature (363)..(363): n is a, c, t, g, unknown, or other
  misc_feature (486)..(486): n is a, c, t, g, unknown, or other
tggagctccccgcggtggcggccgctctagaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaccngcaccacaccctcgtacgtcgccttcaccgactccgagcgcctcatcggagatgcngccaagaaccatgtcgccatgaccccatcaacaccgtctttgatgcccagcgtctcattggcagggagtttagtgatgcctctgtccagagtgaaattaagctgtggcccttcagggcatccntggggcccggtgagatcccaatgaatagttgtccacaccaggggggagagaaacagtttgcagccgaagagatctccctccatgggtctcatccagatgcgtgagatcgctgaagcttaccttggcacacgatcaagaatgctgttgtcacggtccctgc

SEQ ID NO: 69594 - DNA, 998 bp, Zea mays
  misc_feature: Ceres CLONE 1548015-R
cctacactctggaaacttctacatcagaattcagaaagggggagaaaaacgtatctgttgagctacaaataacagagcattcatgtgacacggacaaatatgagatatacacattggatggggcgcaggaacacaaggatgcagcaactctagtacaaaataggttgccgggccggccatgccaaagaagcatggcaacatgctgtgaactagccatctagttccgcgtttcactggcaccgacggattacagtagcagcaccatggccacagcaacaacgcacaggttgccgcccgagactcatcaccagtgcccacctttttccgggggccaacggggcacagatgaatcccacggagcttccgttcaggggctctgagcatatagcagcacaattgttctccgtttaaaaaccctctgaaaactgcttcagaccaagcctggtagggcccacaaatcacagcccccctttttgggaaaagcaaactgccttaaatcttggggaaggaaacccatccaaagttggaaaaccccggcctgaacccgccgtcccccctaaaaaaagagtcccttttccccccctttccacggggtgggcccaagagagtcttccctcaaaacatggccttttcctctatggaggccacccaatacccccaagtttcttttcctttctttttgcttgggagaagaaaaagatttattttagggagggggatagttcaagctcattcaaatgtgggggttccacaccccccctcccaaaatgtgggggacaagcaccacacgaaaaaattcccccacacaatgtggtccgccccaaaaaagaaaaaccccttttcttctgaagtggggacggcccctaccccccgccggggggaaaattaatatattggggctcctctcccctctttattttggaatagaagggaacacccccccccccctctttctttgcttcttggggcattcttcttccacacaacgtttggagatg

SEQ ID NO: 69595 - DNA, 669 bp, Zea mays
  misc_feature: Ceres CLONE 1548015
  misc_feature: Encodes the peptide sequence at SEQ ID NO. 69596
aaagctggagctccccgcggtggcggccgctctagaactagtggatcccccgggctgcaggaattcgtctcacccctagaaaaagcctccggttgtcccctccatcagtcccctcgtccttctcccctctccacacggcgtcgcggctcccctcattcgccggcgtcgactatgaacggaggcagccggcggcagcggtactcctcagagcagctcctcttcgacgtccccgccaatgccggtgccggccggtgggcgcagcagcgtggcggggtgcgtcgcggggacggggagatcttcgtgtcggtggagcccgcgacgccggcgcggctgtgcggaggggacgccacggccggggactcgccgggacagaggcagcagctcagtcccgggttgctcgacctccatgcgttcgacaccgagcttattcccgattttcaagtaccaggaatctatgatggtgcccaaaagtttggctatggaggaggtctagatgaatctgatatgagattcacatcaaacaagatgatgagcaagtctactatttttcctgatggtaactatctgaaggccttcactgagaaagaaaaagcagcacctgtcgcgaaaatcaaagtggtggtgcgccaaaagacacttaacaaaaaggaagtatcaaagaaggaagaa

SEQ ID NO: 69596 - protein, 166 aa, Zea mays
  misc_feature: Ceres CLONE 1548015
MNGGSRRQRYSSEQLLFDVPANAGAGRWAQQRGGVRRGDGEIFVSVEPATPARLCGGDATAGDSPGQRQQLSPGLLDLHAFDTELIPDFQVPGIYDGAQKFGYGGGLDESDMRFTSNKMMSKSTIFPDGNYLKAFTEKEKAAPVAKIKVVVRQKTLNKKEVSKKEE

SEQ ID NO: 69597 - DNA, 648 bp, Zea mays
  misc_feature: Ceres CLONE 1548016
  misc_feature (547)..(547): n is a, c, t, g, unknown, or other
  misc_feature (589)..(589): n is a, c, t, g, unknown, or other
aaaactggagctccccgcggtggcggccgctctagaactagtggatcccccgggctgcaggaattcgtctcacccctagaaaaaagcagcagagcagcctaccttttcccctctccacctcccgcaagcaaactcacggtcacggcaccgcccccgcacccactgccctctagcttcttcctccccgctttcatggcaggaaaggctgaggcgatgatgcccataggccatccagtttgatccatgccatcctgaacctctatacatactgccccagcccgggcactcgcgatctctacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggatttgggtgggagctgcgctgcagctgcttgccccctcgcngttctttgctcaattgggggtgtcgcgcgtggctcctgggcngaatttcgtgtcttgcctgggcgggtcacgtccccgtcccggtccccatcccttggggg

SEQ ID NO: 69598 - DNA, 649 bp, Zea mays
  misc_feature: Ceres CLONE 1548019
  misc_feature: Encodes the peptide sequence at SEQ ID NO. 69599
  misc_feature (558)..(558): n is a, c, t, g, unknown, or other
  misc_feature (597)..(597): n is a, c, t, g, unknown, or other
aagctggagctccccgcggtggcggccgctctagaactagtggatcccccgggctgcaggaattcgtctcacccctagaaaaagcgccaccaaccgcagatcctaaatccgatctctctctctctctctctctctctctctctctctccctccctctcgaggttttcggtttcgatccggcaagcgggcgagatcttcatggcgacgtcgttcgaccgctgggagaaggaccccttcttcctcgccgccgaggaggtccaggaatccgccgatcggatggaatcggtttatcgggtatgggtgcaggagaggagcgggggcgattccgaggcggcaagcgtcactggaggccctacagctgcgcagcttcgccgcgagctgcacacggcgctcggcaccgccaagtggcagcttgatgaactggcgcgggcagtcagatcgaacgatctgattatgtcagcaggaaaagacacaagagctaggcatgatgattttgttacagcaatcggctatcgcatattagaggtcgagaactacttgaaagaatcccatcttgcngacgggagggggccattgagctgggttcacttggatgangaggaaagggacgaccttgcagctttcctatctgccagtccttttcacagaa

SEQ ID NO: 69599 - protein, 150 aa, Zea mays
  misc_feature: Ceres CLONE 1548019
  misc_feature (11)..(111): Pfam Name: Syntaxin-6_N Pfam Description: Syntaxin 6, N-terminal
  misc_feature (133)..(133): Xaa is any aa, unknown, or other
MATSFDRWEKDPFFLAAEEVQESADRMESVYRVWVQERSGGDSEAASVTGGPTAAQLRRELHTALGTAKWQLDELARAVRSNDLIMSAGKDTRARHDDFVTAIGYRILEVENYLKESHLADGRGPLSWVHLDXEERDDLAAFLSASPFHR

SEQ ID NO: 69600 - DNA, 668 bp, Zea mays
  misc_feature: Ceres CLONE 1548024
  misc_feature: Translation starting site: 201
  misc_feature: SWISSPROT Homolog: EC 1.1.1.40 Malate dehydrogenase (oxaloacetate-decarboxylating) (NADP(+))
  misc_feature (434)..(434): n is a, c, t, g, unknown, or other
  misc_feature (437)..(437): n is a, c, t, g, unknown, or other
  misc_feature (446)..(446): n is a, c, t, g, unknown, or other
  misc_feature (447)..(447): n is a, c, t, g, unknown, or other
aagctggagctccccgcggtggcggccgctctagaactagtggatcccccgggctgcaggaattcgtctcacccctagaaaaaatcccccctctccacactgccaactcgctccgaagagggaggaggacgacgccggttgccactgccactgccgcgccgctcccgtctcccctccctccgcgggaactcggcgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgccccagcgggtggacgcggtcgcgatggtctcccacgcggagacggtgacggagaaggagcaggatgaagcngcngcccgccannccagagctgcccgtcatgccttgggccacctcggtcgcaagcggttacaccctttttgaggatcaacacacaaacagggtccttgctttcccaaaggaggaaagggatggaaccctacttggggtgaagggtttcccccgggggatttttctcaggaacctcaaattaaaaatttcatggaaccccccgtggggaaaaaccaaaccccctttgccggggtt

SEQ ID NO: 69601 - DNA, 632 bp, Zea mays
  misc_feature: Ceres CLONE 1548026
  misc_feature: Translation starting site: 142
  misc_feature (278)..(278): n is a, c, t, g, unknown, or other
  misc_feature (282)..(282): n is a, c, t, g, unknown, or other
  misc_feature (286)..(286): n is a, c, t, g, unknown, or other
  misc_feature (289)..(289): n is a, c, t, g, unknown, or other
  misc_feature (321)..(321): n is a, c, t, g, unknown, or other
  misc_feature (336)..(336): n is a, c, t, g, unknown, or other
  misc_feature (338)..(338): n is a, c, t, g, unknown, or other
  misc_feature (339)..(339): n is a, c, t, g, unknown, or other
  misc_feature (343)..(343): n is a, c, t, g, unknown, or other
  misc_feature (345)..(345): n is a, c, t, g, unknown, or other
  misc_feature (346)..(346): n is a, c, t, g, unknown, or other
  misc_feature (373)..(373): n is a, c, t, g, unknown, or other
  misc_feature (378)..(378): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (399)..(399): n is a, c, t, g, unknown, or other
  misc_feature (408)..(408): n is a, c, t, g, unknown, or other
  misc_feature (409)..(409): n is a, c, t, g, unknown, or other
  misc_feature (426)..(426): n is a, c, t, g, unknown, or other
  misc_feature (428)..(428): n is a, c, t, g, unknown, or other
  misc_feature (429)..(429): n is a, c, t, g, unknown, or other
  misc_feature (434)..(434): n is a, c, t, g, unknown, or other
  misc_feature (435)..(435): n is a, c, t, g, unknown, or other
  misc_feature (441)..(441): n is a, c, t, g, unknown, or other
  misc_feature (444)..(444): n is a, c, t, g, unknown, or other
  misc_feature (447)..(447): n is a, c, t, g, unknown, or other
  misc_feature (448)..(448): n is a, c, t, g, unknown, or other
  misc_feature (453)..(453): n is a, c, t, g, unknown, or other
  misc_feature (477)..(477): n is a, c, t, g, unknown, or other
ggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggttcatcttcgntggnaaanagnttgaggacgggcgcacgcttggtgactacaanatccagaaggagagnanncctnannttgtgctccgcctcaggggagggatgnagatntttgtgaaaannntgaccggnaagaatatnnaccttgaggtggagtcntnntgaannattganaangtnnagggnaagattcaggacaaggagggaatnactccaaaccagcagcgcctcatctttgctgggaagcaccttgaggacgggcgcacgcttcgccactacaacttcccaacggagaccaccctccacttggtgctgcgcctcaggggaaggatgaagattttcgctgagaccccgacccggccaac

SEQ ID NO: 69602 - DNA, 669 bp, Zea mays
  misc_feature: Ceres CLONE 1548029
  misc_feature: Encodes the peptide sequence at SEQ ID NO. 69603
aaagctggagctccccgcggtggcggccgctctagaactagtggatcccccgggctgcaggaattcgtctcacccctagaaaaaactccttcgttatcaccagtacccacccatacctcaccgcctcatctgctctcatcccccgtcttcttcccaagctgccacgttgcctccctccctccgctccagcggcccatggcgttcgccctggcgggggccttcaagggcctctccctggtgcccgccaccacctcctccttcccgcgcggcgaccgcgcctcgctctccgtcggcggcgcagccggcgtgccggtgccggtgccggcgcggcggctcaccatccagatggcgcacaagaagggggccgggagcaccaagaacggccgcgactccaagggacagcgcctcggggtcaagatatacggcgaccagctcgccaagcccggggccatcatcatccgccagcgcggcaccagggtctatcctggaaataacgttggaatgggcaaggatcacacactcttttctttgatagatggactcgtcaagtttgagaagtatgggccggacaaaaaaaaggttagtgtttacccatatgagaaggagcctgaaaacccaaacagttacagagcaaggaagagagagtacttcccgcatgcggcgtgaacg

SEQ ID NO: 69603 - protein, 156 aa, Zea mays
  misc_feature: Ceres CLONE 1548029
  misc_feature (52)..(132): Pfam Name: Ribosomal_L27 Pfam Description: Ribosomal L27 protein
MAFALAGAFKGLSLVPATTSSFPRGDRASLSVGGAAGVPVPVPARRLTIQMAHKKGAGSTKNGRDSKGQRLGVKIYGDQLAKPGAIIIRQRGTRVYPGNNVGMGKDHTLFSLIDGLVKFEKYGPDKKKVSVYPYEKEPENPNSYRARKREYFPHAA

SEQ ID NO: 69604 - DNA, 681 bp, Zea mays
  misc_feature: Ceres CLONE 1548030
  misc_feature (353)..(353): n is a, c, t, g, unknown, or other
  misc_feature (369)..(369): n is a, c, t, g, unknown, or other
  misc_feature (370)..(370): n is a, c, t, g, unknown, or other
  misc_feature (448)..(448): n is a, c, t, g, unknown, or other
  misc_feature (450)..(450): n is a, c, t, g, unknown, or other
  misc_feature (481)..(481): n is a, c, t, g, unknown, or other
  misc_feature (518)..(518): n is a, c, t, g, unknown, or other
  misc_feature (536)..(536): n is a, c, t, g, unknown, or other
  misc_feature (609)..(609): n is a, c, t, g, unknown, or other
  misc_feature (667)..(667): n is a, c, t, g, unknown, or other
  misc_feature (681)..(681): n is a, c, t, g, unknown, or other
aacacgctggactccccgcggtggcggccgctctagaactagtggatcccccgggctgcaggaattcgtctcacccctagaaaaaaaatggcgcacgtctgccagcagaagctgaagctgaccctagctagctagcggtcatggaaatccttcgtcgtcgcctccgcgcgcgccgtgtctctcttgtcacgttcggcagcgaccagcgaccgcgccgccctgtcactgtgcaacgactcgatcgtctctctgggcaagtccttataaagttggcccgacgcgagagtgatacacatgccggcgacaacgacttactagctagttttatctagctcgttcgatcgcgtgcgtcnttccatttttttccanncccatccggggggtaagaaagggtgcctttcttcatccccaaattccccccccccccttggaaaaaaaaaaaacctcncntccggcggggggggggggaaacaaggccccnccgagaccgatggagggggtgcgggcaaggaccatcntccgggtcccgcccgtcncttatctgcgtgcctcgtctgcgcccccgccgcatcccccttcttccacccgaacgggatcacgaccagccgntggcgacttccacccaaaaccaaaatactactctttttactcgacaccgcctcctcancaatccactacccn

SEQ ID NO: 69605 - DNA, 650 bp, Zea mays
  misc_feature: Ceres CLONE 1548036
  misc_feature: Encodes the peptide sequence at SEQ ID NO. 69606
  misc_feature (255)..(255): n is a, c, t, g, unknown, or other
aagctggagctccccgcggtggcggccgctctagaactagtggatcccccgggctgcaggaattcgtctcacccctagaaaagtcttcccccgcgcggcggccgcgggagtgttcgtgttcctcacttctcccgcttgcgtccccgacactccctcagatccgcggccgtttcccgatccgaggggcattccagccctaaatagcggccggtgagcaggtctccttccgccggcgcggaccacctgagagccgtncttcctcctcgccttctcttgcggcgcggcgcggaggccggagtcgcttggaggcccagctgtgttcgggttgatttcttcatttgtcgtggttagaggcacctggtttgtttttttgctgaagctggtggtacatgtgaatagcagggcctggtctctgcctctgcttttgcttcgaagcaatggcgaatgcaagcaagcacttgcacccttcaagtcaggcagggcatgacaagaagtatagggcaccgctgggtgcttcccaagaaaaggcatttcccctaaagggggtaaacccgcatttggcctccaaacaaactgattttgggggggggtttaaaaaggccctgggggaacattttctgaaaaggggcctttgccctttagggaaacaa

SEQ ID NO: 69606 - protein, 71 aa, Zea mays
  misc_feature: Ceres CLONE 1548036
MANASKHLHPSSQAGHDKKYRAPLGASQEKAFPLKGVNPHLASKQTDFGGGFKKALGEHFLKRGLCPLGKQ

SEQ ID NO: 69607 - DNA, 651 bp, Zea mays
  misc_feature: Ceres CLONE 1548044
  misc_feature: Encodes the peptide sequence at SEQ ID NO. 69608
  misc_feature (651)..(651): n is a, c, t, g, unknown, or other
aaagctggagctccccgcggtggcggccgctctagaactagtggatcccccgggctgcaggaattcgtctcacccctagaaaaaagcaaaagctgctcatcaccgatggccacggctaacacaagcaagcaagcaagtcactgagtagctagcagtatataccaccataaaaacaacacacacacacgtgcgctaataagctaagcttaaggtagctcctctctatctccggctagctcggacggacgacgttgccatggctgctcaactgcatcacgcactatacgagctgctgcacgaagcagcagcagcgcaacgagcgctgctgctcgcgatccccttctccctgctgctcctgccgctcctgctccgctacctcgcggcgtcggcgtcggcgtcggcgtcggcgacaaagaacgacggagcggcggcggtggcggccagcgaccccgacaagctcttgagcctgctgccgtcgccgcccatgaagctccccatcatcgggcacctgcacctgatgggggacatcccctacgtgtccctcgccgcgctcgccaccaggtacggcccggacctgatgctgctccgcctcggcgccgtgccgaccgtggtggtctcgtcgccgcgcgtcgccgaggccgtgctccgcan

SEQ ID NO: 69608 - protein, 131 aa, Zea mays
  misc_feature: Ceres CLONE 1548044
  misc_feature: SWISSPROT Homolog: EC 1.14.13.68 4-hydroxyphenylacetaldehyde oxime monooxygenase
MAAQLHHALYELLHEAAAAQRALLLAIPFSLLLLPLLLRYLAASASASASATKNDGAAAVAASDPDKLLSLLPSPPMKLPIIGHLHLMGDIPYVSLAALATRYGPDLMLLRLGAVPTVVVSSPRVAEAVLR

SEQ ID NO: 69609 - DNA, 662 bp, Zea mays
  misc_feature: Ceres CLONE 1548045
aaaactggagctccccgcggtggcggccgctctagaactagtggatcccccgggctgcaggaattcgtctcacccctagaaaaaaagggatctcgctcttgcctccttaattcaccttcgccgattgccgccgtgggccgccgcgatggctgttgcggacgcctagtaccacctccgtcgtattctccggtgactccgccctcggcggtgtccgattgccctcttaactagtctgttccgttcccagtccacctcctctcgctcctctgcgacccccgaggaccaccagagcgggacgtcacggaactcgtcggccacgtcctggccgtctcgcatgctgacaaccaggctgttgccctcccgggcgtcctcggcgcggagctcgcaacatccctgtcagctcgctgcgcatctgatgcaccggcgtcgcaggctatatgaacagctcaagtaggtccggaacaaacgacctgcatggacctataatgcactccaaaggacaacgcccgatgttctttttcttcaccgcaactaatgaggcaagatttctcggcttctcgccagtcacgtcttacacagtagcggagtcgcggagatcatgcacaccaactcttgatgaaggataacagcgaggcccacgaccctttcgcttcggcataacg

SEQ ID NO: 69610 - DNA, 628 bp, Zea mays
  misc_feature: Ceres CLONE 1548051
  misc_feature: Encodes the peptide sequence at SEQ ID NO. 69611
  misc_feature (106)..(106): n is a, c, t, g, unknown, or other
  misc_feature (222)..(222): n is a, c, t, g, unknown, or other
aaagctggagctccccgcggtggcggccgctctagaactagtggatcccccgggctgcaggaattcgtctcacccctagaaaaaactcaccgtccgtccgtccatngagccatggcagcagcagcagcagcctgcatctgtctgcagctctctctccccagcaaccattcttcctctgcatgtcctccagcatacaagaagcgtgtcgcgctagccccaggnagaagaacccgtcttctctgccctggatctggggccctcttcttcttctttcgtgggtgttgaccagggacccgggaggaaggttttcctgaacccaaatttctttgctccaaaacgaccccccctttcggggcctccaaggggttccccccgggccaaaatttcaaaagggctccatggaaaaaggcggatttccgggggggttatcccccccccccggggtttttttgtggggggccccaaaaaggaaaccaagggggtgcccccgttttttttttttctgggggggggctttcccgggccggggggggaaaaaagggaaaaaaatttttcccgcgggggggggaaaaaaaacacaccccccccccacaaaaaaaaaatttccccccccccccttttttttttt

SEQ ID NO: 69611 - protein, 57 aa, Zea mays
  misc_feature: Ceres CLONE 1548051
MAAAAAACICLQLSLPSNHSSSACPPAYKKRVALAPGRRTRLLCPGSGALFFFFRGC

SEQ ID NO: 69612 - DNA, 628 bp, Zea mays
  misc_feature: Ceres CLONE 1548054
  misc_feature (365)..(365): n is a, c, t, g, unknown, or other
  misc_feature (397)..(397): n is a, c, t, g, unknown, or other
  misc_feature (398)..(398): n is a, c, t, g, unknown, or other
  misc_feature (408)..(408): n is a, c, t, g, unknown, or other
  misc_feature (409)..(409): n is a, c, t, g, unknown, or other
  misc_feature (412)..(412): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (428)..(428): n is a, c, t, g, unknown, or other
  misc_feature (432)..(432): n is a, c, t, g, unknown, or other
  misc_feature (438)..(438): n is a, c, t, g, unknown, or other
  misc_feature (440)..(440): n is a, c, t, g, unknown, or other
  misc_feature (441)..(441): n is a, c, t, g, unknown, or other
  misc_feature (473)..(473): n is a, c, t, g, unknown, or other
  misc_feature (475)..(475): n is a, c, t, g, unknown, or other
  misc_feature (488)..(488): n is a, c, t, g, unknown, or other
  misc_feature (490)..(490): n is a, c, t, g, unknown, or other
  misc_feature (498)..(498): n is a, c, t, g, unknown, or other
  misc_feature (523)..(523): n is a, c, t, g, unknown, or other
  misc_feature (538)..(538): n is a, c, t, g, unknown, or other
  misc_feature (539)..(539): n is a, c, t, g, unknown, or other
ggcggccgctctagaactagtggatcccccgggctgcaggaattcgtctcacccctagaaaaaatagccgccgctccgctttggctgtatcactcgttcctcttcagagcctccctttcgccggcggcgtacgaagagatggcatagcgtttggccattatcgccatcgtcagcgaggactagtgcaagcccaagaagtgccgccaggagtgcacgaagagctgccccggcgtcaagactgggaagctttgcattgaagtaacttcggcatcaaagactagctttcatttctgaggacctgggcatcgggtgtggtatctggggaaagaaatgtccatttgatgacattgaaatcatcaaccttncaaaagacttgcaaaaggatattctttaccgnnttgggcccannacncttaagttgnnnangntggntgtccnanngcctggtcccgttttgggccttggtggaacanangggattggaaagncnaaagctcntaaagtgttggctgtgaaactgaanctaacttggggccgnntttaaaaacccacctggattggcaggaaattcttagctacttctcgtgggtttgacccccagaacctacttcccacccctaattgaaaa

SEQ ID NO: 69613 - DNA, 645 bp, Zea mays
  misc_feature: Ceres CLONE 1548055
  misc_feature: Encodes the peptide sequence at SEQ ID NO. 69614
acccgcggtggcggccgctctagaactagtggatcccccgggctgcaggaattcgtctcacccctagaaaaaacttatttcccctcccaccgcggccaggcctcagtcctctctgttgcggagccgccgcaacccagcgtcccccgaagtctaaccctagatccggaccggccatggcgtcccgccgggtcgtctcctcgctcctccgctccgcgtcccgcctgcgggccgcctcgcccgctgcgccacgcccgcgcgcgccaccgcaccgcccgtacccggccgggtacctcttcaaccgcgctgccgcctacgcctcttccgccgcggcccatgcggcacctgccaccccgccgccggccaccgggaagaccgggggcggcaagatcaccgacgagttcaccggcgctggcgccatcggccaggtgtgccaggtgatcggcgccgtcgttgacgtgagcttcaatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctg

SEQ ID NO: 69614 - protein, 157 aa, Zea mays
  misc_feature: Ceres CLONE 1548055
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRAPPHRPYPAGYLFNRAAAYASSAAAHAAPATPPPATGKTGGGKITDEFTGAGAIGQVCQVIGAVVDVSFNEGLPPILTALEVLDNNIRLVLEVAQHLGENMVRTIAMDGTEGLVRGQRVLNTGSPITVP

SEQ ID NO: 69615 - DNA, 643 bp, Zea mays
  misc_feature: Ceres CLONE 1548064
  misc_feature: Encodes the peptide sequence at SEQ ID NO. 69616
aaagctggagctccccgcggtggcggccgctctagaactagtggatcccccgggctgcaggaattcgtctcacccctagaaaaaaacggctccactcctaacactggctgagctcagcccacacttggcctggcctcgttctgctgaagctcgacccgttccccctaatcttctccaatccctttcttctgggctctgacagggtgacgaatcccatgggcgccgcggcgaggaagcccgccgccgctggggtgttgccaatctggctctgcctcgtctgcgcgtcgagagcgcagccgtacatcggcgtcaactacggcgaggtggcggacaacctgccgtcggcggacgagacggcgaggctgctcaggtcgacgtccatctccaaggtgcggctgtacggcgtggacgcggggctgatccgcgcgctggcggggtccggcatctccgtggtggtgggcgtggcgaacggcgacatcccgtcgctggccgcggacccggcggccgcgtcccggtggctggccgccaacgtgctgcccttcgtcccggcgaccaccatctccgccgtggccgtcggcaacgaggtgctggagtccggggacgccaccctgggcgccgcgctgctcccggcatgcagaaactc

SEQ ID NO: 69616 - protein, 142 aa, Zea mays
  misc_feature: Ceres CLONE 1548064
  misc_feature: SWISSPROT Homolog: EC 3.2.1.39 Glucan endo-1,3-beta-D-glucosidase
MGAAARKPAAAGVLPIWLCLVCASRAQPYIGVNYGEVADNLPSADETARLLRSTSISKVRLYGVDAGLIRALAGSGISVVVGVANGDIPSLAADPAAASRWLAANVLPFVPATTISAVAVGNEVLESGDATLGAALLPACRN

SEQ ID NO: 69617 - DNA, 816 bp, Zea mays
  misc_feature: Ceres CLONE 1548069
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (38)..(38): n is a, c, t, g, unknown, or other
  misc_feature (39)..(39): n is a, c, t, g, unknown, or other
ttttttnnngttnnnnnngtnnnggtggggttggaggnncccattacctggtataactggagctccccgcggtggcggccgctctagactactggatcccccgggctgcaggaatgtcgtctcacccctagaaaaaagaattccccaatcccaccgccaggctccgcacgcgcctcggaacctagcccagtcgactccttcagatccggcgggatcgccggctcctaccctcgtcgccacgttccggcatctcggctcccaggcgtcctctacccgacttctacacctgccatcttccccatgcggtgtcccgacgaatcgcttggtcgacaggccacctctcctccaagccagtatcgacgactcgaaggattcgtgtcgtcgtccatcgccgaaaagccgacgccggtcccccggtcgcctcttcccaaatcgaagttggttctgcggaataactctgggttgcaggtccccggtattttcgtcctgacaatttggaaaaaaaatccgggcccctatcctctgcgcataaaaaaaggccctttatactataccgcgtaaccagggataacgtttaccccgccactacctccgaggcggggtcggagtaattcaccaattatcgagcagtggaaccacgggaactcttgtttccccactgtaaccgtaaagcgcccgccgaggcgtccccacaatgggttgcgaagctccgcccctctataaatgtgaattccgaatttaccctcgcgcgcccacctggtcgcgcccagcattagaaaaaggatctgtgtaaagggggatacaaacaccaacagt

SEQ ID NO: 69618 - DNA, 762 bp, Zea mays
  misc_feature: Ceres CLONE 1548072
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (461)..(461): n is a, c, t, g, unknown, or other
tgtcaggccctccccctannnattnnnnnngggnnnaaaaaatnnnnnnnnaatttatttactccccgccgtggcggccgctctaaaacagtggatcccccgggctgcaggaatgcgtctccccctagaaaacagtgacaattgcttgtgggctgacctggcagccatcttattgtagttttgtatgtataccacaccgagaggtgactcccgcagtggatgtgtgaaatagtcccttgaacgtacgtgggtatctagcaatattacggcagtgaatttatagggtggattgcgagaccgaaaaatgaaggtaaattcttaagagattccaagatttatatccggtgcgaacccagaagaacaaaacccccctattttttttttatataaataacttattaaaggcaaacaaaaaattttttttttcccccccccctaaagagaggggggagggggggccncccccttctttttccccctccccccccccccccccgggtcgttaactaaaaaaatattacccaacccactactatagcgcggggggggacgtctctccccaccttcttctcaaaaactcccccaccctaaagtacacaaaaccgggctagaaaggcatcgccgactctcgcgacgagaggaagacaatacacaccccatttcatcccacccaggttgttcaggacaacattcccacccgccacgcccccctcgtgttcactcccgccaacaataaactatcccttctctgacagcctccac

SEQ ID NO: 69619 - DNA, 656 bp, Zea mays
  misc_feature: Ceres CLONE 1548081
  misc_feature: Encodes the peptide sequence at SEQ ID NO. 69620
  misc_feature (656)..(656): n is a, c, t, g, unknown, or other
acccgcggtggcggccgctctagaactagtggatcccccgggctgcaggaattcgtctcacccctagaaaaaatcccaaggcataatttagctactacccctacccccgcgcattggttccgttccatcccaagctaacacaggcatcgtatatatggcgggcgacgacggggcggacgcgtcggagcggctggagagcatcctgacggcggaggcggcggcgtcgccgtgggccgcggccgccatcgagctgcggctgctgacgcggctggcggcgcccgcggtggtgatgtacatgatcaactacctcatgtccatgtccacgcagatcttctcgggccacctcggcaacctggagctcgccgccgcgtcgctcggcaacgccggcgtccagatgttcgcctacggcctaatgctgggcatgggcagcgcggtggagacactgtgcgggcaggcctacggcgcccacaagtacgagatgctgggcatctacctgcagcgctcggccgtgcttctgtgcgtcacgggcgttccgctggccgtcatctacgccttctcggagccaatcctggtgttcctgggtcagtcgccggagatcgcccgcgccgcgtccgtcttcgtgtacggcctcatcccgcagatcttcgcgtacgccn

SEQ ID NO: 69620 - protein, 167 aa, Zea mays
  misc_feature: Ceres CLONE 1548081
  misc_feature (42)..(167): Pfam Name: MatE Pfam Description: MatE
MAGDDGADASERLESILTAEAAASPWAAAAIELRLLTRLAAPAVVMYMINYLMSMSTQIFSGHLGNLELAAASLGNAGVQMFAYGLMLGMGSAVETLCGQAYGAHKYEMLGIYLQRSAVLLCVTGVPLAVIYAFSEPILVFLGQSPEIARAASVFVYGLIPQIFAYA

SEQ ID NO: 69621 - DNA, 714 bp, Zea mays
  misc_feature: Ceres CLONE 1548088
  misc_feature: Encodes the peptide sequence at SEQ ID NO. 69622
  misc_feature (206)..(206): n is a, c, t, g, unknown, or other
  misc_feature (601)..(601): n is a, c, t, g, unknown, or other
  misc_feature (603)..(603): n is a, c, t, g, unknown, or other
  misc_feature (650)..(650): n is a, c, t, g, unknown, or other
tggagctccccgcggtggcggccgctctataatagtggatcccccgggctgcaggaattcgtctcacccctagaaaaaggatgcgatcataccagcactaaagcaccggatcccatcagaactccgaagttaagcgtgcttgggcgagagtagtactaggatgggtgaccctctgggaagtcccctgttgcttccttttaaaaaanaaaaggaaaaaaaaaaaaaaacgaaacccccggggtccccatttccccctaaaggggaggcatattcccggggctccgggggcctttttttaaaacggtgggggggggaaaaccccggggtacccaatttttagcgtgggggaaaaaccccctttttcccccggggggggaaaaaaaaaaaaagaccccctaattccccccccccaaaaattgtccccccccgtggggggggggaaagaaaataccccccttttttttttttttaccccccccccctttttttttttttaccccccccttttttttttaattggggggggggggaggggcccctctttttttttttaaaaaaaaaaaaaaaaggagggtgggggggtgttttcttttaaaaattncnccttcttttttataaattataccccccccccccgggaaagaaaaaanggaggggggggggggggggggggcccccccccccctcttttttttttttgtttggtggggagag

SEQ ID NO: 69622 - protein, 59 aa, Zea mays
  misc_feature: Ceres CLONE 1548088
  misc_feature (16)..(16): Xaa is any aa, unknown, or other
MGDPLGSPLLLPFKKXKEKKKKTKPPGSPFPPKGEAYSRGSGGLFLKRWGGENPGVPNF

SEQ ID NO: 69623 - DNA, 804 bp, Zea mays
  misc_feature: Ceres CLONE 1548092
  misc_feature: Encodes the peptide sequence at SEQ ID NO. 69624
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (32)..(32): n is a, c, t, g, unknown, or other
  misc_feature (33)..(33): n is a, c, t, g, unknown, or other
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (712)..(712): n is a, c, t, g, unknown, or other
nnnnnnnnnaaaaaaggaaaaaaaaatccccnntcnntttttttnnnnnagaataatgagactccccgcggtggcggccgctctagactagtggatcccccgggctgcaggaattcgtctcacccctagaaaaaaaaaaaaaaaaaaaaaaaaaaaaaaaaaggatttggaatctaccttttcttttgctttttcccttataaaaataactcaatcaaaatccaattatctactctacaagaatgaaatgcttgttatgcctaatatacttagtttaacctgtatctgttttaattctgttctttgtccgactagctttttcttcgccaaattacccgaagcttatgccattttcaacccaatcgagaatgttatgcctgtcatacctgtaatcttatttctaaaaaccgttgtttggtaagctgctgtaagtgtggggaggaaacctttacaattctgcctgccaaattgaatggaaggatccctgcccaaaaaaaaaaaaaaaaaaaagacgcctcgaaggaaacccaaatatgccctaaaagaaaaaccaaattaaagacgttttaagaggagccggcggatttacaaacgggggagagggggggaaaaagccttgtacgttaacaccaaaaaaaagtaataataaaaaaaaaaaccgaaccattttacacaaccgagagcgtgaaagacaaaaaaaaggcgtacaaanttgagaaacaacctataccaaataaattcggaaccacacgcaaaagagagaaaaacgggaaacaaagtcaacacaacggaagaccataattg

SEQ ID NO: 69624 - protein, 57 aa, Zea mays
  misc_feature: Ceres CLONE 1548092
  misc_feature (23)..(58): Pfam Name: PsbK Pfam Description: Photosystem II 4 kDa reaction centre component
MLVMPNILSLTCICFNSVLCPTSFFFAKLPEAYAIFNPIENVMPVIPVILFLKTVVW

SEQ ID NO: 69625 - DNA, 892 bp, Zea mays
  misc_feature: Ceres CLONE 1548093
  misc_feature (1)..(1): n is a, c, t, g, unknown, or other
  misc_feature (28)..(28): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
ntttttttttttattgtttttttccacnccannnaaagaaannnnaaaatactggagctccccgcggtggcggccgctctagaactagtggatcccccgggctgcaggaattcgtctcacccctagaaaaacagtccccggccctccgtcccctcctcctgcgaaggctcctccagcaccactagctagagctaaccccgtgctgctgctgctgctactacctgctgccgcgcgccgtttgttgccgtgcgggcgtgttgtggtccgctgatctcgttcgcgggacgccggggggtggtggtggtggcaccgctgttggtggtgcccggcgttaaccaaaaaaaaaaaaaaaaacgaaaacctcgagggaccccctttccctcctataggcgaggcgtatttacgcggggcttttttgccccccccttttgggggggaggggggggcggggaaaatcctttgctttttacccccccccaagttcttctgttgaggtccatcctccccctttttcctccctcctgtgtttttattaagccaaaacaagtcccccgccctcctgtatctcgcccctttcccccacccggttttcccccaattctcgctaaatgcgcccccactcgcaccatatccttcagagctgcctcaaataacttcccggggcaaaaacataaacagccgcggcaccaccatttttgtgtgtaatctaacacgccctatgtatactttaataacaaccggctcgcgcccggaaagagccgcggcgcgacacccccgtcgtcctgtgtatcgccacgcgacgaaagtgcgctgcgttgaaatattgcgcaccaaagagacacgacgctacccacccttgtggcctacgagggctgagctgcgttattggtat

SEQ ID NO: 69626 - DNA, 747 bp, Zea mays
  misc_feature: Ceres CLONE 1548105
  misc_feature: Encodes the peptide sequence at SEQ ID NO. 69627
  misc_feature (9)..(9): n is a, c, t, g, unknown, or other
  misc_feature (12)..(12): n is a, c, t, g, unknown, or other
  misc_feature (19)..(19): n is a, c, t, g, unknown, or other
  misc_feature (35)..(35): n is a, c, t, g, unknown, or other
  misc_feature (37)..(37): n is a, c, t, g, unknown, or other
  misc_feature (38)..(38): n is a, c, t, g, unknown, or other
  misc_feature (40)..(40): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttttttnttnggcggtnaccacccactttagtntnntnttagaaannnnaaaaaagctgggactcaccgcggtggcggccgctctataatagtggatcccccgggctgcaggaattcgtctcacccctagaaaaaatgcagcagcaggccagcggcacgccacccgcctcactcccgcctccgatccgctgcttactcgccacccggagatggccaccgccgccgccttctccgtctcctcgccggcggcctccgccgtcgccgcgcgatccaaggtgtttggaggagttaaccaggcgagaactagaactggctgccgcgtcggcatcacgcggaagaactttggccgtgtcatgatggcccttgcagtggatgtttctcgttttgaaggagtgccaatggctcctccagacccaattcttgggggtgctgagggctttaaagcagataaaagcgagctgaaccccaatcttggtgttggtggctataggacagaaaagctgcagcccctcgtgctcaatgtagtcaagaaggctgaaaatcctaaggtgaacaaaaaaaaaaaaaaacgagaacgcttcgaggtaccccaatttcgcccctaaaaggggggccataattaacccgacgcatcccttgggcccggcggtttataacaacgttcaaggaactgggggaaaaaccccctggcacgattacccacaaactaaaatcccccttttgcgacgacactatcccccccctt

SEQ ID NO: 69627 - protein, 131 aa, Zea mays
  misc_feature: Ceres CLONE 1548105
  misc_feature: SWISSPROT Homolog: EC 2.6.1.1 Aspartate transaminase
MATAAAFSVSSPAASAVAARSKVFGGVNQARTRTGCRVGITRKNFGRVMMALAVDVSRFEGVPMAPPDPILGGAEGFKADKSELNPNLGVGGYRTEKLQPLVLNVVKKAENPKVNKKKKKRERFEVPQFRP

SEQ ID NO: 69628 - DNA, 848 bp, Zea mays
  misc_feature: Ceres CLONE 1548107
cacaggacgtccacacacgctatacaccaaattaacgaccccccacccccgacaaaactggactccccgcggcggcggccgctatacaaaagtggatcccccgggctgcattatccgtctcacccctagaaaaagtagtcgctgtcacgctcttgcctcgctcctttccggctacattacgtaacggatcggacggtgatgatccatccatggagctgtgagctgagctgagctgagctcaccaccaccgcacacgggagcaatctattagctagcatagccagccagccaagtaaccgcactaagcagaagctacccagccatgcctcgccgtctattttgttataaaaagacaaccgctcgcgacctcggttgattccctcccgccgcgggccataatccagggcagcttctggttttcttggtggaaggggccccccccccgggaaccgggattttaaaccacttttttgcgttccatcccccccccccccaaatttttttctggaaaccccccggcggtaggtcataatagaaccccccccccctcccccccccaaataatagcccctcgcaacactctccccccttctcttaaaggagggatgaggaaaactaactcacccatattacgctgcactttttggcagtccccaccccacgctttctatccacgctacttatataacctttcgggaccactggagcggaaaatagccacgaaatctcttctactcccgcgaacccgtaataaaacccagggtggccacgggtgtacgccaccccgcgggtttacgggtgcctgacgaccaggagccgctcgactacaaaccgcaactctatagagg

SEQ ID NO: 69629 - DNA, 680 bp, Zea mays
  misc_feature: Ceres CLONE 1548116
  misc_feature: Encodes the peptide sequence at SEQ ID NO. 69630
ctccccgcggtggcggccgctctattactagtggatcccccgggctgcaggaattcgtctcacccctagaaaaaacacccacacccacccacacaaccgcacctcgcacccattgaccagacggcggcgctcatctcctcccccacggttctccccatcggcctgctggcttctccccggcgtccccgatactgatcctcatcactcatgtctgctgaagttgctggaggacacccttatttcctctcgtgctacttctggttcatatactgcataaaattccgagattttacttgatacaagtggaacactcagagttttgtgcgaatacttcctaccatgtgattcagttgtagctggtgaatttggcaagactcaatttctctcatctgagttcagaaacccttgcttggtctcctgcttcccttgagtcttgccaaccatagttttctctcatctctttctgtgacttgaccaacatctcttttggtcctgtcagtctcgcaatactcccttccaaagacttgtctagaggttggattgccctgctctctgctggcgctgcagcttgctgaagtctttacttgctgcattctgtgctcacacttttgaaagctgctctcttctgctctgcgttgttgatttctgcactcaagcttctcttgcctgtgcactcaagc

SEQ ID NO: 69630 - protein, 29 aa, Zea mays
  misc_feature: Ceres CLONE 1548116
MSAEVAGGHPYFLSCYFWFIYCIKFRDFT

SEQ ID NO: 69631 - DNA, 721 bp, Zea mays
  misc_feature: Ceres CLONE 1548120
  misc_feature: Encodes the peptide sequence at SEQ ID NO. 69632
gcggtggcggccgctctttcaatagtggatcccccgggctgcaggttttcgtctcacccctagaaaaaacgcgacaatccccttttcctctcccccagatctacccgccgcgccacccctctcggctcctccacagcggcgacagatctttcctcgacgtcctccgtttctctccagcgtaaatatgggttctaaatcggaagataaggtgctcgatgccgccgccagagatccattagctctgatcaccgacaggacaggcacaacatgcagttttccgccacctccgacgaagaaccaacgacttataggcctgcagagatgccaccagcgagccctttgttaaaggagttgagggaggtgcatcatgcgggcaaagtatgggggtgcaatatcccccccccatcagctccgcgaactatctcgtagggagaagttccataatgatcacttttattttgggattggcagaagtaggaattagaccctggggaagcataattaaatttaaaaaaccaacatgtcattttttacaggacaaacacaccccctttcgaatcaaaaaacatggaaaattccgccaaagagggaaccgcgctccctctattttgaaacacccatgtgggctttcaaactgtgtttactcaactggacttggagagggggaaaatttttcaaaaaagtaaaaacgcgccattttcttaactatgatgaacacgcg

SEQ ID NO: 69632 - protein, 53 aa, Zea mays
  misc_feature: Ceres CLONE 1548120
MGSKSEDKVLDAAARDPLALITDRTGTTCSFPPPPTKNQRLIGLQRCHQRALC

SEQ ID NO: 69633 - DNA, 701 bp, Zea mays
  misc_feature: Ceres CLONE 1548121
  misc_feature: Encodes the peptide sequence at SEQ ID NO. 69634
  misc_feature (701)..(701): n is a, c, t, g, unknown, or other
tgggggcccgcttttccaactagtggatcccccggggctggaggtttttcgttttacccccagaaaaaaaaaaagaaccccacaaatttttattctagcccttcccggttccaggggtttttcttcggggggggcaatgtttctccccccgaacccgggggggggcgggcccggcaccggcaccggcaacaattggttcttcgactgcggcatcttcgacaacctcccggccgcggcctgcggggccttcccgtgggacgcgtccccgtcttcttccaaccccagtgtggaagtgggcagctatgtgaacaccaatgatgttttcaaggagcccaatgatgtcttcaaggagcctggcagcaataagcgtttgaggtcaggatccaatgatgccccccccccaacatctaaagcttctagggaaaaaaaaaaaaaaaaacgagacgcttcgaggtacccatttccccctatagggaggtcaattacccgcgctcccgggccgttcgtttaacaagtcgtgaattggaaaaaaccctgggggttacccaatctaatcccctttggcagcaaattcccccttttccgccaggttggggataaatacgagaaaagggcccgacaccgaattgcccttttcccacaaagttttgctcaacccctgaatggggccaaagggaaaaatttgtataaacgcttaaatn

SEQ ID NO: 69634 - protein, 124 aa, Zea mays
  misc_feature: Ceres CLONE 1548121
MFLPPNPGGGGPGTGTGNNWFFDCGIFDNLPAAACGAFPWDASPSSSNPSVEVGSYVNTNDVFKEPNDVFKEPGSNKRLRSGSNDAPPPTSKASREKKKKKRDASRYPFPPIGRSITRAPGPFV

SEQ ID NO: 69635 - DNA, 717 bp, Zea mays
  misc_feature: Ceres CLONE 1548124
  misc_feature: SWISSPROT Homolog: EC 3.2.1.23 Beta-galactosidase
acaaaacaattataataaggaggaagccaacatgtatgattacccccccctactactaaaatggatctccccgcggtggcggccgctctttactagtggatcccccgggctgcaggaattcgtctcacccctagaaaaactcgcagcgccggcgcgccatctcggtacgaaggcgcacggcggcgctccacgatcggccatctcacccacgacctctgaggcttcccatcccgacccccgccagtcgcctcgcgccctcgactccggactccggtcctccgcacaccggccggtgaccctgcgcttgaacctgctatagaaatttatacaaatggccgcggttgatgcgacacccaaggagatggatgcacctgcctgttggacccaaatgatgaaacaaaacacactctgattaaagaagacaaagctgcaaacaccaatcattctgttgctgcacctcagtccttgctaccacaccacgacgatgatgatgaaccacaagctgatggtccatctccagatggaccagcagctgtaaagaacacaaaaaaaaaaaaaaacgagacgctcgaggtacccaattcgccctatagtgagtcgtattacgcgcgctcactggccgtcgttttacaacgtcgtgactggcaaaaccctggcgttacccaacttaatcgccttgcagcacatccccctttcgccagctggcgtaataacgaa

SEQ ID NO: 69636 - DNA, 786 bp, Zea mays
  misc_feature: Ceres CLONE 1548127
  misc_feature: SWISSPROT Homolog: EC 1.3.3.4 Protoporphyrinogen oxidase
  misc_feature (5)..(5): n is a, c, t, g, unknown, or other
  misc_feature (12)..(12): n is a, c, t, g, unknown, or other
  misc_feature (13)..(13): n is a, c, t, g, unknown, or other
  misc_feature (18)..(18): n is a, c, t, g, unknown, or other
  misc_feature (20)..(20): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (481)..(481): n is a, c, t, g, unknown, or other
  misc_feature (786)..(786): n is a, c, t, g, unknown, or other
tttgngtttttnnaaatntnttttggttnttcnncnccccttnnnnnnnntaagctgggactcaccgcggtggcggccgctctagactagtggatcccccgggctgcaggaattcgtctcacccctagaaaatctgaaacaacttgtgacctctgaccttaaaaaactcttgggcgtagaggggcaaccaacttttgtcaagcatgtatactggggaaatgcttttcctttgtatggccatgattatagttctgtattggaagctatagaaaagatggagaaaaaccttccagggttcttctacgcaggaaataacaaggatgggcttgctgttggaagtgttatagcttcaggaagcaaggctgctgaccttgcaatctcatatcttgaatctcacaccaagcataataattcacattgaaaacgtctgacctatcctctagcagttgtcgacaaaattcccccacctcatgtacagtanaaaaccgaagcgttgcagtctcagaacatctttccttcaaatattaacccttccgttggaccatccaccagaaaaggtagtccccttgtggaaagcccgaaaaatgaaggttaaaaaactatttatgggtgggcccgaaaaaataaaaaaaaaaaaccaaaaccgcctccagggtaccccaatttcccccccctttaatggagagcccgaaattaacgcccgccccttcccctggggccgctcccttttttaacaaacacagtcctgggaacgggggagaaaaaaaccccctgggggcgtttttn

SEQ ID NO: 69637 - DNA, 693 bp, Zea mays
  misc_feature: Ceres CLONE 1548128
  misc_feature: Encodes the peptide sequence at SEQ ID NO. 69638
  misc_feature (673)..(673): n is a, c, t, g, unknown, or other
aaactggagctccccgcggtggcggccgctctagaactagtggatcccccgggctgcaggaatttttctcacccctagaaaaactgtaggggaggtcctgcggcaaaatagctcgatgccagaagtccagcccacgggagggcgactagggttaggggcgaccggaggtccccgcgcctgcccaaatccacccatcccttccgttcaagccgccggagctcccaggccgctggtgtcgaagccgtcgtcccttccttccaggcccgcctcctctctgtccgttctgtcttggtcgacgaagctcaagaccacagtgtcaggaagctctccaatcttccagccaaacacaattcatcagtcagatacacttttaccaaggaatttttcagaatcactccacgagaggttcagctctcgaagctagagaaccagagctctaccaaacaggccaggacgtctctcaaatccccagttcagtaactggctaactgtaggagaaggagagagatggagaacggcggcgctaaacgcgacgtccccgacgatgcgaacgagcattgccctggaacacagtctgaggaggcaggcaaggcagatgcctgcgctgggtgccccaaccagcagatttgcgccaccgcccccaaggggcctgatcccgatgtggttgctattngtgagaggttggctactgtg

SEQ ID NO: 69638 - protein, 62 aa, Zea mays
  misc_feature: Ceres CLONE 1548128
  misc_feature (56)..(56): Xaa is any aa, unknown, or other
MENGGAKRDVPDDANEHCPGTQSEEAGKADACAGCPNQQICATAPKGPDPDVVAIXERLATV

SEQ ID NO: 69639 - DNA, 1878 bp, Zea mays
  misc_feature: Ceres CLONE 1548129
  misc_feature: Encodes the peptide sequence at SEQ ID NO. 69640
actccaccagcaggtctgcttgcttgtgtttggtggatctgaatcaccactcactcccacctgctcgccatctccccttctctctctccctgctgccgtgcggctccagctccagctgcaggcgcgggagaggggccgcatcgacctccccaatccccatggccgctaccaagatccttgacaggctcaaggtgggggcttcacctccagcgcccggcggcgcgctcccgctcaccttcttcgacgtgccgtggctcttcacgggccccgtggagcgcgtcttcttctacccctacgcgcacacggcggaccacttcgccgcccacctcctgccgtccctcgtctcctccctctccgccacgctgcgcgcgttctacccgctgctcggccgcgtccgcccgtgcccggacggcggcggcgggtacgaattcttctgctccgacggcggcgaggccgtcgagctcatcgtcgccgagagctccgacgacttcgacgagctctccgccggcgggccgagggacgtcgcccggctctacgcgctggtgccgcggctcccgtcgcccggggccgacggctccttcgccctcgcggcggcgcaggtcaccgtgttccccgcccgcggggtcgccgtcggcgtgtccatccaccacgtggcctgcgacgactccagctacacgcacttcatcaggacctgggccgcccagtgccgcgtggctagcggcggcgcggacgcggtgccgccgccgcctttcctggaccgtggcgtggtcgccgaccccgagggcctcgccggcaggacgctcgacgaaatgcgccagctggcaggcaacggcccgcctccgcctccgccgccggcggcaggcccacagccgaagcttgtcatcgcgtcgttcgcgctcacccgcgaccgcatcgacgcgctgaagcggcgcgtggccgccaaggtcgcggcggacggcggcggcacgggccgcgtccactgctcggcgttcacggtggcgtgcgcgctggcgtgggcctgcctggcgcgcgtgggcggcggggagcggccccgcgcgcacctgctgttctcggtggagtgccggcgccgcctggcgccgccgatcccgcaggagtacctgggcaactgcctccggccgtgcttcgtggaggtgggcacgggcgagctgctgggcggcgacggcgtggcggctgcggccgcggcgatcggcgcggccgtcgcggcgctcgacggcggcgtgctggatggggcaggcgggtggttccacaagatcctgtcgctggtcccggagcgcccgatgtcggtgggcgggtccccgcggtacggtgtgtacgagactgacttcgggttgggccggccggccaaggtggagctggtgtccatcgacaagacgcccggcacggtgtccctggcggaggcccgcgacgccggggtggaggtcggcgtcgtggtgcaggaggccgagatggcgcgcttcggctcctgcttcgccgatgcactggaggtgctctgtgacagtgtgactgaactgaactgagcggcatcgacgatggcacctccattttcgagaagctggtcatcagctcgcgattacatgtaatggagctcgcgaaattacactacatgaagtggtgtttaaggagtagtataataagaaaatatagggataagagagatgatccgaagtgtatatttgagggagggatgggtatattttcatatttgcgtggagtaatctcgtatgcgagaatatcaattgtgtgattgataaaaaagaagggttcattgattcgtgccattatagtttttgaagttatgagatttgttattataattatctattttgaaatttggcattacaaaaaaaaaaaaaaaaa

SEQ ID NO: 69640 - protein, 459 aa, Zea mays
  misc_feature: Ceres CLONE 1548129
  misc_feature (2)..(447): Pfam Name: Transferase Pfam Description: Transferase family
  misc_feature (5)..(221): SWISSPROT Homolog: EC 2.3.1.153 Anthocyanin 5-aromatic acyltransferase
  misc_feature (275)..(323): SWISSPROT Homolog: EC 2.3.1.167 10-deacetylbaccatin III 10-O-acetyltransferase
MAATKILDRLKVGASPPAPGGALPLTFFDVPWLFTGPVERVFFYPYAHTADHFAAHLLPSLVSSLSATLRAFYPLLGRVRPCPDGGGGYEFFCSDGGEAVELIVAESSDDFDELSAGGPRDVARLYALVPRLPSPGADGSFALAAAQVTVFPARGVAVGVSIHHVACDDSSYTHFIRTWAAQCRVASGGADAVPPPPFLDRGVVADPEGLAGRTLDEMRQLAGNGPPPPPPPAAGPQPKLVIASFALTRDRIDALKRRVAAKVAADGGGTGRVHCSAFTVACALAWACLARVGGGERPRAHLLFSVECRRRLAPPIPQEYLGNCLRPCFVEVGTGELLGGDGVAAAAAAIGAAVAALDGGVLDGAGGWFHKILSLVPERPMSVGGSPRYGVYETDFGLGRPAKVELVSIDKTPGTVSLAEARDAGVEVGVVVQEAEMARFGSCFADALEVLCDSVTELN

SEQ ID NO: 69641 - DNA, 804 bp, Zea mays
  misc_feature: Ceres CLONE 1548133-R
cgaattgggtacctcgagcgtctcgtttttttttttttttttgaagaaaaaaataaagttttgacaactttttttcccggaacatctcctataactccccctataagaactgggggaaatatacttccaggcagaggggtcagtagcaaataactcctatttcagtgtcggaaggatgccaatcttcttgatgacttggaacctgaccttgatgtgatcagcgcatcagcaaatttttggatctcaacctcctcgggtatggccttgctactttcaaggccaatgctgggaccaaaggcatttaccttttcctctctaaaaaatacactcttgaccacaaaagggtcacttctttcacctacaatttctgggccaaaaggactaaattttgccctgtccaaaaaaaaatgtgtaccaaagccttgatcaccatgccgtcaactatcaggaatgtttggttctgccttgaacaaaaaatagctttcatgtgaatcccttccagggaagccatcgaaggaacaacttgaaataaaccctctcctctccaaagtaaaaatttcacggttctctttcccttttcccagcaccagtttccaaagcttaaagaaaaacttcttctttttggggtttttattaatatgctttgtcatggaaccaatttcatttgacacatcatccggttcacctgaacaaaccccggggagaaagagcactctgaaaccgaattccaacttgccccaaagggaattggtcctccgccacccacttttgggcattttccatttttcagcttgtttgggccct

SEQ ID NO: 69642 - DNA, 746 bp, Zea mays
  misc_feature: Ceres CLONE 1548137
  misc_feature: Encodes the peptide sequence at SEQ ID NO. 69643
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
ttttnnnnnnnnnggggtgggcgttctttcgtcccccnnnntttaannnnntataagtggagtccccgcggtggcggccgctctataactagtggatcccccgggctgcaggaattcgtctcacccctagaaaaaacgcacctagggttttcgcgccgccgccgcagccgcaacaatgccgtcgcacaagaccttccggatcaagaagaagctggcgaagaagatgcgccagaaccgccccatcccctactggatccgcatgcgcactgacaataccatcaggtacaacgccaagcgcaggcactggcgccgcaccaagctcggcttctgagcgtcgggattggccggctgctgcgtcggaaggctagggtctaatagctatcttctgtttaatcattgtctctgcttctgttttctgccccgcgatgctgggggggggggagccacattctgatgaatggtgacgttaagagaaaattaggagtactgtgttggcaccccaagaattccttgccacattgctacgctaaggaaacgaacccctatatcttatctatatatgcaagcgctgcacggatctgagggccccaaaacaaaaaaaaaacctactacccttcaaggtgaccccattccgcccccacggggggaggcgaaataaaccctccgccacaaaagggcctgtggttttaataaaggattgaggaagtggggaaaaatcctctggcggttatccctccaccttacat

SEQ ID NO: 69643 - protein, 51 aa, Zea mays; identical to SEQ ID NO: 2355
  misc_feature: Ceres CLONE 1548137
  misc_feature (9)..(51): Pfam Name: Ribosomal_L39 Pfam Description: Ribosomal L39 protein

SEQ ID NO: 69644 - DNA, 671 bp, Zea mays
  misc_feature: Ceres CLONE 1548142
  misc_feature: Encodes the peptide sequence at SEQ ID NO. 69645
  misc_feature (158)..(158): n is a, c, t, g, unknown, or other
gtggatcccccgggctgcaggaattcctctcacccctagaaaaagtcttctctccgcctcgcgcacccggttccgcgtgcctttccccacctactctcgcggctctcgccagccagtctagggtttcggtcccggcgtgcttatccgcccccgccggncatgtcgaaacaaggagggaaggccaagccgctgaaggcgcccaaggccgacaagaaggagtacgacgagacggatcttgcatatctgcttaacaagaaagatgaggaaaaagctcttgaaggagcttaaggccaaggcacagaaaggcgcgattgggggctcttttctcacccccaaaaaaggggggagagggtctacttacccaattctcccctaacccagtcgtattaaccgcgctcactggccgtctttttacaaggccgggactgagaaaaaccctgggcgttaccaactttatcccgcttggaaaaacatccccccttttccccatttgcgttattagccaaaaaggccccggaaccaatccccccttccccgcaatttgtcccatcccggattggtccaatgccactttcgatcccgtataatttttgggtacaaaattcccctcacaattcttgggtaaatacaagtctcactttttttaaacccatatagtccctaaattatgc

SEQ ID NO: 69645 - protein, 42 aa, Zea mays
  misc_feature: Ceres CLONE 1548142
  misc_feature (1)..(43): Pfam Name: TMA7 Pfam Description: Translation machinery associated TMA7
MSKQGGKAKPLKAPKADKKEYDETDLAYLLNKKDEEKALEGA

SEQ ID NO: 69646 - DNA, 728 bp, Zea mays
  misc_feature: Ceres CLONE 1548144
  misc_feature (728)..(728): n is a, c, t, g, unknown, or other
tggcggccgctctagaactagtggatcccccgggctgcaggaattcgtctcacccctagaaaaaccagggctacccgggcggcaagttcttcgacccgctcggcctcgccggcaccgtcaaggacggcgtctacgtccccgacgtcgagaagctcgagcggcttaagctggccgagatcaagcacgcccgcatcgccatgcttgccatgctcgttttctacttcgaggccggacagggcaagacgccgctcggcgcgcttggcctatgatctgcatgctgccggccacgacgtgtgtcgtgtcatcggtcatcctgtgtgcttgtgctcatcgatcgatcgaatccccgaacctagttctcgatgcgattgcaacgtcttggtaccgctgcctcccacccaaccccttgcaccaaatggggggggtttttttcttcctccttcctcccggggaaggtcccaccctaagggtataagcaatcctgggccctggaaccccatttaagggccaaaatgaagggaacccaaggggaatttttccttaacatttactccccccaaaaaaaaaaaaaaaaaaccgaaaaccctcccgagggtaccccaatttcccccccctatagggggaggccccaaatttacccgcggccctcctttgggggcgttcttgtttttacaaccgcccctgggaccgggggaaaaaacccttgtgcgtttttcccccatattttn

SEQ ID NO: 69647 - DNA, 651 bp, Zea mays
  misc_feature: Ceres CLONE 1548145
  misc_feature: SWISSPROT Homolog: EC 3.2.1.23 Beta-galactosidase
tggcggccgctctagaactagtggatcccccgggctgcaggaattcgtctcacccctagaaaaaaaaaaataatgttatcttcatatttattggccatacctgaattcagttgaaccgagcttaggccagcttatgtttaatatgcagttccaacctgtgattgacccattttttatgttctttttgccctctgtgatgtgagtgtgactactctgtaacattataagtgtgatactattgtagtctctactgccctgacgatgtaaacggttggatatctttgaagctgtccttgatgaatctggacatgtattttgtgtgtaaaaagaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaatttttgttaatcacctcatttttttaaccaataggccgaaatcggcaaaatccct

SEQ ID NO: 69648 - DNA, 668 bp, Zea mays
  misc_feature: Ceres CLONE 1548146
  misc_feature: Encodes the peptide sequence at SEQ ID NO. 69649
tcccgcggtggcggccgctctattctagtggatcccccgggctgcaggaattcgtctcacccctagaaaaatttattgagaaatttaattatactcatctatctaatctactttctctctcctcccccgtcccgtcgcttcgatcccccgagcttcgctcacaccggtcacctccgcctcctcccgcttcgcgcgcatctccttctatcgctccagcctccagcacacgtcctccatgccctcgcggttctgatccggccacagccatgcagcaccgctcgccggaggcggcttcggcatccgcctccccgacggccgcggcggtggaggccatggcgccgggcgtcggcggggttgagccggccgtgacgctcgaccaggttccgcgctggagcgacccggaccagcgcatctccctgctgtcccccaccgccgccggatccgagaccccggcctcgtccttcctctccttctccgacccgctcaccggcgacgacgcggccgcgggggccgggggccgtggcgcgtcgcggttccccgtcgattacgagatcaactcgaagatctacctctggcgaggccatccgtggaacctcgaggtcgacgccgtcgtcaactccaccaacgagaacttggacgaagctcatagcagtcctgggctccacgct

SEQ ID NO: 69649 - protein, 134 aa, Zea mays
  misc_feature: Ceres CLONE 1548146
MQHRSPEAASASASPTAAAVEAMAPGVGGVEPAVTLDQVPRWSDPDQRISLLSPTAAGSETPASSFLSFSDPLTGDDAAAGAGGRGASRFPVDYEINSKIYLWRGHPWNLEVDAVVNSTNENLDEAHSSPGLHA

SEQ ID NO: 69650 - DNA, 796 bp, Zea mays
  misc_feature: Ceres CLONE 1548150
  misc_feature: Encodes the peptide sequence at SEQ ID NO. 69651
  misc_feature (796)..(796): n is a, c, t, g, unknown, or other
aaccgcttttttccccgccaaccgccacacccccactgcatcccccaaacacaagactccccgcggtggcggccgctctatactagtggatcccccgggctgcaggaattcgtctcacccctagaaaaaaaaaagaaaaaaagaaactctccgaaaccctagatccgctgctccattctcagccgccgccaatcccttccgcgtgctctctcacccggtgagtgagaagaccagatggccggcaagggcgatggcccggctatcggcatcgatctctgcatgacgtactcttgcttcggcgtgtggcagcacgaccgcgtcaggatcattgccgacgaccatggtaaccgcgctacgccctcttacgtggcctttcccgactcctagcgcctcatcggatatgcgggccagaatcatgtccccttgaccccatcaacacgggttttgatccctagcgccccttcggcaggaggttcactgatgcgtccgtcccgagtgatatcaggttgtggcccttcaaggtcatttctggggcctggtgaaaaaggcaatgattgtttgtccatccccaaggttgaggaaacaccatcttggcagcttaaagagattccccctcgagggttcttataaaaccattccccggaaattggcttgaaggcttccccttgggacagcccggaccccaaaaaagcgttgtgggtccccaagtcccctggccctccctttctgagggacctccaccgggggggagggcccaccaatagggattccctggagggctcaatttcgctggccn

SEQ ID NO: 69651 - protein, 50 aa, Zea mays
  misc_feature: Ceres CLONE 1548150
MAGKGDGPAIGIDLCMTYSCFGVWQHDRVRIIADDHGNRATPSYVAFPDS

SEQ ID NO: 69652 - DNA, 661 bp, Zea mays
  misc_feature: Ceres CLONE 1548152
  misc_feature: Encodes the peptide sequence at SEQ ID NO. 69653
  misc_feature (584)..(584): n is a, c, t, g, unknown, or other
ccccgcggtggcggccgctctagaactagtggatcccccgggctgcaggaattcgtctcacccctagaaaaaacctcaccagcctcctcgtccccgatctcctcccacccgcatccaagggtttccttctcgaccgtgcggaacgagccagagaacaggtatggcggcggcgcggcacctcagatccggcctccccctcctccgcgcccacctcgcatcctccgaatccgcggccgtcgctcaggtttcgaggggcttcgcgtcgcaggccgccaagcccaccgggaaggagatcaaggttccaaaggctctgtttggcggcacaggcaactatgccagtgcactgttcctcacagcagctaaatctaatgcattggacaaagttgaatctgagattaaagctattgtagaggcttccaagaagagcccgttgttttctcaattcataaaggacttgtcagttccaaaagcgaccagggtgaaggctatagccgaaatatttgctgacgctgggttttcagatgttacaaagaatttcttggggtatgttccctgctagtcatttttttgtgtgcctaattaangtaagatacagtttcgtgtaacaagttaatcgctttgatacattccagggaaaaaaactgaataggtgctcttgtcg

SEQ ID NO: 69653 - protein, 132 aa, Zea mays
  misc_feature: Ceres CLONE 1548152
  misc_feature: SWISSPROT Homolog: EC 4.1.2.4 Deoxyribose-phosphate aldolase
MAAARHLRSGLPLLRAHLASSESAAVAQVSRGFASQAAKPTGKEIKVPKALFGGTGNYASALFLTAAKSNALDKVESEIKAIVEASKKSPLFSQFIKDLSVPKATRVKAIAEIFADAGFSDVTKNFLGYVPC

SEQ ID NO: 69654 - DNA, 653 bp, Zea mays
  misc_feature: Ceres CLONE 1548159
  misc_feature: Encodes the peptide sequence at SEQ ID NO. 69655
ccgcggtggcggccgctctagtctagtggatcccccgggctgcaggaattcgtctcacccctagaaaaaaatctgtgttcttttctacctctttcggtctccgctgagacttgaaacagcctttcatggatgtactgaagagaaaaagaaccttttgtaccataagatagtagaacagaattggtgtctcagatttcttcaaagttctgagtctccaaattggcaaaaagttgaagttactgggggccatgtgcatgtgtccgggtccggcatctggaaatggaatggtactcctgtatatattcggctcgcccctcaccaaccgggggaggacgacgaccggtcccattccccccgccccaacttgtcaggactcaagaggctcccctcctccctcgccgcggaacacgcgcgccgtcgtcgccagcccgggttcatttctccgttccttggtgcggtggtagccgagcgctccggccatggcgttctatcggggcctcaccgcagtctcgagactgcgatcacgcatggcgcaggaggccaccacgctggggggtgtgaggtggctgcagatgcagagcgcgtccgatctcgatcttaagtcccagttgcaggaattgattccggaacaacaggatcgcttaaagaagctc

SEQ ID NO: 69655 - protein, 58 aa, Zea mays
  misc_feature: Ceres CLONE 1548159
  misc_feature: SWISSPROT Homolog: EC 2.3.3.1 Citrate (Si)-synthase
MAFYRGLTAVSRLRSRMAQEATTLGGVRWLQMQSASDLDLKSQLQELIPEQQDRLKKL

SEQ ID NO: 69656 - DNA, 661 bp, Zea mays
  misc_feature: Ceres CLONE 1548165
tccccgcggtggcggccgctctagaactagtggatcccccgggctgcaggaattcgtctcacccctagaaaaactctggaaaaggaaagagatgataacaagaaagagaaggcaaagagtaggaggaatgagaacacaatctttggtgcacttcagaaggtgcaacaggacaagaaacaagtagaggagtctatagataagcataagcaggctgtgagagagttgattgagaattatcctggattatcatctgaagtgccacctatctctgcactagaagagcaacttctttcatacttccgtgcagctaaagatatggaggaatcttctagtcccttccgtgatggtgcagcaactcaaactccagttgttgaaactgcccctgtggatgcacctacttcagctggaggtgattcagtattaattttgttctgacattgctgccattctattcattttgtaatgattcagtactcataagtcattctgaagcatttgatgttgtttcctatgtgatgacatttgattcattactcttccggtcaatgtgggagctgataagtcgttcagttgcaggacgtccagtagatacttcgtcaaggccagctaaagctaaaatgacggaagaaagagcagttcccaaaccaagcagtgaagtacg

SEQ ID NO: 69657 - DNA, 740 bp, Zea mays
  misc_feature: Ceres CLONE 1548168
  misc_feature: Encodes the peptide sequence at SEQ ID NO. 69658
  misc_feature (11)..(11): n is a, c, t, g, unknown, or other
  misc_feature (13)..(13): n is a, c, t, g, unknown, or other
ctttttttttncncttttttttattgtttccttcccccgccgtcccccccagggtgggtttatatatcggaggaaccaccgctcttttctagtggatcccccgggctgcaggaattcctctcacccctagaaaaaagacttcataagttggggcaccgtctgcatgataaaaacattgatgggcataaacttctgcaaaaatattttgaagctagggacgctaaagcgaatgaagaaccttctgactcatctaattccttggataagccacctgatgttccatagatcccggtgcattcatcagaagataccgttgatcttaaagtgaatggaacaccaaagaaggatgcatctgtggtcaaccctgttctggaggattctgtttcaagcataccagtcactgcagacaatgaacctgtgccttctcccaccacaacaaaaatggacccagttttctaacaaagccacacggatcaagtttgaaaatgaaagtcaccatggcatctccttgctccaaatcacatccagctgatatggataaaagatgcctctcttccttctaaatctccacaaaccaattgagctgctccagatcctcctaaactgcccttcatctgattaaacaacccctaagttccctcaaagctaacatttcggctgattaaaaactacttccggttccctccaaaaaatctccccttttgggtaaaaaaaaagttagctccggggcccccctccca

SEQ ID NO: 69658 - protein, 94 aa, Zea mays
  misc_feature: Ceres CLONE 1548168
  misc_feature (4)..(4): Xaa is any aa, unknown, or other
  misc_feature (5)..(5): Xaa is any aa, unknown, or other
LFFXXFFYCFLPPPSPPGWVYISEEPPLFSSGSPGLQEFLSPLEKRLHKLGHRLHDKNIDGHKLLQKYFEARDAKANEEPSDSSNSLDKPPDVP

SEQ ID NO: 69659 - DNA, 657 bp, Zea mays
  misc_feature: Ceres CLONE 1548169
  misc_feature: Encodes the peptide sequence at SEQ ID NO. 69660
ccccgcggtggcggccgctctagtactagtggatcccccgggctgcaggaattcgtctcacccctagaaaaactctgcacaaggcaagacatgattacgtgaaatagaaggcaaaatatcacgaggattgaaaacacaatctttggtgcacttcataacgtgcgcctcgtcctcatacgagtaaaggagtctatgagatagagcatagacaggctgtgacacagttgattgagaatatatcctggattatcatctgatgtgccacctatctctgcactagaagagcagcttctttactacctcctgcgcaaccaaacgatatggaggaatcttctagtccctctccgtgatggtgcagcaactcacactccagttgttgagactgcccctgtggatgcacctacttcagctggaggtgattcaggattaattttgctctgacagtgctgccattctattcattatgaaatgattgagtagctcataagtccttctgaagcatttgatgttctttcctatgagataacatttgattcattactcttccggcctatgtaggatctgataagtcgttcagttgcaggacgtccactatatacttcagtgaggccagctaacgctaaaatgactgatgatagaccagtttcctcatcaagc

SEQ ID NO: 69660 - protein, 33 aa, Zea mays
  misc_feature: Ceres CLONE 1548169
PRGGGRSSTSGSPGLQEFVSPLEKLCTRQDMIT

SEQ ID NO: 69661 - DNA, 648 bp, Zea mays
  misc_feature: Ceres CLONE 1548174
  misc_feature: SWISSPROT Homolog: EC 4.1.1.31 Phosphoenolpyruvate carboxylase
ccccgcggtggcggccgctctattactagtggatcccccgggctgcaggaattcgtctcacccctagaaaaactatctcatcgcagcggcgcgagccgcacctctggccactccgaccatggacctgccgtgcttggctgtatcgccgctggcgggcgtcgagcaaatctccctgcctcggtgagaagcaccactccatcttacgcgcaggtcacgtcagctggttcccggaatggtctccgaggactacaagctcctcgctggagatgcgctgctctctgaccgcttcctcgaaatacatccggacctccggagaccttgtcttcgtgcactcgttcattaccgtcaccaactattggccgactgctatcggctcgagacacgatttaacttgccaagatctcctccaggtcatcgggttggcgcctaaccacgccgtccgttgtgcagaggtgcgtcttgcatatgcttcactcttctcaaacagaccaaatgatgtcgcagatccctttgtacccggctggcaaagccagccccaggaaagggggcgtacccctacgaatgcccccccccacccccccgttccggaaagccaaaaaacaaggtgggaacctgcgttcctttgacaaaaagttctctgtaattttc

SEQ ID NO: 69662 - DNA, 662 bp, Zea mays
  misc_feature: Ceres CLONE 1548175
  misc_feature: Encodes the peptide sequence at SEQ ID NO. 69663
gcggtggcggccgctctagaactagtggatcccccgggctgcaggaattcgtctcacccctagaaaaaagttatttgacttaaccccgtctttggtcccggatggggtaggacatatcactcacgctgagggaagataaaggtgcacgaatcccgactgggtgtgaggtgtacggcgctcctcccggacgccggatctgcgcccgcggaccctccccgacgacggatctacccccccgcacgagaatggaggcggggctctggccgttccttgcccgcgagcccccaaatgcgtccacccccccgatatatatatcaatcattgcccctgtgatatcaaggttccagatgatgcaatgcccaaaacatcttctcctagaactgctggctgctagttgcaaacatttgtcattcccttgttatgttgttgcttccttctctgctggaccacacgggaaaactttgcacatacagggagctcctttcaaatcctcctatgtccagagatttggactgtcctgttacgacacagatggctgtggcagtcctggatcgtaactttaggaggcgattatccttcctcggacaccaattgacggtacgcacctgaactggcagagaatttttggccaacctgacaatggttctggcccttccactcaa

SEQ ID NO: 69663 - protein, 103 aa, Zea mays
  misc_feature: Ceres CLONE 1548175
MEAGLWPFLAREPPNASTPPIYISIIAPVISRFQMMQCPKHLLLELLAASCKHLSFPCYVVASFSAGPHGKTLHIQGAPFKSSYVQRFGLSCYDTDGCGSPGS

SEQ ID NO: 69664 - DNA, 795 bp, Zea mays
  misc_feature: Ceres CLONE 1548180
  misc_feature: SWISSPROT Homolog: EC 3.6.3.6 Proton-exporting ATPase
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (733)..(733): n is a, c, t, g, unknown, or other
ttatgagtttttannnnnnnnctaatattaataagatatttgctcctccccctttttttgtcttatcttcggtggcggccgctctatactagtggatcccccgggctgcaggaattcgtctcacccctagaaaaaaacgcccaccaccactctctatgctcaccgccccccgtcccgctcattggtacgagagtactggacccttcctttctcgcacgggaagactagctaggaggggcggcgcccgtgcggcgtatgcccgatgcctgccgtccgcctgcgcctctaggactagggtccgctccagcgccagccgtccgccatgcgtgggctcgaggagatcagatactgagccatcgatctggagaacatgcccatccatgaggtgttcgagctgctgaagtgctcccgcgaagggctgaactccagcaagaagccaagatacgtctcgagattgttgttcccgaacacccccccccggagcaacaaggagagcaacggtccctcaagttcccttggagatcatgagcgaaccccccctttccttgggtcactgcaaaatgggctgcctcccaccgtttatttgcactccccccaacggtgattggctaaaccccccctgaattggccagggacttccggtggggcatccatcgtggctccttcggatcatccaaccccacgctttctcctttaacttgggagcctagaaaccaattgcccaggggggtgnccctatctcaccggggttgagatggggcaaacctccgagtctcccaaaaaacccaaggtttg

SEQ ID NO: 69665 - DNA, 660 bp, Zea mays
  misc_feature: Ceres CLONE 1548181
  misc_feature: Encodes the peptide sequence at SEQ ID NO. 69666
  misc_feature (259)..(259): n is a, c, t, g, unknown, or other
  misc_feature (273)..(273): n is a, c, t, g, unknown, or other
  misc_feature (343)..(343): n is a, c, t, g, unknown, or other
  misc_feature (454)..(454): n is a, c, t, g, unknown, or other
  misc_feature (532)..(532): n is a, c, t, g, unknown, or other
  misc_feature (642)..(642): n is a, c, t, g, unknown, or other
  misc_feature (650)..(650): n is a, c, t, g, unknown, or other
ccccgcggtggcggccgctctagaactagtggatcccccgggctgcaggaattcgtctcacccctagaaaaagtctcgctttcctttcccgttcaccccaagcccccaacctgcgagctgcgacaagttcgtctctctcgtggccacgactggccgccgcccccgcctccgtcccctcgcagattcccaggtcttcgccgctcccttcgccgccaaagagcacccactaggttaaatccgccagggggaaatctccatncagtggctcgtgcntattatgcgatcttcatgggctgactcagttgcgaacgcccgagaatcggcgcccgcgactgctgctgcntatggctctgtttgcactcatagcacctcgcgccctacgcgcagcttctacgtgcctcacaatcttcctgggcgctcagcttgtgcttgctgtgagctctagccagcctantagcaccagcccaagtggaccactggcaatggctgctgacaaacttctgggtcaggtgctgtctttttgtgggccctnccttggctggcattgtgaaagggggggggggctgctgggactcccgccccggtgggttgggaccgccaaacaccggaaccaaaatccttttggcaaaacccaagctgaanaaattganttcgacggcc

SEQ ID NO: 69666 - protein, 55 aa, Zea mays
  misc_feature: Ceres CLONE 1548181
MRSSWADSVANARESAPATAAAYGSVCTHSTSRPTRSFYVPHNLPGRSACACCEL

SEQ ID NO: 69667 - DNA, 654 bp, Zea mays
  misc_feature: Ceres CLONE 1548182
  misc_feature: Encodes the peptide sequence at SEQ ID NO. 69668
  misc_feature (612)..(612): n is a, c, t, g, unknown, or other
ccccgcggtggcggccgctctagtactagtggatcccccgggctgcaggaattcgtctcacccctagaaaaaagcagtccagctccagcaccaccagcggcgccctgccccacgcggccacacccaggacccagcggccagcactactacctcgctggaaacgcgcggaggtccagcgccagccgccagcaccaagcttccaggtctctagtgactcgatctcaagcaaaggcgtttcgggatgtttatcatggatcgatcgatcatggcggatggtgagacatcttcggatgaaaagaggaggtggacggggccaccagaggcgcacgagttggaggagacaaagaggaggcggacggggccaccacaggcgcatgatttggaggagcgcctggactctctcagggacaaaattgccgccgcaagtcttgtcgctggaaaccgattctgagaggagcagcgacggtccttgttgcacgagtggttgcgcctcgcatctgccaagttggatctggatctctcaggcataagcgagtttgacctatcagcagaggcgttgccttggttgatgccgccggaagaggcagacaagaggacgacgcacacgctgcnaaaggcgcaggagttggaggagcgcatgacctgtctgcggtt

SEQ ID NO: 69668 - protein, 61 aa, Zea mays
  misc_feature: Ceres CLONE 1548182
MADGETSSDEKRRWTGPPEAHELEETKRRRTGPPQAHDLEERLDSLRDKIAAASLVAGNRF

SEQ ID NO: 69669 - DNA, 643 bp, Zea mays
  misc_feature: Ceres CLONE 1548185
  misc_feature: Encodes the peptide sequence at SEQ ID NO. 69670
  misc_feature (577)..(577): n is a, c, t, g, unknown, or other
  misc_feature (581)..(581): n is a, c, t, g, unknown, or other
  misc_feature (584)..(584): n is a, c, t, g, unknown, or other
tccccgcggtggcggccgctctagaactagtggatcccccgggctgcaggaattcgtctcacccctagaaaaaacgctgctatcctcctcagtcttctccgcttttcccccatctccttctgggcgcaccaggaaaaaaattgatacattcctcggcagctgcgcgagtcctctgttgataccccggcgacccaaagcccccgtccgagcagcagcagcagccgccgcctaaaagtaacaggattggggattttttttttgcttcgtgttctccttctcctgctgtaggcgttgattcgggtgatgagagatgggcttcttggcgtgcttgtgccgatgccctcaggacggggacgacgacgagaaggagggggagcagttcagaatcaaccaccaggtcgcctcagtggactacccaaaatcttctgaaagcagcccattgaaggctgagagagtggttcatatggacggagcgcagctaattggtagacatgatgaagcaacaatcttcacgttgcgtcagcttgctgaggctaccaataatttcaggcaggactctcttttggggcgaggtggnattnccngttgccgtctacaaaggcaacttcctaattaatggaaaaagtttgttgccggcaaacac

SEQ ID NO: 69670 - protein, 101 aa, Zea mays
  misc_feature: Ceres CLONE 1548185
  misc_feature (91)..(91): Xaa is any aa, unknown, or other
  misc_feature (92)..(92): Xaa is any aa, unknown, or other
MGFLACLCRCPQDGDDDEKEGEQFRINHQVASVDYPKSSESSPLKAERVVHMDGAQLIGRHDEATIFTLRQLAEATNNFRQDSLLGRGGIXXCRLQRQLPN

SEQ ID NO: 69671 - DNA, 710 bp, Zea mays
  misc_feature: Ceres CLONE 1548187-R
  misc_feature (1)..(1): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (62)..(62): n is a, c, t, g, unknown, or other
  misc_feature (239)..(239): n is a, c, t, g, unknown, or other
nttgggggnnnnnnnnnnnnnnnnnnnnnnnnnnnnncccattgggtacctcaagcgtctcngtttttttttttttttttaaacagtccatccaatgggctgggatattaattaattattacaaaacagcatgcagaattgtacgaaatgcttattattacaatatgtataatatgccaagattttccacttggacttgacaacaagagtgaatataaagaggcagggaaattacatantgcataggggaaaaacagacgctgccaagttcgggcattttccatcccaaaaactggacaaaaacgccaaccaatcccgggaaagcctgaattttttggcggggtgccaattccctccagggtggaattgaaaaaaaaaagccccccctaaaccccgtggtttcttggcatttgccgggggggggggaatattttccccccctttccttgggtgtaaaagaaataaaacccttttgttttgcccagggccggggggggggggttaccccgcccccccccgggggttctaacttttgaacacattcccccggggggggtttttttttttccccccccggaaaaaatcccttttttaaaaaaacccccccccccttgggggggggcccgcaccccctaaaaaaaatggggggggggggccccccttttattccccctcttttataaaggggcgttgggagggccccccctaaa

SEQ ID NO: 69672 - DNA, 627 bp, Zea mays
  misc_feature: Ceres CLONE 1548191
  misc_feature: Encodes the peptide sequence at SEQ ID NO. 69673
  misc_feature (287)..(287): n is a, c, t, g, unknown, or other
tcccccgggctgcaggaattcgtctcacccctagaaaaaatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcngaggagggccgcgccccgccaaggtgcgcgccttggccgccaggcggggtggacgcggtcgcaaatggtctccaacgcggaaacggaaaccgagaaaggaccgggaggaggccgcggccccccacgaagaaactggcccgtattgccctggggccccctccggtcgcaagggggttacccctttttgaggggtccaccccccaaacagggggtttttggtttccccaagggaggaaggggaggggaccctctttgggggggaagggtctccccccgggggtttttttctcgggagaccccaaattaaaaaaattttttggaaaccccccgggcgggaata

SEQ ID NO: 69673 - protein, 143 aa, Zea mays
  misc_feature: Ceres CLONE 1548191
  misc_feature: SWISSPROT Homolog: EC 1.1.1.40 Malate dehydrogenase (oxaloacetate-decarboxylating) (NADP(+))
  misc_feature (42)..(42): Xaa is any aa, unknown, or other
MLSTRTAAVAASASPASPWKLGGRSEGGASCDGCRTYRNTLXRRAAPRQGARLGRQAGWTRSQMVSNAETETEKGPGGGRGPPRRNWPVLPWGPLRSQGGYPFLRGPPPKQGVFGFPKGGRGGDPLWGGRVSPRGFFSRETPN

SEQ ID NO: 69674 - DNA, 662 bp, Zea mays
  misc_feature: Ceres CLONE 1548193
  misc_feature: Encodes the peptide sequence at SEQ ID NO. 69675
gcggtggcggccgctctttcctagtggatcccccgggctgcaggaattcgcctcacccctagaaaaaagccccaggaggacagtcccgttccagtcagagcgcagccagttcccccggcccctcccccctcccgctcgccggcggcgatggggcacggcgcgagctgcagccgcccaagcgaggaggtggacttcttcggcgcggcgcagtgcggggacacggcccgcctcgccgccgctcttcgctcccgccccaccttgctcgcccgcaccacgctcttcgaccgcctctccgcgctccacatcgccgccgcacacggccacctccaggtggtctccctagcattagacctttgcgtgcaccccgacgtcgttaaccgccacaagcagacggcattgatgctcgcggcgatgcacgggaagaccgactgcgtccggcggcttctcgacgccggcgccaatatcgtgatgttcgattcctcgcaccggcggacgtgcctgcactacgcggcgtactacgggcacgcggactgcctccgggaccatcctctcggcggccaagtccgccgcccggtgtccggaattcctgggggggttcgccccccctttcctggaaaactgtccggggaaaaaaaccccggggggtggaaagcccccttttt

SEQ ID NO: 69675 - protein, 171 aa, Zea mays
  misc_feature: Ceres CLONE 1548193
  misc_feature (79)..(111): Pfam Name: Ank Pfam Description: Ankyrin repeat
  misc_feature (46)..(78): Pfam Name: Ank Pfam Description: Ankyrin repeat
  misc_feature: SWISSPROT Homolog: EC 2.7.11.1 Non-specific serine/threonine protein kinase
MGHGASCSRPSEEVDFFGAAQCGDTARLAAALRSRPTLLARTTLFDRLSALHIAAAHGHLQVVSLALDLCVHPDVVNRHKQTALMLAAMHGKTDCVRRLLDAGANIVMFDSSHRRTCLHYAAYYGHADCLRDHPLGGQVRRPVSGIPGGVRPPFPGKLSGEKNPGGWKAPF

SEQ ID NO: 69676 - DNA, 629 bp, Zea mays
  misc_feature: Ceres CLONE 1548197
  misc_feature: Translation starting site: 222
  misc_feature: SWISSPROT Homolog: EC 1.4.1.2 Glutamate dehydrogenase
acccgcggtggcggccgctctagaactagtggatcccccgggctgcaggaattcgtctcacccctagaaaaaaaaacaccacgcacagcctcctcccttcctcaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagattatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgatccgtcagtgcagtgtgacatgaagctatggccgttcaaggtcatcccagggcctggtgacaagcccatgattgtagtgaactacaagggcgaggagaagcagtttgctgctgaggagatctcctccatggtcctcatcaagatgaaggagattgctgaagcc

SEQ ID NO: 69677 - DNA, 702 bp, Zea mays
  misc_feature: Ceres CLONE 1548198
  misc_feature: Encodes the peptide sequence at SEQ ID NO. 69678
  misc_feature (349)..(349): n is a, c, t, g, unknown, or other
  misc_feature (389)..(389): n is a, c, t, g, unknown, or other
  misc_feature (391)..(391): n is a, c, t, g, unknown, or other
tgcaggaattcgtctcacccctagaaaaaaggccaacaaaggagcaaagctaccgtcgccgaagccgagcgacgttccaagaaacgaaacagccatgatgatgatgggagagggagcgcacgcgccgccttggcagcagtcaccggcggccagcggcatcatggacgcggacgaagtgtctccttacgccctcctggcggagctgaacattacctgccgtcaaacgaggtgatggcccacgacgaggaggacaacgaggccctggcgtgcttttccccccctccacccgtacccttggcaaccatttttttttaccccccccccccccggggggaaagacggggggccnctcctttttaacccaccaaccccccccaactttcccctantnaaaaaacccaggcgtaaaatggccccggcgggggttatccccttaagtggtattctttatgtctgggtacccgctgtccccatggattttccccgggggggcggtttgccaagtctgtgttgatcttcttgccacgcctttgccctcccgcttcctcccggggtgctccgggctttccccagttgcgcgcccatatgcctccgcggcgcgcgcccgcgcgccccatcctggcctctccctctccccaccccctgtcctctttctcgcccatcacccattctactactttttccattatttcgtgtgccacg

SEQ ID NO: 69678 - protein, 45 aa, Zea mays
  misc_feature: Ceres CLONE 1548198
MMMMGEGAHAPPWQQSPAASGIMDADEVSPYALLAELNITCRQTR

SEQ ID NO: 69679 - DNA, 672 bp, Zea mays
  misc_feature: Ceres CLONE 1548200
  misc_feature: Translation starting site: 246
gcggtggcggccgctctttactagtggatcccccgggctgcaggaattcgtctcacccctagaaaaagcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaggagggtgctgctgcagtgtctcccctctcgctatgagtagtgctgtgaaggaccagctacagcagatgtcgacgacgtgcgattctctcctgttggagctcaacgtgatttgggatgaggtcggtgagcccgacatggcgagggaccggatgctgctggagctcgagcaggagtgcctcggcgtctacgaatagataggtcgaccaggtcaatcgatgcagggcccagttgctgcaggccattgcggaggcagaggccgagctcgctggcatatgctcggccatgggcgagccaccgatccctgttagacagcccaatccaaacttacaagggtttaagggaagaaattggatgcgcattgtccccctactttggaaggaaattgagaaaaaaaccaaagtttgaaaaatagggggcccaatgttgtttgaggtggttcggagtccatttttagaacgg

SEQ ID NO: 69680 - DNA, 653 bp, Zea mays
  misc_feature: Ceres CLONE 1548201
  misc_feature: Encodes the peptide sequence at SEQ ID NO. 69681
tccccgcggtggcggccgctctagaactagtggatcccccgggctgcaggaattcgtctcacccctagaaaaagtcgtccgctcctctcctctcccctacccgtctccttgtcgtccttgcctgcggattggggcggcacagcctctcgcttctcccgcgcgcgagccctttctccgcggccgcggcatgacgatgccggaggcgaatgcctctgcgacggcgcagaggaagaagaactcaccagagatggagttcttcagcgagtacggcgatgccaacaggtacaagatccaggagatcattggcaaagggagctacggggttgtctgttcggctatcgaccaacatacgggcgagaaggtagccatcaagaagatacagaacatcttcgagcacctgtccgatgctgctaggatcctccgcgagatcaagcttctccggctgctgaggcaccccgatatcgtcgagatcaaacacgttatgctgcctccgtcgaggagggactacagagatatttacgttgtgtttgagctgatggataccgatcttcaccaagttattaaggctaacgatgacttgacgaaggaacaccaccagttctttctctatcagatgctgcgtgcattgaaatatattcatactgctaacgttt

SEQ ID NO: 69681 - protein, 153 aa, Zea mays
  misc_feature: Ceres CLONE 1548201
  misc_feature: SWISSPROT Homolog: EC 2.7.11.24 Mitogen-activated protein kinase
MPEANASATAQRKKNSPEMEFFSEYGDANRYKIQEIIGKGSYGVVCSAIDQHTGEKVAIKKIQNIFEHLSDAARILREIKLLRLLRHPDIVEIKHVMLPPSRRDYRDIYVVFELMDTDLHQVIKANDDLTKEHHQFFLYQMLRALKYIHTANV

SEQ ID NO: 69682 - DNA, 656 bp, Zea mays
  misc_feature: Ceres CLONE 1548202
  misc_feature: Encodes the peptide sequence at SEQ ID NO. 69683
ggcggccgctctagaactagtggatcccccgggctgcaggaattcgtctcacccctagaaaaaacattcacttctcttcccatccgtacgaactcgcatatctgagagaccgaggcgcccgcggttctgctttccttccttgccccgttcacgggagaattttctggagtcttcgactctagcagggttccgatggcgctgcgatggatgatcctggcgtgcgtggtggcggtggaagctgcggtggctgcgctggtcacgctcccggtgccccgcgctgtgcggggtcagatcgtcgcgctcacgtccttgttcctgcaacccctgtccagtgtgatacccttcgccgccttccagatcctcggtctcgtactggaagaaggagcacacactgatgtgcacctcggagatttgctccgccgaatagcgcattcgcttcgagaaatctgtgagtgattgattcccttccatgtttagatttgtgtggtgcttctaagtctctgcttttcctgcttagcttatgcaatctgacatatgcagtgattgttgttctcttaggggacagttggatagttggagttctacttcctacttagatggaatagcgtgatcgggccagataatatcgtatcaaattcctgtacagctttattgat

SEQ ID NO: 69683 - protein, 87 aa, Zea mays
  misc_feature: Ceres CLONE 1548202
MALRWMILACVVAVEAAVAALVTLPVPRAVRGQIVALTSLFLQPLSSVIPFAAFQILGLVLEEGAHTDVHLGDLLRRIAHSLREICE

SEQ ID NO: 69684 - DNA, 650 bp, Zea mays
  misc_feature: Ceres CLONE 1548204
  misc_feature: Encodes the peptide sequence at SEQ ID NO. 69685
gcggtggcggccgctctagtactagtggatcccccgggctgcaggaattcgtctcacccctagaaaaagttctatatcgccccattgctcgctcgccaagagttcttcttgttaggcaaggcaaaagcagaagcaaaaaaagaaaggtcttgttgccgatggggagctcagggttctcgtggacgcttccggaccaccccaagctccccaaggggaaaccggtggctgtcgtcgtgctggacggatggggcgaggccaaccccgaccagtacaactgcatccatgtcgctcagactcctgtcatggactcgctaaagaatggcgctcctgagaaatggagactagtgaaggctcatggaacagctgtgggtctcccatctgatgatgacatgggcaacagtgaagttggtcacaatgcacttggtgctggtcgaattttcgcccaaggtgctaagcttgtcgatcaagctcttgcctccggaaagatttatgatgggagatgggttccactacatcaaagaatctttggaagtgtaactctccccttattgggatgttgagtgatgggggtgtcaaccccctccttgatcaatgccgaaacttctgaaaggtgtccatgaaagaggggggcaaaaaaatcccgtgtgccc

SEQ ID NO: 69685 - protein, 133 aa, Zea mays
  misc_feature: Ceres CLONE 1548204
  misc_feature (18)..(132): Pfam Name: iPGM_N Pfam Description: BPG-independent PGAM N-terminus (iPGM_N)
  misc_feature: SWISSPROT Homolog: EC 5.4.2.1 Phosphoglycerate mutase
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGRWVPLHQRIFGSVTLPLLGC

SEQ ID NO: 69686 - DNA, 659 bp, Zea mays
  misc_feature: Ceres CLONE 1548205
  misc_feature: Encodes the peptide sequence at SEQ ID NO. 69687
  misc_feature (526)..(526): n is a, c, t, g, unknown, or other
  misc_feature (527)..(527): n is a, c, t, g, unknown, or other
aaagctggagctccccgcggtggcggccgctctagaactagtggatcccccgggctgcaggaattcgtctcacccctagaaaaaacacctaccggcccgccccaacccaatcatacatccatacggctacgagcgacggagcgagcgagggaagttgatgttgtagatgccatccttcctctcctccttccggatcgtagtcgtggcttgactcagcgtagcggccagggcagcggccatgtcgtcgtcggtccggcacggctcgtcgaggggccaggcatggttctgcaccacgggcctgcccagcgacgtcgtcttcgaggtgcacgacatgaccttccacctccacaagttcccgctcatgtccaagagcctcaagatccaccgcatgctcagcgagcaggaggaccagcgtccgacgcggggacggcggcagcggaggagacaggtgaggagcagtgacggagacgatgacggtgctgcggaaacagagatcgaggaggaagaagccgagcctgagcacacnnggtgttaggacgggaggggggagggcgacgggcagccgtactgcattgcgttccccgacttcccgggcgggccgggcacgttcgaggcggccgccaagttctgctcgggcgtccgcgtggacctcaccccct

SEQ ID NO: 69687 - protein, 98 aa, Zea mays
  misc_feature: Ceres CLONE 1548205
  misc_feature (97)..(97): Xaa is any aa, unknown, or other
MSSSVRHGSSRGQAWFCTTGLPSDVVFEVHDMTFHLHKFPLMSKSLKIHRMLSEQEDQRPTRGRRQRRRQVRSSDGDDDGAAETEIEEEEAEPEHTXC

SEQ ID NO: 69688 - DNA, 496 bp, Zea mays
  misc_feature: Ceres CLONE 1548206
  misc_feature: Encodes the peptide sequence at SEQ ID NO. 69689
  misc_feature (39)..(39): n is a, c, t, g, unknown, or other
  misc_feature (40)..(40): n is a, c, t, g, unknown, or other
  misc_feature (212)..(212): n is a, c, t, g, unknown, or other
  misc_feature (221)..(221): n is a, c, t, g, unknown, or other
  misc_feature (238)..(238): n is a, c, t, g, unknown, or other
  misc_feature (239)..(239): n is a, c, t, g, unknown, or other
tccccgcgggtggcggccgcttctattactagtaggatnncccccgggctgcaggaattcgtctcacccctagaaaaagcagcagcgtaagcaaagtagaaggcaaggaccaatggcgccgccgcgggtctccttcctggagctctgcctctccttcctctgcttcgtggtcttctactacttccacatcagatccaagcggaagaaccctnttcgtgccngctggactgggccgctnnggtgggcatggctccccggcccctccctcggggaaacttcccaacaaccttccaaagaaactggatacctcctccttggggcagcagttaatttcctttcaaagcccccggtccggtggatttttttaccccgaccccaaagtccccaggtttcccccaatttcccaataccccagggcccccaattcaaggaaattttcaactcccccggggggggggtttttttaacccaaaaaagaaaatttggggccccccgt

SEQ ID NO: 69689 - protein, 128 aa, Zea mays
  misc_feature: Ceres CLONE 1548206
  misc_feature (34)..(34): Xaa is any aa, unknown, or other
  misc_feature (37)..(37): Xaa is any aa, unknown, or other
  misc_feature (43)..(43): Xaa is any aa, unknown, or other
MAPPRVSFLELCLSFLCFVVFYYFHIRSKRKNPXRAXWTGPLXWAWLPGPSLGETSQQPSKETGYLLLGAAVNFLSKPPVRWIFLPRPQSPQVSPNFPIPQGPQFKEIFNSPGGGVFLTQKRKFGAPR

SEQ ID NO: 69690 - DNA, 647 bp, Zea mays
  misc_feature: Ceres CLONE 1548211
  misc_feature: Encodes the peptide sequence at SEQ ID NO. 69691
  misc_feature (544)..(544): n is a, c, t, g, unknown, or other
gcggtggcggccgctctagaactagtggatcccccgggctgcaggaattcgtctcacccctagaaaaactacctctcatccatccagagaagctagagtccaggtctcactcgcgaccgagagccacagagaaatggggggccctggtcgtccctggcgccggcacgtcttcctcgtcgtgtcgctgcagcttctccttgtggcgccatggcaggacgagacggccgctcgagctctcaatttcaccaggcaggatttccccagggccttcgtctttggtgccggcacgtcagcttaccagtacgaaggggcaaccgatgaagacggaaggagcccaagcatatgggacaactttactcatgcaggtaggatgccggacaagagcactggcgacctaggggcggacggctaccacaaatacaagggagacgtgcagctgatgagtgacactggcctggaggcctaccgcttctccatttcttggtccaggcttattccaagaagaaagagagccatcaaccccaagggcctcgagtattacaancacctcatcaatgagctagtaaaacgaaggaattgagatacacgtgaaccctggtcccacccggaataacctccaatcttggaggaacaataccccggcttgg

SEQ ID NO: 69691 - protein, 148 aa, Zea mays
  misc_feature: Ceres CLONE 1548211
  misc_feature: SWISSPROT Homolog: EC 3.2.1.21 Beta-glucosidase
  misc_feature (137)..(137): Xaa is any aa, unknown, or other
MGGPGRPWRRHVFLVVSLQLLLVAPWQDETAARALNFTRQDFPRAFVFGAGTSAYQYEGATDEDGRSPSIWDNFTHAGRMPDKSTGDLGADGYHKYKGDVQLMSDTGLEAYRFSISWSRLIPRRKRAINPKGLEYYXHLINELVKRRN

SEQ ID NO: 69692 - DNA, 648 bp, Zea mays
  misc_feature: Ceres CLONE 1548223
  misc_feature: Encodes the peptide sequence at SEQ ID NO. 69693
gcggtggcggccgctctagaactagtggatcccccgggctgcaggaattcgtctcacccctagaaaaatccgccctccgcccaaaaccccacgcgagctcccattcccatccatggcgaccaccacctcttcctcctcgctgaccaaaggaaagcgatacagcttaccaaactcaaggataatgatccatcaacctcttggaggggcccaaggacaggagactgatcttgagattcacgccaatgagatgctgcaccacaaggcgaacttaaatggataccttgcataccacactgggcagcccctggataagatcaacgtagatactgaccgtgactacttcatgagcgcgaaagaagcaaaggagtatggccttattgatggagtaatcatgaatcccctcaaggcccttcaaccacttccagcttccagttagtcatgaagtgtgctagaactccgtcaaacatttttgttgtatcaatgtgtctgtcggaagccctggctacgtaatattctacgtccaaatgcatcaaagattgtacaaagaataagaaagataaaaacgagacgctcgaggtacccaattcgccctatagtgagtcgtattacgcgcgctcactgaccgtcgttttacaacatcgtgactgg

SEQ ID NO: 69693 - protein, 107 aa, Zea mays
  misc_feature: Ceres CLONE 1548223
  misc_feature (6)..(96): Pfam Name: CLP_protease Pfam Description: Clp protease
  misc_feature: SWISSPROT Homolog: EC 3.4.21.92 Endopeptidase Clp
MATTTSSSSLTKGKRYSLPNSRIMIHQPLGGAQGQETDLEIHANEMLHHKANLNGYLAYHTGQPLDKINVDTDRDYFMSAKEAKEYGLIDGVIMNPLKALQPLPASS

SEQ ID NO: 69694 - DNA, 631 bp, Zea mays
  misc_feature: Ceres CLONE 1548224
  misc_feature: SWISSPROT Homolog: EC 3.2.1.23 Beta-galactosidase
  misc_feature (631)..(631): n is a, c, t, g, unknown, or other
ggcggccgctctagaactagtggatcccccgggctgcaggaattcgtctcacccctagaaaaaccaagattgaaggtaggctaaaaaacgggtattatgctcgccatggctttcgtaccatcaagcatgacatccgtaccatgtgccaagatgcattgagatataaagatggcaatgattcgggagatataaagcaaattgttgtctccttcatacagctagcaaagagactagggaacccaaggtacatttctgatagatatggagcaggagcccaggacagcctggacattaatcaatattcatttgatactaaactcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaan

SEQ ID NO: 69695 - DNA, 633 bp, Zea mays
  misc_feature: Ceres CLONE 1548226
  misc_feature (61)..(61): n is a, c, t, g, unknown, or other
gctctagactagtggatcccccgggctgcaggaattcgtctcacccctagaaaaacgattntgtctactttccattcgatttttttgctgattcatctgcgtgtttggtttggattggacgagggtgtgcatagctaggtagcgcatcttatcagaattgcagcgtggagtgtatattgccatgccatctgattcgtgaccgcgatctgtctatgtactcttgctgagatccatatgtaaaacaggagaatggcttggttgaagaagtggtgcagggactggactggttgaagcatgtttcagttatattttatgaagagtagagaataaaacgagacgctcgaaggcaccaaattcgccctatagtgagtcgtataacccgcccctcactgcccctctttttacaaacgtccggactggggaaaaccctggggtttcccaatcttaattccccttgaaaaaaaatcccccttttccccagcttggggtaataacccaaaaaggcccccgaccccaattcgcccttttccaaaaattttccgccccccccgaatggggcaaaagggaaaatttttaaaccctttaaaatttttttgtaaaaaattcccggggtaaaaatttttgtgtaaaaaa

SEQ ID NO: 69696 - DNA, 518 bp, Zea mays
  misc_feature: Ceres CLONE 1548236
ccccgggtggggcgctctgactagtgatcccccgggctgcggattctctcacccctagaaaaaaataatgaactttaggacttggtatgacgttttatgttaagcgttgtcaggttttgctttcgtgtttgctgattgttggactctagatgcagaatctacgtattggttttggttcctcgagagtgcaatgcagacgatcttttccatgagtgatacggactacacatgaagatttgctgaaaaaaaaaaaaaaacagaccgtcaggtacccattcgccctatagtggagtccattttaccccgcctccctgtggcctcgttttttaaaaaccccggtggacggggaaaaaaaccccggggggttttcccccaaattttttccccttttggagaaatcccccctttttccacagggggggttaaaacaaaaaaagggccccccccatatttcccccttcccaaaattttttcccccccccttgggggggagagggaatttttttgcgcttttattt

SEQ ID NO: 69697 - DNA, 683 bp, Zea mays
  misc_feature: Ceres CLONE 1548242
aagctggagctccccgcggtggcggccgctctagaactagtggatcccccgggctgcaggaattcgtctcacccctagaaaaatagaaaaaacctgagaaccgcagagacaggcgtcttcgtactcgcctatctccgcgacccaaagcgttcccccttctcccattcttctctcatttctcaccaccgccgccgctaccccctttcgacaacaccatgagggagtgcatctcgaatcacatcggggcaggccggtatccaggtccgaaaacgcgtgctgggagctgtactgcctcgagcattgccattcaggctgatggtcagatgccccggggacaagaccatttggggggaggggaagaatgcttttcaaaaccttctttcatggaaaactgggcccggggaaacccctcccccccgggttgtttttttttgacccttggaaccccccggccctccataaaggggagggaatggggggccttatggccaggtttttcttttctgggggaagatccttacagggggcaggagggggggagccccacaaactttttccttcggggggccccaaaaaccctttgttaaaaaaaaaaagtttaacacatgggccttttcccgcccctatggaaggaattggcgaaaaaaaatgccccggggggccacgggggggtccttccccct

SEQ ID NO: 69698 - DNA, 539 bp, Zea mays
  misc_feature: Ceres CLONE 1548245
  misc_feature (148)..(148): n is a, c, t, g, unknown, or other
  misc_feature (193)..(193): n is a, c, t, g, unknown, or other
ccccgccggtggcggccgcttctagaactagtggatcccccgggctgcaggaattcgtctcacccctagaaaaaagcatctcaagccaccattcgaccttcaagtctcgctacgtagcagtgcaataaaaaaagcagccgcaatggcngagcagcaccatgggcccttctcctccacggccctttcgccgggncaaggccgtgaacgtgccgtcgtcgtccgccttcgggaagcccccctgacaatgccccagaccgccggggaaaggccaaaccccggcgggggggcttccgggaaaccccgggggtacgggcccccccaacacccgtgtgttttttttcccttgggggggcccccccctttttttttgggggggaccccccaaatttcttaagggggggatttcccccggggaaaaactcgtttgggggaaccccccggggggggttttccccccccccccccccgcaaaaaatttcttcccaaaaaaagggggggggggggggggagtttctcccccccccggggggggggggggg

SEQ ID NO: 69699 - DNA, 676 bp, Zea mays
  misc_feature: Ceres CLONE 1548250
  misc_feature: Encodes the peptide sequence at SEQ ID NO. 69700
tccccgcggtggcggccgctctatactagtggatcccccgggctgcaggaattcgtctcacccctagaaaaaatgtgcacgcctccattagcctcgcattgacgcggtccgcaactcctctaaacccttcctctccctccggcgccggcgccggcgccgacatggccgtccactacctcctccgccgcggggtctccggtggctcactgctccaccctatccgcggtctcttcctcgcctccaaggagcttgggaggcgtccgttgggctctgcggcggcgggagacgcagcggccgagctgaggggcgcgcgggaggacgtcaggcagctgctcaaggccacctcctgccatcccatcctggttcgattaggttggcatgatgctggtacatatgacacacaacattaccgagtggccccaagtgtggtggagctaatggtagcttgagatttgaagtcgagttgaagcatggggccaatgctgggtcttgtgaatgctctgaagctgatcccacctatcaaggaccagttttcaggtgttacttatgcaaatctgtttcagctttgccgccgcccagcccttgaggaaacaggggccccccaaattcctatgattcatgggaggggttgaggtattgccccccaaacatggcccaccagaggggaggcttcctt

SEQ ID NO: 69700 - protein, 95 aa, Zea mays
  misc_feature: Ceres CLONE 1548250
  misc_feature: SWISSPROT Homolog: EC 1.11.1.11 L-ascorbate peroxidase
MAVHYLLRRGVSGGSLLHPIRGLFLASKELGRRPLGSAAAGDAAAELRGAREDVRQLLKATSCHPILVRLGWHDAGTYDTQHYRVAPSVVELMVA

SEQ ID NO: 69701 - DNA, 854 bp, Zea mays
  misc_feature: Ceres CLONE 1548252
  misc_feature: Translation starting site: 310
cttttattcccttttgtcaattttctttacggtagggctaaccgactctctgtattactatactctccctcggtgggggccgttctataactagtggatcccccgggctgcaggagttcgtctcacccctagaaataataaacccttatttctcgtgccgccgcctcctacgccacctagcgctcgagctcctcgcgtcctgccgagcgcgctccgcaacgtccccatgaagttccgcatcgcgaacccttccaccgggtgccaaaagaagctggaaatcgatgacgcaccagaagctgcctgctttttatgaccgaaggatcatcccacgaggtcaacggcaatgctcccgcgggaggagtctccggggttatggtcttcccaatcatgcgtggatttgataaccaagggcttccggtggaaggaggggagtatttaacttctcggtcgctcgttgcccctttttggatatgggtgaaggccctcccgtgccttccgtcgcttgtttggaggggcacaaatgtaggagcagcatcgcgcaaaaccgccgataattggggcgcgaacattatcgcccgcgcagattttttgcttgtttattccgacctcgggccgcacccaattttgccaattggttaacacattgagactccgccggcgcctctacatgaaaattataattgagcgccaatgtatcaatcgcgatcccccaactaacgtctttctttgtgtgtacgtcggaatttatcgtctcggaccggcacaggtgcggaactatcatgtacggacgcctcttatgtgttggggacgaacgatccattatcgcttcaggtaaatccatcgcgttgacgcgg

SEQ ID NO: 69702 - DNA, 620 bp, Zea mays
  misc_feature: Ceres CLONE 1548255
  misc_feature (285)..(285): n is a, c, t, g, unknown, or other
ggcggccgctctatactagtggatcccccgggctgcaggaattcgtctcacccctagaaaacttctcccctccccttgtccacagcccccgtagaccatgggaagatgcatggcttgagcatctgcatggttcttgagagttaaagctgcacgacgatggatagtggaaacagagcttctcaagaagcattcgttttcgtggtgcctttcctgacctccttggtggtcagctgaggtgcgcacaaaccggcaagtcacaatacggcaatggcggattcccattangagtccctccttttttatttcctttaccccctttttacctttctaagtgggggggatttggtgtccaggggggggaaaccttgaaagaacaaaggacccgaggtttccctgggtgaatggaattatacccccccccttggggggaaacaatgtttttcccccatggggaccccccggccccccaaaaaaaagcgggtttaaaaagaaattgtttccccttaaaaaaaaaaaaaaaaaaaaccgaaccccccccgggggcccccatattcgcccccttttggggggggccttattcacccgcccccccccctggggcgggtttttttttcaacccg

SEQ ID NO: 69703 - DNA, 786 bp, Zea mays
  misc_feature: Ceres CLONE 1548256
  misc_feature: Pfam Name: Frigida Pfam Description: Frigida-like protein
  misc_feature (786)..(786): n is a, c, t, g, unknown, or other
ccacttgaagcctcccccttctcccccccccctccttcccccttccctccacaactgagactccccgcgctggcggccgctctagaactagtggatcccccgggctgcaggaattcgtctcacccctagaaaaaatattcaagcactatcagcggtccatcacggagcaatgtgaacaagaaagaacagtctgcactgcgagctgacatcaagtgtgttgaggatcgcaaactagaagctgagtttctactggagggtcttcggaagcaacattgaacacactatagaaagccgagaccgacaagaagaaggcagcatcaagcgctaccagtggcggcagctgcgggcttgcaaccaagcgtatccgtacgaatactggccgcccaaatggctcctgtccaggcaggtcttctcactaataatgcttgcgaggcttctctccaaactcccacaacatagacccaccccccctcccacgcgtcttacgccaacacccttcccccgtgcctcgcctcataccccgatgcctgcccatccatagcctcatattccttcgcctccccaacccccggattaaacgcctaacccgtcccctccccctgcattataaaccaccaggcctcaccctttccccttacggaacgggcaggggtggaccaccgacgtagttactggccccgcgagagcccccccccgtacaatcaaggggtacccactagtgctctacaccctagtttcaaatgaaaggttatgtccaacccgagattaaaacttttcggggccatn

SEQ ID NO: 69704 - DNA, 653 bp, Zea mays
  misc_feature: Ceres CLONE 1548258
  misc_feature: Encodes the peptide sequence at SEQ ID NO. 69705
tcaccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtggaccccaacatctccggcgggcacgtgaaccctgccgtgaccttcggcgccttcgtgggcggcaacatcaccctgttccgggggctcctgtactgggtggcgcagctgctggggtccaccgtggcgtgcttcctgctccgcttctcgacgggcgggcagggcacgggcacccttcggctgactgccgtgtcggtgtgggaagggctggtgctggaaatcttgatacctttcgggctgggtacccgtgtacgccaggg

SEQ ID NO: 69705 - protein, 160 aa, Zea mays
  misc_feature: Ceres CLONE 1548258
  misc_feature (13)..(160): Pfam Name: MIP Pfam Description: Major intrinsic protein
MPINRIALGSHQEVYHPGALKAAFAEFISTLIFVFAGQGSGMAFSKLTGGGPTTPAGLIAAAVAHAFALFVAVSVDPNISGGHVNPAVTFGAFVGGNITLFRGLLYWVAQLLGSTVACFLLRFSTGGQGTGTLRLTAVSVWEGLVLEILIPFGLGTRVRQ

SEQ ID NO: 69706 - DNA, 610 bp, Zea mays
  misc_feature: Ceres CLONE 1548260
gccgctctataactagtggatcccccgggctgcaggaattcgtctcacccctagaaaaacatattttgtagaacacaccaaagttcgataacttatcctacacacagttttactcgatgctttggctgtatcatttcatcccggcagatcatgcaagggaatgttgttctgggtcatatttgtgttgtcgactttggagccggatggacctctgtagctacacttccttactccagcagtccagcgccagcaaatttcatgtttgcagtccattttaagcatacagcattaactgttggaatagcctgtataaatgttacttgaggaaattatttcccatcatttcgagggaattaaaatttatttataaagtaacatatttagtttggaaaaaaaaaaaaaaaaacgagacgctcgaggtaccccattcccctatagtgagtcgtattacccgcgctcactggccgtccttttacaacgtcctgactgggaaaaaccctggcgttacccaatttaaatcgccttggaggaaatccccccttttccccaagttgggttaatacccaaaaagcccccccaccattccccctttcccaaagtttggccagcc

SEQ ID NO: 69707 - DNA, 812 bp, Zea mays
  misc_feature: Ceres CLONE 1548261
  misc_feature: Encodes the peptide sequence at SEQ ID NO. 69708
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
aacccatgcccaaaccccacacctcaactcccgcctcnnnttcctnnnnnnnnccaaacctggagctccccgcggtggcggccgctctagaactagtggatcccccgggctgcaggaattcgtctcacccctagaaaaaacatcgagtcatccatctaaacatccgatccgaccatggcggcagacgcacttcggggccttctccccggcgtttacgccgtgctgatggtaatcgccgtcgcaagcgctgcctccagcgacgtgtcctcggtggtcgtcggcctcgccaaatgcgccgactgcaccaggaagaacttgaaggccgaggcggcattcaagggtcttgaggtggcgatcaagtgcaagaacagcaaaggcgagtacgagagcaaggccatgggcaagcttgatggcttcggcgccttcagcatcccacttagcacggacctccacggtgcctgactgcgttgcaaacctccacagcgctgcggggaacccctagcccccggccaagaaccctcccaaaaattggccacataatcgcccaaaggagcaaccctcctacggggccccctggaaacaaaaagaactaacccaaaccaaaagaaatagtgccgtcgcgccaatacctagagtctgggtaccaatcaaaaagaaacaccacacccgaagaaaccaattttccaacaaaagaaaccctcttttcccccccctcgccgcccaatggccacacaaaccctccaaccccctaaaaccatgggaagccccaaatcccctagtcctccccctaatcaccccagcaatcaaccacg

SEQ ID NO: 69708 - protein, 95 aa, Zea mays
  misc_feature: Ceres CLONE 1548261
  misc_feature (34)..(95): Pfam Name: DUF1210 Pfam Description: Protein of unknown function (DUF1210)
MAADALRGLLPGVYAVLMVIAVASAASSDVSSVVVGLAKCADCTRKNLKAEAAFKGLEVAIKCKNSKGEYESKAMGKLDGFGAFSIPLSTDLHGA

SEQ ID NO: 69709 - DNA, 680 bp, Zea mays
  misc_feature: Ceres CLONE 1548263
  misc_feature (680)..(680): n is a, c, t, g, unknown, or other
gctctagtctagtggatcccccgggctgcaggaattcgtctcacccctagaaaattccacgctgcctcggccggcacctacctcccccacttcgccgccggcgggtggagtcgggccggagcagccgctagctcgcctctgttaccccccccccccccccacggggagggttggggcgatgtggggcagggggggcttcgttgggtggtttgggtgcgcgggggtttgtgtgtggcgtggggggggggggggtggtgggggttgggtggggtggggtggggagggggagttttgtagggtggcggcggggtggcgggggggcggtcattttgttattgtgacatgggggggggggggggttttgtgtttgtgtgtggggtgggccccccggggggggggttggggggtttgaaagggagttggggtgtgtgggggtggggggggtggtgtgttgtgggtgtggggtgggtgacccccctccccaccaacccaaatggtgtgggcgggtggttgtgttgggttgggggagttttaggggggggttttgttggtggggtttggttgctgtggggcgtggtttggggagaaggtgggggagtttgtgcgggtgctgagggggtgtgtggtgggggtggtgaagggggtgttgtgtgttggggtatttgggtggtggtagggtn

SEQ ID NO: 69710 - DNA, 674 bp, Zea mays
  misc_feature: Ceres CLONE 1548266
  misc_feature: Encodes the peptide sequence at SEQ ID NO. 69711
gcggtggcggccgctctagaactagtggatcccccgggctgcaggaattcgtctcacccctagaaaaaaccagctctctctctcccctgtacttcttgtagggatagatgaaggccatacatggactcgcactactcaagttaagttaccctctaaaacatcgttgataaacacgataggcgcaccatccacgtttgatagccagaatagagtccatccaccgatagctctcattccatggcgagggcttccatcatgatagcggcggcagttcctttggcatgtggccatggccatgccgactgccgaagcgagaaacatgaacaccacgcacgacggagaagaaggactacaccgtgttgcactcgcacagcttcctccacttggaccgcctcatcagctgactggcgtcggtgtcggcggcctctccgggggcagtcttcctggtagcattattctcggctacgagctgcacgacgacgacgacttcctagcctcgctgcaccttgtccagaggcagaacagtggacctccttgggtggtgggtagaagggcctccatcggttttccgcttgcagcccagggtagccccggagacgaggttcgaaccccgaaacccgccaccgagccctggaacgggaaccagaaggggggaactaaaagggggggggggg

SEQ ID NO: 69711 - protein, 128 aa, Zea mays
  misc_feature: Ceres CLONE 1548266
MAMPTAEARNMNTTHDGEEGLHRVALAQLPPLGPPHQLTGVGVGGLSGGSLPGSIILGYELHDDDDFLASLHLVQRQNSGPPWVVGRRASIGFPLAAQGSPGDEVRTPKPATEPWNGNQKGGTKRGGG

SEQ ID NO: 69712 - DNA, 612 bp, Zea mays
  misc_feature: Ceres CLONE 1548269
gctctttactagtggatcccccgggctgcaggaattcgtctcacccctagaaaaactacctcgagctctactcgcataccactgcatgggtgttggggttcttgtatccctgctagtgatgaccctctcccacagccaccaagtctgctctgtccagagaatcaagtgccagtggtgaccatgctcacaattctttacccaccatagccagaacattctagggagttgctggcctatatgaagcttgttccataatcatctcaggtgaggaagcgacaaatttttgttgcttttgctccaaggtggtatcaaatgaagaaaaacaagagtgaagatgcgggaggacgtggtcctccatataggacttttgtttaaagctatcgggaggagtttttgcctcccttgaaatgtgtactactcaacactcgtttatagctctggtctgtaataagtaacttgatcttactttctaaataaatgtaagtttatgtaatagcttccgctaaaaaaaaaaaaaaaaacgagacgctcgaggtacccaattcgccctatagtgagtcgtattacgcgcgctcactggccgtcgttttacaacgtcgtgactgggaaaac

SEQ ID NO: 69713 - DNA, 793 bp, Zea mays
  misc_feature: Ceres CLONE 1548274
  misc_feature: Encodes the peptide sequence at SEQ ID NO. 69714
cagcattctctgttccccgtttccccccctcttttattccatctgcccactccacaaaatggagctccccgcggtggcggccgctctagaactagtggatcccccgggctgcaggaattcgtctcacccctagaaaaaagttgttctcgttcccttgttagttgagctctttcccttcctcgcttggaaccaaatcaaatcggagcggcggagcaatacgatccctcgcctcgcttccattcgaatcatctcgaacggggcactaatcgggaagctaatgtcgcgcaattcgcgagatctgtagcgccactcggcttcaccggcggcgccgcgggcatggaagcgcagaacggctccggcgtaggggcgcccgtggtgctcaacgtgtacgaccttacgcccatgaacaactacctctactggttcggcctcggtattttccactccggaatcgaagtctcccccccctggagttacggatattgggagcacacccagtttcccacaaaggtggggggtatcttgcggtgggaacccaaagactttgtccccgggtctcaactaacccacgcatctgttgccgattgggcaaccactgaactttggtctagaggcatagttctccgcttcttatcattgaaaaatctttgcagggaaaggtaacattggccaaccccattacccttttgatttttcaaggaacctggccacccatttttaaagaatgaatgtcctggtaagaaaccttgaaccacggaaaatccatctcccctggggtggggataacaaccgc

SEQ ID NO: 69714 - protein, 108 aa, Zea mays
  misc_feature: Ceres CLONE 1548274
  misc_feature (11)..(103): Pfam Name: DUF862 Pfam Description: PPPDE putative peptidase domain
MEAQNGSGVGAPVVLNVYDLTPMNNYLYWFGLGIFHSGIEVSPPWSYGYWEHTQFPTKVGGILRWEPKDFVPGSQLTHASVADWATTELWSRGIVLRFLSLKNLCRER

SEQ ID NO: 69715 - DNA, 866 bp, Zea mays
  misc_feature: Ceres CLONE 1548275
  misc_feature: Encodes the peptide sequence at SEQ ID NO. 69716
cgcctatcccttacgtaacactgctattcctttctactcttctataatataaataaaactggagctccccgcggtggcggccgctctagaactagtggatcccccgggctgcaggagttcgtctcacccctagaaaaaacctccgcagctagcatcgatccgccattgctcaccgcacaagtgcacgctcacctgtcacctcacacacgcagctaagtagctaacgccggaggcgagaacaagaaaaagctcgacatggccgaggagaagaagcagggcctgcagctgctggacttctgggtgagcccattcgggcagcgctgccgcatcgcgatggacgagaagggcctggcctacgagtacctggagcaggacctggggaacaagagcgagctgctcctccgcgccaacccggtgcataagaaaaatccccgagcctgctgcacgacagcacgccccgttctgccaacccccctcgtcatccgcggaagtacctacaacgaaggcgtttccccggcggggcggcacccgggactaaccttcccccgcccgaacccttaaaaaacaccgccccgacagggcccccgccttttctggggccggaaactatcgttctcaccaaggaaaagttctttacgaaaatgggtaacactcccggttgcggggagaaacccctccgcgcggcggaatcggtctcactgccaccacgcgttctcccccaccacaagaagggcccccagaatctccctcccacaaaaaaacaaacaggggcgccccttataccaataccaaccccagcaaacccaccacagatggagatcccaaccccccaactaacttatccccacaacacacctacccccccc

SEQ ID NO: 69716 - protein, 101 aa, Zea mays
  misc_feature: Ceres CLONE 1548275
  misc_feature: SWISSPROT Homolog: EC 4.4.1.5 Lactoylglutathione lyase
MAEEKKQGLQLLDFWVSPFGQRCRIAMDEKGLAYEYLEQDLGNKSELLLRANPVHKKNPRACCTTARPVLPTPLVIRGSTYNEGVSPAGRHPGLTFPRPNP

SEQ ID NO: 69717 - DNA, 859 bp, Zea mays
  misc_feature: Ceres CLONE 1548277
  misc_feature: Encodes the peptide sequence at SEQ ID NO. 69718
caaaaccctaccttccaacacatccaaaccgcgatcacaactccacctacacaaaactgggactccccgcggtggcggccgctctataactagtggatcccccgggctgcaggaattcgtctcacccctagaaaaagtgcccatgaagtaccatccgagagatgttgattcaattaacgctgttatggccaagtcaaatgtggttattaacctcataggacgagagtatgaaacaaggaactacagcttcgaagaagtaaaccaccatatgcctgaacagcttgcaacaattgctaaagagcatgggggtatcataagatttattcaggtttcttgcctacgggcgtccccgtcttctgaatctacaatgttgacgacaaaagcttgcatgagagcaatcagtcttccaagaattccctgaggctaccatcatgaggcctggctcccctgaatttggcacattaaaaacccccactcctgaacagacggggcaccaatctccaaaaaaataggggggtttcccacccccccttttatgggggcgcggaacctttcaacaaattcaaaccccgcgcccttttaaaactaaatttttttttaatatccccttaagtagaaacatcccctcaaaagggaataccagttccctctacccatgggcgaaaaagaattaattaaaccctctgtaggggggccccaaaaacatttcacccccgcccccctaaaaatctttgccttaacccctttctattataaacaacatcatccccccgaaaaggcgccctaaaaatacgcaccccaataccccccccaccccccgctgcccgaaacgcggccattttctatccccccaaacggg

SEQ ID NO: 69718 - protein, 92 aa, Zea mays
  misc_feature: Ceres CLONE 1548277
MKYHPRDVDSINAVMAKSNVVINLIGREYETRNYSFEEVNHHMPEQLATIAKEHGGIIRFIQVSCLRASPSSESTMLTTKACMRAISLPRIP

SEQ ID NO: 69719 - DNA, 654 bp, Zea mays
  misc_feature: Ceres CLONE 1548280
  misc_feature: Encodes the peptide sequence at SEQ ID NO. 69720
  misc_feature (426)..(426): n is a, c, t, g, unknown, or other
  misc_feature (526)..(526): n is a, c, t, g, unknown, or other
tccccgcggtggcggccgctctattctagtggatcccccgggctgcaggaattcgtctcacccctagaaaaacttgagcacctgcagcgccgccagacactccgtagtctgtaccccaagcaccggcgcggcggcggcggctaccatggcagtcgggaagaacaagaggatctccaagggaaagaagggtggtaagaaaaagaccgtcgatcccttctctaagaaggactggtatgacatcaaggccccatcggtcttcagtgtgcgcaacattgggaagactctcgtgtccaggacacagggtaccaggattgcctctgatggtctgaagcacagagtctttgaggtttgtctagctgatcttcagggtgacgaggatcaggcttacaggaaaatcaggctccctgctgaagatgtgcaaggcangaatgtgctcacaaacttctggggcatgaattttaccaccgataagctcagatctctagtaaagaagtggcagacattgattgaagcccatgttgatgtncagacaaccgacaactacatgctgcgtttgttctgcatgggttttacccaagagcgcccaaaccaggtcaagagacctgctttgctcaagcatcccaaattcgccgattccccccagaatggtgaaat

SEQ ID NO: 69720 - protein, 169 aa, Zea mays
  misc_feature: Ceres CLONE 1548280
  misc_feature (11)..(160): Pfam Name: Ribosomal_S3Ae Pfam Description: Ribosomal S3Ae family
  misc_feature (94)..(94): Xaa is any aa, unknown, or other
MAVGKNKRISKGKKGGKKKTVDPFSKKDWYDIKAPSVFSVRNIGKTLVSRTQGTRIASDGLKHRVFEVCLADLQGDEDQAYRKIRLPAEDVQGXNVLTNFWGMNFTTDKLRSLVKKWQTLIEAHVDVQTTDNYMLRLFCMGFTQERPNQVKRPALLKHPKFADSPQNGE

SEQ ID NO: 69721 - DNA, 642 bp, Zea mays
  misc_feature: Ceres CLONE 1548282
  misc_feature: Encodes the peptide sequence at SEQ ID NO. 69722
  misc_feature (397)..(397): n is a, c, t, g, unknown, or other
cgtggatcccccgggctgcaggaatgtcgtctcacccctagaaaaatcttcgcatctggcacgagcagccaagcaaataaaagtagagcggcgagcgacgaccggcctgggccactctttcggccgagcgtagccagcaggtcgtcgtcgtcgtcgtcgtcgcagcacccggccggctagcatggccacaaggaggcagtggtggtggtggtgcctgctgctgctggcggcgtggtgctgcgccgcggccgcgcagtcgccgccggcggcggacccgctgcagagcaagtgccagggggacttcgggaagctgacggactgcatggactactcgacggggcacgcggagtcgccctcgttcacctgctgtggtgtgcaacatctctccaaaaagagngacccgagtgcctttgataaatcatcccgcaaaagaaaacggggcgcaacccggtgaaatcgctccgaacggcgcttccaccgaattatggggttatcccgccgccctggaaccctccccaattacaaggtattcggttttgaattcccccttgttaaaccttaaaaacaggggctccccggaataatcccccccttcccccaagaatctttccaaaaaaaattctttctcaacaggggggggaa

SEQ ID NO: 69722 - protein, 90 aa, Zea mays
  misc_feature: Ceres CLONE 1548282
  misc_feature (72)..(72): Xaa is any aa, unknown, or other
MATRRQWWWWCLLLLAAWCCAAAAQSPPAADPLQSKCQGDFGKLTDCMDYSTGHAESPSFTCCGVQHLSKKXDPSAFDKSSRKRKRGATR

SEQ ID NO: 69723 - DNA, 689 bp, Zea mays
  misc_feature: Ceres CLONE 1548284
  misc_feature: Encodes the peptide sequence at SEQ ID NO. 69724
  misc_feature (492)..(492): n is a, c, t, g, unknown, or other
ctccccgcggtggcggccgctctagaactagtggatcccccgggctgcaggaattcgtctcacccctagaaaaagcagcaccagttgcttcacggcttcatcatcactccactagccagtcagctactggcctacagctagccgcctcctctcctctcatcccatcccatctcatctccgacaagcgaagcagagcactggcatgagcatggaccgcatggcgcggcgttccgtgtccttgctcctcgctctggctctcctggccgccgcggcgtcggcggactcgtggctgtacgagaagttcacgacggagggcaacgtgcgcgcggactacaacgcgcaggggcagcaggtgacgtctctgatcctgacgcagcagtccggcggcgccttcagctcgcggcagaagtacctgtacgggggagtcagcatccagatgaggctgatcccgggcaactccgcgggccaccgtgacctccttcttacctgtcntcgggcgacggcccccggcaccacgagattcgacattgaagttcatggggaaaccccagcggggaaccccggggtgcctaacacccaacttgggggcccaccggccaccggcaaaaaggacccccatttctacctgggggttaaacccggcccccaaatttcccaccctaacccctatattgggaaaagaaaaaaaa

SEQ ID NO: 69724 - protein, 162 aa, Zea mays
  misc_feature: Ceres CLONE 1548284
  misc_feature: SWISSPROT Homolog: EC 2.4.1.207 Xyloglucan:xyloglucosyl transferase
  misc_feature (97)..(97): Xaa is any aa, unknown, or other
MSMDRMARRSVSLLLALALLAAAASADSWLYEKFTTEGNVRADYNAQGQQVTSLILTQQSGGAFSSRQKYLYGGVSIQMRLIPGNSAGHRDLLLTCXRATAPGTTRFDIEVHGETPAGNPGVPNTQLGGPPATGKKDPHFYLGVKPGPQISHPNPYIGKRKK

SEQ ID NO: 69725 - DNA, 655 bp, Zea mays
  misc_feature: Ceres CLONE 1548285
  misc_feature: Encodes the peptide sequence at SEQ ID NO. 69726
  misc_feature (400)..(400): n is a, c, t, g, unknown, or other
ccccgcggtggcggccgctctagaactagtggatcccccgggctgcaggaattcgtctcacccctagaaaaaggagacggtagacggaggagctagcttgccaattgccattgcactgcgcgcgcgcacctcacatccgccgccagcaggtgccaccgccatctctgctttctctctctctctctctctctctctctcaagcaacgcccgcctgcccgcccgccatggcgaccatagccacgatggccctgctgaagcccgccaggatcgtggcgcggtcggcgccgccgtccaccagcggcagcgtctcgctgcgcgtcccggcgcgggccaagaaggccgcggtgtccgtgtccgtgtcgtccgcgctggcgggcgccttcttctcggcgctggcgtncccccacgcggcgctggcggcgcagcgcgtggcggacgtggcggcggcggccgacgccgggagcgacaaccgagggcagctgctgctcttcgtggtggcgcccgccatcgggtgggtgctctacaacatcctgcagccggcgctgaaccagctcaaccgcatgcgcagccaggccgtggtcgccggcctgggcctcggcgccgccgccgccgggatggcggccgcgcccgaggcctccgccgccgccgcggcgca

SEQ ID NO: 69726 - protein, 143 aa, Zea mays
  misc_feature: Ceres CLONE 1548285
  misc_feature (59)..(59): Xaa is any aa, unknown, or other
MATIATMALLKPARIVARSAPPSTSGSVSLRVPARAKKAAVSVSVSSALAGAFFSALAXPHAALAAQRVADVAAAADAGSDNRGQLLLFVVAPAIGWVLYNILQPALNQLNRMRSQAVVAGLGLGAAAAGMAAAPEASAAAAA

SEQ ID NO: 69727 - DNA, 905 bp, Zea mays
  misc_feature: Ceres CLONE 1548287
ataagagcctcgatcgaccaccccaacccgtatgctcgccatacttcattaccatacccggaaggggccctgcggaggcggccgcttttataactggtggattacccgggtctgcaggaattcttctcacccctagaaaaaaggctccatcagtacggatccaccgctaccaccaccaccaagcactccagtcccacaacagcatggccagcagcgcgttccgccccgctatcctcttggtgctcctggcgccgtcaccgctacttggtgcgacttctattgccgttcctgggccggctttatctaccggctccggtgccgcccgtgtccgacgtagactcctccctatggacgataccgtacgcccttaacgacgagcagcctaacctctgattcctggccgcctgttgcaccctccttatccctggtataggggtaatcaaacagcgcacagtgaaaagaaaaaatctgtcattagtgtatgaacccccccacgggggccgatcgcaataagacttacacctactcgataaacatatacccggccgcaagctcactactaaatgagacactttccgccccccctcccaatctgtaaaataaccccgttatggtggtgccgaccttacttagaccgttcttagatattaccacgattccctccgcccccatcgttctcaaactctacgcctacatgaagatttccgtcgggtcaaaacgcaaccacccaccgcagattgacacccaccggctccccttatgagagacgccatcataaagttctccgagattacgtagcccaataataaaggcgaaccaccctcaacaatattcactccccaacgcgggccgcatatttttgccacaccccgcttgaacttaccgccagcgtccgatacccctcg

SEQ ID NO: 69728 - DNA, 732 bp, Zea mays
  misc_feature: Ceres CLONE 1548293
  misc_feature: Encodes the peptide sequence at SEQ ID NO. 69729
  misc_feature (267)..(267): n is a, c, t, g, unknown, or other
  misc_feature (276)..(276): n is a, c, t, g, unknown, or other
ggcggccgctctagaactagtggatcccccgggctgcaggaattcgtctcacccctagaaaaagtgcgtgcagctgcatgtggccatcctgcgattgccatgtgtttaatctccgggtcacaggtgttgtcgatgatccaccactagtagtagcgattgcatggagattggtgctcgggtcaataatgatggtgattgtgacggagtgccctgcaaaataattaataattcgtgtgaaaaagttgattatatggttcctgacactcngcgtcacgncctccgcccccttcttccgtgaacccccagacttcactaccgggaaagtaagccttacactcccatccggcccccccccagggtgcaaaagccttttcgtaattattttctccgggcccccccaccccccaggtcgccccacccaaaatccttttgttaaacttttttttagaagggggggatggggggggttttttctttcagaaaaaccctccaatcttcgaagggcgggggtcttaaaaaaaggctgggatgaagtaacttttttacctttggcagctataatttattttggttaaccaaggctttccacagggaaaaattttgggccgccccaccctttcgttttttcggtgtgccccccctctcaccaagtttattctcacgcttacctcagggggggttttaaaccccacttttaaggccctctctggagggtttagccgggaatattcc

SEQ ID NO: 69729 - protein, 47 aa, Zea mays
  misc_feature: Ceres CLONE 1548293
MWPSCDCHVFNLRVTGVVDDPPLVVAIAWRLVLGSIMMVIVTECPAK

SEQ ID NO: 69730 - DNA, 737 bp, Zea mays
  misc_feature: Ceres CLONE 1548296
  misc_feature: Encodes the peptide sequence at SEQ ID NO. 69731
  misc_feature (469)..(469): n is a, c, t, g, unknown, or other
  misc_feature (737)..(737): n is a, c, t, g, unknown, or other
atacgtttgtgcagccccaaaccaaccctctttcccccgaacattatgtcaaaaacgaaacacagaactcccctcggcggcggtcgctcattacctagtggatcccccgggctgcaggttttcgtctcacccctagaaaaaaaaaaccctagctccaaaaaacgaactagaaacgaccgcgaagccacaggtcgaaggcggcggcggcgatggggagcgacacggagacggagaagaaggcctcggtggcgctgatgtccatcgcgaaacccctcgctggaaagaagctctgcaagcggaccctcaagctcgtgcgacgagcctccgaggcgaagtgcctcaagcgcggagtcaaagaggtagtcaagagcattcgccgcgggaacaaaggattgtgtgtgatcgctggaaatatttctcctattgatgtgattacacctgttccgatactatgtgaggaatttttttnccccccacatatatgttcccttcaaagaggatcttgcgaccgcaggaaccactaagaaggcccacttgttgcgttcttggttctgaccaaaccaaacaaaggggaacttcattggagaggtgaaggaacaaattaaaatcggtacctttaacccaatttggtaacgggaaagtcccttgaagcctcccttctgcctattgttttcttgcgggacccaccctttattttggaaaaaccccgggcaaaattcccccttggttccacgctn

SEQ ID NO: 69731 - protein, 104 aa, Zea mays
  misc_feature: Ceres CLONE 1548296
  misc_feature (87)..(87): Xaa is any aa, unknown, or other
MGSDTETEKKASVALMSIAKPLAGKKLCKRTLKLVRRASEAKCLKRGVKEVVKSIRRGNKGLCVIAGNISPIDVITPVPILCEEFFXPPHICSLQRGSCDRRNH

SEQ ID NO: 69732 - DNA, 937 bp, Zea mays
  misc_feature: Ceres CLONE 1548298
  misc_feature: Encodes the peptide sequence at SEQ ID NO. 69733
  misc_feature (499)..(499): n is a, c, t, g, unknown, or other
  misc_feature (937)..(937): n is a, c, t, g, unknown, or other
taaatactcagtacatcttcaccaaacgaccacaaccacacacaaaaactcaaacccccacacaccccggaggcggaccctctataatagtggatcccccgggctgcaggaattcgtctcacccctagaaaaaaccacacacccacacccccgcgccatggcctctcctcccccgacctccctctcctccccccacctcatccatctccgcctccaacccctatccagcgtcccgtcgctccacctgactaccctccccttcctgcgctcactcccgcttcatcgtcactagcttccgtctcaaccgaaatacacctcctgtaccctaactgctcgccctctatccagcagccacaagcgaactccctctataagccgcgcgcgaaagaaccaccccacccccccccccgggcctaggtagacggaataaaggggggaaaaaagcctatgcggccacttgattaagggtcgaagggtcgttatgttaatgggcggccanacccccctaggtaaaaaacatgaaaggcgaaggccccctcgcttatcgcaccctaagattaaaaacacatcgaaacacgaaacacatcccgaaaaatgtcctgttatagatactctgatctcttttcccctcctgtcatacactgccggtgcgatatatccgctatcatccccccgggcgagtaaagaaaacagaatccgctatgtttatatttgtgtcgcctttttaacatgagaccgccctcccagggatgctaacccgaggtcgacgtactcatcataaccgacatactcggatgaatctctcttaatgccggggtaccctattaaatccgccgctcgcaccgcacatattaattgtcttaccgccaagccgcgggccggtattgtatacccaccgcccgctattactatacacctttatatgcgatccgccccn

SEQ ID NO: 69733 - protein, 44 aa, Zea mays
  misc_feature: Ceres CLONE 1548298
MASPPPTSLSSPHLIHLRLQPLSSVPSLHLTTLPFLRSLPLHRH

SEQ ID NO: 69734 - DNA, 815 bp, Zea mays
  misc_feature: Ceres CLONE 1548299
  misc_feature: Encodes the peptide sequence at SEQ ID NO. 69735
ccactatcttctttcccctatccccccctcgttattttccccccgcccttaaaataaaacaccccccgcggtggcggccgctctttactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatggccgccacctcccgcatcgtcgcggccaagacgccgattcttggccagggtcgcgccgcagacgacgccgccaatgcccgccccctccgccacgtcgccgccaccatccgctggcagcccgaccatcatgggcaacgatccgcggtacccgcccggaccggatcacgcacttggggccccttctccgcccagaacgccctcgccccttgaccccgctagattttatggcgacttccgcctcggtacaccgtccaaggctgaccccgctgacccgagaggccgttcccgccccaaaaaggggcgtttcgcaggtttaatcttcttctattgttgcccccacaccttgggaccccaatgggcacgtcattaactcccaggaaggcggctaacactcaaatagggatgcccccctcggacacatcagtgaacaccccgtgtatggatcccaaggcccccgctggcccaaaaatcctctttccgacagggggtggttcccaaaatacctgtggacaagctgcacatgctcggggacacacgtgtccaaaagtagtcttttgcacaagaaagccaaggccttcccaag

SEQ ID NO: 69735 - protein, 75 aa, Zea mays
  misc_feature: Ceres CLONE 1548299
MASTIMAATSRIVAAKTPILGQGRAADDAANARPLRHVAATIRWQPDHHGQRSAVPARTGSRTWGPFSAQNALAP

SEQ ID NO: 69736 - DNA, 763 bp, Zea mays
  misc_feature: Ceres CLONE 1548300
  misc_feature: Encodes the peptide sequence at SEQ ID NO. 69737
acccgcggtggcggccgctactccaatagtggatcccccgggctgcaggtattcgtctcacccctagaaaaaaacacccaatggcatcacgaatgtggaacctcaaagccctggtcacctcactactctgcatctcggcgttgtcgtcgtcgccatggccatgcacggcagccggtcagctgggcggcaagcccctggtcaccgccgtcaccaaggacgcgtccacctccctctacacggcgccgctcaaggacggccacccgctcgtcctcgacctcactagcccggtcatctcgctggccacgtgcgcctcctcctccaagaacaacaacggcacgctcaccgtcacgctatccgccaacgccaccgacggcccagaacccgctgttcccgggtctcccttctcggcggggggccaacttgcgcggccggtccttcaaagctggcccgccgggcgcccgggcccagtccggggtttccggggggtttggcgcccttcctccaagcaaccaggcaagtttgcttccgggggccaaggggggcgcccacccccaaaaagggcccccaaaaaaaggtgccccctttgtgccctgccccacgtgaacgggcagggtgtcaacttccgggggaaaaagaaggtcggtggggggcccatacttttggggcggggaggcccccttttatttttatttcccctccgcggaagatggggggggaaacatctcctcaccaaaattgtcgggtgggggggccgctgctcccc

SEQ ID NO: 69737 - protein, 223 aa, Zea mays
  misc_feature: Ceres CLONE 1548300
MWNLKALVTSLLCISALSSSPWPCTAAGQLGGKPLVTAVTKDASTSLYTAPLKDGHPLVLDLTSPVISLATCASSSKNNNGTLTVTLSANATDGPEPAVPGSPFSAGGQLARPVLQSWPAGRPGPVRGFRGVWRPSSKQPGKFASGGQGGRPPPKRAPKKRCPLCALPHVNGQGVNFRGKKKVGGGPILLGRGGPLLFLFPLRGRWGGKHLLTKIVGWGGRCS

SEQ ID NO: 69738 - DNA, 688 bp, Zea mays
  misc_feature: Ceres CLONE 1548301
  misc_feature: Encodes the peptide sequence at SEQ ID NO. 69739
tcccccgggctgcaggaattcgtctcacccctagaaaaaacaccacagctcccacacacagcaggcagcagctcgatcgctagctcctccgaaccggaaagccaagcccgctttggcgatcgtgcttgcttgcttggttccttcaattcctgccggagccagcgagagctagctgctgctgtcgcgtggtagacgtcgtcttgccagcgagagcctagctcgatcggtctctctggtacaacgtagggagaaagatcgagggggagaggacgacgacgatggccggcgcgaccgtgaccgaggaggaggtgaggaagggccagtgctccaccggccccgccaccgggctggcgatcggcaccccccccccctgccaacttgtgtggaccaggaccgaatacccgggactactactttccggaattcccaggaggggaggcaccttacctgaccctctaggacgaaatttcaacaggaagttgcgaccaaggccgaagaatctcggaaagcggtttcttggtacctggacggaagggaattccccggggttgaaaaaccccgacgctttttgccgcgttactttgtcggcctttccctggaaataatcggccaggacctttttttttttatgcgatagccccccaaatttttgggaaacgggcgggagttcctctaatggcacccccgg

SEQ ID NO: 69739 - protein, 108 aa, Zea mays
  misc_feature: Ceres CLONE 1548301
  misc_feature: SWISSPROT Homolog: EC 2.3.1.74 Naringenin-chalcone synthase
MAGATVTEEEVRKGQCSTGPATGLAIGTPPPCQLVWTRTEYPGLLLSGIPRRGGTLPDPLGRNFNRKLRPRPKNLGKRFLGTWTEGNSPGLKNPDAFCRVTLSAFPWK

SEQ ID NO: 69740 - DNA, 679 bp, Zea mays
  misc_feature: Ceres CLONE 1548302
  misc_feature: Encodes the peptide sequence at SEQ ID NO. 69741
tacccgcggtggcggccgcttctgtactagtggatcccccgggctgcaggtaattcgtctcacccctagaaaaatacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcgggcaaggggaaggaggtgctcagcggggtcgtgttccagcccttcgaggagatcaagggggagctcgccctcgtgccccagtccccagacaagtcgctcgcgcgccacaagttcgtcgatgactgccacccccccctcaacgagcagatcaacgtggagtacaacgcctcgtatgcataccactccctcttcgcctacttcgaccgcgacaacgtggctcttcaaggatttgcccagttctttcaggaatccaccgacgaggaaaggggaccacgctgaaaaagctcatggagtaccatacccaacctgggaggcagggtgagggttccaatcaattgtgaccccttttaaccgagtttgaccaccctggaaaaaaggagatgcctcttgtaccccttatgggggctg

SEQ ID NO: 69741 - protein, 139 aa, Zea mays
  misc_feature: Ceres CLONE 1548302
  misc_feature: SWISSPROT Homolog: EC 1.16.3.1 Ferroxidase
MLRVSPSPAAAVPTQLSGAPATPAPVVRVAAPRGVASPAAGAACRAAGKGKEVLSGVVFQPFEEIKGELALVPQSPDKSLARHKFVDDCHPPLNEQINVEYNASYAYHSLFAYFDRDNVALQGFAQFFQESTDEERGPR

SEQ ID NO: 69742 - DNA, 675 bp, Zea mays
  misc_feature: Ceres CLONE 1548305
  misc_feature: Translation starting site: 156
gctcttaactagtggatcccccgggctgcaggaattcgtctcacccctagaaaaaacctgagtacctgacacacagcgaaacgccgaaaccgcgtcaagttccccttcttcgatcccccaatcgccgtaaccctagactcgccaccgccgccgcgatgctccgctcgccgggcaattcgccccgcctcctctcaccgtcgcccacacccgcgccctccacccctcgcccggcctccccgcccccctccaacgccccctcctcgaagcgccgccggtcggaggtgctcgacgaggacacctacgtcgccgccatcgagcgcatcatcgagcgcgactactttcccgacctgccccgcctccgggaccgcctcgactggctgcaggccgtgcggtcccacgacccgctcatcctacgggacgcgcagctcaagatcctagaccgttgcagccgcgcccagcgccacgcgggggggttccgtccccccggccgaagccgggcaactccaagggcgctccggttcccccgtccttttttaaacacccccccgcaaggaaccagtcacccgcgggggggtggggagggtgttctgacggcccgaccaagcgaataaccgaagttccggcgggcttgtggggccattccccggggacagggcttcttttccccaccccgct

SEQ ID NO: 69743 - DNA, 665 bp, Zea mays
  misc_feature: Ceres CLONE 1548306
  misc_feature: Encodes the peptide sequence at SEQ ID NO. 69744
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
gcggtggcggccgctctataactagtggatcccccgggctgcaggaattcgtctcacccctagaaaaacccaccctgctgtctccctccctccttccttccttccccgccactgcgcagcgcgagtgcggcgacagccagtcacacactcacactccctcgaccgctctcggccccgtccgcgtcgccgcagggcgaggaggcaatggcggcgggcgggaatggcgccggcggggacaccagggcggccttcgcgcggatctacaagacgctcaaggaggagctgctcaccgacccggccttcgagttcaccgaggagtcacgccagtggatcgaccgcatggttgactacaatgtactcggaggcaagtgtaaccgtgggctctctgtggtcaacagctacaagctgctcaagggcgctgatgctctgggcgagggagaaaacgtccttgcttgcaccctcggctggtgcattgaatggcttcaggctnnntcttctgtgcttgatgatatcatggatgactctcacactcgtcgcggccagccttgctggttcagggggcctcaggtgggcttaattgctgcgaatgacgggatcttcctttcgaaccctatttaccggatcttccggggcccctttagggcgaaactttacttggcttatct

SEQ ID NO: 69744 - protein, 153 aa, Zea mays
  misc_feature: Ceres CLONE 1548306
  misc_feature: SWISSPROT Homolog: EC 2.5.1.67 Chrysanthemyl diphosphate synthase
  misc_feature (96)..(96): Xaa is any aa, unknown, or other
MAAGGNGAGGDTRAAFARIYKTLKEELLTDPAFEFTEESRQWIDRMVDYNVLGGKCNRGLSVVNSYKLLKGADALGEGENVLACTLGWCIEWLQAXSSVLDDIMDDSHTRRGQPCWFRGPQVGLIAANDGIFLSNPIYRIFRGPFRAKLYLAY

SEQ ID NO: 69745 - DNA, 609 bp, Zea mays
  misc_feature: Ceres CLONE 1548308
  misc_feature: Encodes the peptide sequence at SEQ ID NO. 69746
  misc_feature (609)..(609): n is a, c, t, g, unknown, or other
tccccgcggtggcggccgctctagaactagtggatcccccgggctgcaggaattcgtctcacccctagaaaaaggagcactcaccactcagcagcgatcgcagcaccgcggcgagataatgagcagcagcctgtcctccggcatctctgcctcgccatctgcagcggccagcaccgctcggcgccgccatgacgcagcgccgcagcagctgacgagggtgaaggcggcagcgcggccacagctgctgcacgccggccgccggcgttcgagtgtcgggaggaggccgggcggcggcccggtggtggtgaggggccgggcctgggcccactgttcggagaatcaagccgggacctggaagaaggacgcccatccaccggtgtaccggcaccaaacgggcttcaagcccggaaggaactttccaacctacggggaaaataatggacgggaaaccccaccccccaatttttccaaaaggggcccaaaaaaaaaaaaaaagggggcctttcccgggggaaggggaatgttctcccccgaaaggggggtaaccccaaagaaaaacccttgaaacccccccccccctcccgaggggggcttttttattgaggggcn

SEQ ID NO: 69746 - protein, 187 aa, Zea mays
  misc_feature: Ceres CLONE 1548308
PRGGGRSRTSGSPGLQEFVSPLEKGALTTQQRSQHRGEIMSSSLSSGISASPSAAASTARRRHDAAPQQLTRVKAAARPQLLHAGRRRSSVGRRPGGGPVVVRGRAWAHCSENQAGTWKKDAHPPVYRHQTGFKPGRNFPTYGENNGRETPPPNFSKRGPKKKKKGAFPGGRGMFSPERGVTPKKNP

SEQ ID NO: 69747 - DNA, 693 bp, Zea mays
  misc_feature: Ceres CLONE 1548313
  misc_feature: Encodes the peptide sequence at SEQ ID NO. 69748
  misc_feature (393)..(393): n is a, c, t, g, unknown, or other
  misc_feature (401)..(401): n is a, c, t, g, unknown, or other
  misc_feature (467)..(467): n is a, c, t, g, unknown, or other
  misc_feature (552)..(552): n is a, c, t, g, unknown, or other
ctctccgcggtggcggccgctctagaactagtggatcccccgggctgcagggaattcgtctcacccctagaaaaaaacaccgtcttcctctgttttgccagggccaacgccattacctagaagtctagaagagaggtggaagaaggcagagacgagagggtttaaggaattcggggggagagagagaggcagggcggtgacgagcttggactggcgatcgcgggagcgatgacgacggcggccggcatgccggagtcgccggtgggctcggccgcggcggctggcggtcccgcggcgcccgaggtggcggccatggacgcggtgatcgggtggttccgcggcgagttcgcggccgcgaacgcgatgatcgacgcgctgtgcggcccctgccanattttgcnggggggggggggggggggcccaaatataaacccccgtttttcgccggggctccaccggccgcccgngccatactggttcccccgtcctccaccatgccagaagtttctacccccgtttgcgggacgtccaacgcccgagcctgcgccggcngtcggggggccgccccgcgcccgcccgcgggggccctgcctgctactcccgaaaggaagaaaggccccgtcccccggtccatccacgattcccatgggaaagacctcccccttctgaagcgggaccccgatacccaggccc

SEQ ID NO: 69748 - protein, 146 aa, Zea mays
  misc_feature: Ceres CLONE 1548313
  misc_feature (55)..(55): Xaa is any aa, unknown, or other
  misc_feature (58)..(58): Xaa is any aa, unknown, or other
  misc_feature (80)..(80): Xaa is any aa, unknown, or other
MTTAAGMPESPVGSAAAAGGPAAPEVAAMDAVIGWFRGEFAAANAMIDALCGPCXILXGGGGGGPNINPRFSPGLHRPPXPYWFPRPPPCQKFLPPFAGRPTPEPAPAVGGPPRARPRGPCLLLPKGRKAPSPGPSTIPMGKTSPF

SEQ ID NO: 69749 - DNA, 666 bp, Zea mays
  misc_feature: Ceres CLONE 1548315
  misc_feature: Encodes the peptide sequence at SEQ ID NO. 69750
  misc_feature (432)..(432): n is a, c, t, g, unknown, or other
  misc_feature (440)..(440): n is a, c, t, g, unknown, or other
ctccccgcggtggcggccgctctagaactagtggatcccccgggctgcaggaattcgtctcacccctagaaaaacgcagccggaggtcgccggtcgccaccaccaatggggccacccgccatggcgttccaagccctcaccctcacgccactccccttctcaatcgacagctcgagccgccgcgtccgcgtgcttgccgttgcggccgaccagactcctcaggccgcccccccttcggagccggcgaacaggcctagccgcctccttcgcgagctcgcgcagcggaagaaggccgtatccactaagaagaagcatccgccgcgtcacttcatcctgaagccacctctcgatgacgagcgccttacccggaagatctgcagcagcccgcagctgtcgctcaaggcgctcacgatgatctctgcaatgctcccntcgcgacngctctccacggccgaggggacctggatggactagtacctcctcgaggacaaactaggggcatcgggtaccccctccaacccctcggaaaagctccgtcaaaggcaaataattcccccccaatttttttccaaaggcctttgtttacccccggtttcccaaatttggaaaccccttttggggggccaaaaaaaaattggggaaacaaagagaaaagggccccccccc

SEQ ID NO: 69750 - protein, 122 aa, Zea mays
  misc_feature: Ceres CLONE 1548315
  misc_feature (112)..(112): Xaa is any aa, unknown, or other
MGPPAMAFQALTLTPLPFSIDSSSRRVRVLAVAADQTPQAAPPSEPANRPSRLLRELAQRKKAVSTKKKHPPRHFILKPPLDDERLTRKICSSPQLSLKALTMISAMLPSRXLSTAEGTWMD

SEQ ID NO: 69751 - DNA, 656 bp, Zea mays
  misc_feature: Ceres CLONE 1548317
  misc_feature: Encodes the peptide sequence at SEQ ID NO. 69752
ctccccgcggtggcggccgctctagaactagtggatcccccgggctgcaggaattcgtctcacccctagaaaaaggacccgttcaaggagccgatactgagcacggccaactccgtgctgtccatcctggccgccgactaccccgtggagcgcaacacgtgctacctctccgacgactccgggatgctgctcacctacgaggccatggcggaggccgccaagttcgccaccgtctgggtgcccttctgccgcaagcacggcatcgagccgcgcggccccgagagctacttcgacctcaagtcccacccttacatgggccgctcccaggtagaactcgtcaacgaccgccgccgcgtgcgcaaggactacaacgagttcaggggcgcatcaacgggctccgacacgactttcagcgaagtcccaacccttaaaacccccccagggggctccaggaccggaaacccagggcaacctggatggcccacggcccccggtgggagggccccttgggccagcccccccaaaaacccccccgggggaaccccccccggttttttttgtgtttttttaaaccccccaaacccaaacctttattttttcccccccggggaaccttaaaaaccccctgaattttaaaatgggagaacacccccccc

SEQ ID NO: 69752 - protein, 144 aa, Zea mays
  misc_feature: Ceres CLONE 1548317
  misc_feature: SWISSPROT Homolog: EC 2.4.1.12 Cellulose synthase (UDP-forming)
MLLTYEAMAEAAKFATVWVPFCRKHGIEPRGPESYFDLKSHPYMGRSQVELVNDRRRVRKDYNEFRGASTGSDTTFSEVPTLKTPPGGSRTGNPGQPGWPTAPGGRAPWASPPKNPPGGTPPGFFCVFLNPPNPNLYFFPPGEP

SEQ ID NO: 69753 - DNA, 608 bp, Zea mays
  misc_feature: Ceres CLONE 1548319
  misc_feature: Encodes the peptide sequence at SEQ ID NO. 69754
cggccgctcttttctagtggatcccccgggctgcaggaattcgtctcacccctagaaaaactgcttccatttgcactccccgtcgtgtggcttcctccctcttcctccggagctgctatattttgagacccagccgggaaagcggaggcggagactaccgaccccaccacgagccccccggaattctcgcgaatcacataagctccctagccgccggcgagcactcgtgcgctcccctggaagcggcggaggccgcagccgagcccgcctctctgccggcgccggcgatgggcaactcactggggtgctcggattccggcgagcggctcggctcggcggcccgcgacggggacgccatcgacgcgcggatgctgctggagctcagccccgcgctcgcgcgctactccaccttcggcgggctctacactccgctacacttcgccgccgccaatggccatctcgacattgtcacgatgctgctggataaaggcgctgacgttaacgcgcgctactactgcggccagactgcgctgatgcatgcttgtccgcatgggcactgcgatgtggtgcagatgcttcttctatttagatgcaatgttactagggca

SEQ ID NO: 69754 - protein, 107 aa, Zea mays
  misc_feature: Ceres CLONE 1548319
  misc_feature (44)..(76): Pfam Name: Ank Pfam Description: Ankyrin repeat
  misc_feature: SWISSPROT Homolog: EC 2.4.2.30 NAD(+) ADP-ribosyltransferase
MGNSLGCSDSGERLGSAARDGDAIDARMLLELSPALARYSTFGGLYTPLHFAAANGHLDIVTMLLDKGADVNARYYCGQTALMHACPHGHCDVVQMLLLFRCNVTRA

SEQ ID NO: 69755 - DNA, 661 bp, Zea mays
  misc_feature: Ceres CLONE 1548321
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaatagaaaaaatatatctggatctccacatagaagacaagtggactctgcaacttcctcggtgccatagatattacagggaggtccaaactgagcgtatctgagcgaacaaaacatcagcccccctacatgtttcatctatatcacgaagttgcagatatgtggtaactatcaaaaggatttaccgtacctgggccagtgttttcgccttcaccatacctgcccattgtcagtactatttcctagatttggagtagtcccgtagctaatcctcttccctgcggaggtgatgggattttatgttgtattgatgttgtcaacaatgtcgttcttagccatgaattgctggttccactgtaagcaccgctggatgtttatcgctttggctgtttttctgctgttcataactgagttaaagatttgtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagct

SEQ ID NO: 69756 - DNA, 606 bp, Zea mays
  misc_feature: Ceres CLONE 1548324
  misc_feature (196)..(196): n is a, c, t, g, unknown, or other
  misc_feature (211)..(211): n is a, c, t, g, unknown, or other
gttcccgcggtggcgggcgctctagactagtggtcccccgggctgcaggattcgtctcacccctagaaaaaacgcatcgcctcgccgctgttccccgcaacctatcgacccaatctcgtccgacccggcgcgtcgtcccctccagatctccgtcgccctctcccagtagcagatactgttctgctgcagtctgacnaagtggagggcttangagcttctgctgcttttatgtctgaaccatcttttgcttatttgggatggttggagagtactctcgtgcacctagaaaaggcaaaaggtccgtcccactgcatgcgtcaagaaccggcgggttttcttgttcggaattgccattgccggggcccaagcccgccttgtttcccccaaaggatccgcccccccccctgttggggaatttttgccccccgaatatccaccttaaaaattctttcccaaaaggggcccacaaaaattgggggcttaaaaggggggtatgccctttcccggggaaaaaagcccccaaatgtttcccccaaaaaaagggcccgggtaaggggttaaaaaaaaattttggggaaatgggggaaaaaacaaaaaaccttttgc

SEQ ID NO: 69757 - DNA, 712 bp, Zea mays
  misc_feature: Ceres CLONE 1548325
  misc_feature: Encodes the peptide sequence at SEQ ID NO. 69758
  misc_feature (302)..(302): n is a, c, t, g, unknown, or other
ccccgcggtggcggccgctctagaactagtggatcccccgggctgcaggaattcgtctcacccctagaaaaaatcaatttctcggcaggcgacttcaattcctgggaatctgtggaagcaaaatcgaagcatgccaaaaacacttgaaaagtaccaaaaatgcagttttgcagggcctgaaacagcactccagaatagagagaatgagcaactgaaaagtagccgcaatgagtacctcaaactgaaggcacgtgttgataatttacagtggactcaaaggaacttgcttggtgaagatctcnagtgattaggcataaaagagctggagcacctggagaagcagctcgattcgtccttgaagcacataaaatctacaagggtactgaaaagtgctaacaccataaacgaaatgtatttcccgctttaaaggaagaaggacatggaatattttaagttctcccctttcgtaaaaccggggccgcctacttttcataaaggggtcactgcctccctgaatttccttaactaccaaccctctttctcactaaaagcatgaaaaaaactgaatttggggcgggggagtcaagcttttcccaacatataaaaaaagaaaactgaaaccccccccggaggcctccccatttcgcccccccataaaagaatgtaggtataaaccccccgccataactgtgggcaactccgttctataaaa

SEQ ID NO: 69758 - protein, 57 aa, Zea mays
  misc_feature: Ceres CLONE 1548325
MPKTLEKYQKCSFAGPETALQNRENEQLKSSRNEYLKLKARVDNLQWTQRNLLGEDL

SEQ ID NO: 69759 - DNA, 663 bp, Zea mays
  misc_feature: Ceres CLONE 1548331
  misc_feature: Encodes the peptide sequence at SEQ ID NO. 69760
  misc_feature (162)..(162): n is a, c, t, g, unknown, or other
  misc_feature (168)..(168): n is a, c, t, g, unknown, or other
gccgtccagcaacgtccatatagaactagtggatcccccgggctgcaggaattcgtctcacccctagaaaaatctgtagattcggttttgttgtccatgtgctcagatgggaacttgagattgtatgaatttgagatatggtgatatgagctgatgattttntctttntcaaacaaaaaaaaaaaaaaaaaaaaaaaaaaaaaaaaaaccgagaccctcgaggtacccaattccccctatagtgagtcgtattaccccccctcactggccgtcttttaacaacgtcgtgactggaaaaaccctggcgttacccaacttaacccccttgcagcacatccccctttccccagctggcgtaatagcgaaaaggcccgcaccaatcgcccttcccaacagttgcgcaccctgaatggcgaatggaaattctaaccgttaatattttgttaaaattcgcgttaaatttttgttaaatcagctcatttttttaaccaataggccgaaatcggcaaaatcccttataaatcaaaagaatagaccgagatagggttaagtgttgttccactttgaaacaagatccactattaaagaacgtgaactccaacgtcaaaggccaaaaaaccgtctatcagggcgaatgcccactacgtgaaccatcaccctaat

SEQ ID NO: 69760 - protein, 41 aa, Zea mays
  misc_feature: Ceres CLONE 1548331
  misc_feature (3)..(3): Xaa is any aa, unknown, or other
  misc_feature (5)..(5): Xaa is any aa, unknown, or other
MIXSXSNKKKKKKKKKKKTETLEVPNSPYSESYYPPSLAVF

SEQ ID NO: 69761 - DNA, 646 bp, Zea mays
  misc_feature: Ceres CLONE 1548333
tccccgcggtggcggccgctctagaactagtggatcccccgggctgcaggaattcgtctcacccctagaaaaacctagaaaaaatttcaaaccactcttcgcccccttcctctcctctcatccccttcccccctccactctctcgtgtgtggtctcgcccctgaggttcctgatcgcaccatctccctccggcgacagtccgccgccccgccccgcgcgctcgacgaggccgctccgggtggtgaagaggtgagtgtcctacttgtgattcgcccagagattggatccggtcgtccgctgcatagcatgaatcctccgctgaggggggaaccgttttgagagatgggtgagggtgttgtctcagcttcctgtttagcgctgtggaaccgttgctctgggggtgctgctgcagtgtctcccctctcgctatgagtagtgctgtgaaggaccagctacagcagatgtcgacgacgtgcgattctctcctgttggagctcaacgtgatttggggatgaagtcggtgagcccgacatggcgagggaccggatgctgctggagctcgagcaggagtgccctcgacgtctacaagagaaaggtcgaccaggccaatcgatgcagggcccagttgcggcaggccattgcggaa

SEQ ID NO: 69762 - DNA, 1148 bp, Zea mays
  misc_feature: Ceres CLONE 1548339-R
ctcgagcgtctcgtttttttttttttttttcgaatagaggaaattaatttaatatgtatactatgtgcaccacaaagattcatggacacttataccataagccccttccaaaaaaataaaagtaaccgaaaacgaaaacatgtatcttttttatgtaaagtttgcatgcattcgctgcgaatttgtctatcggtgagactaattccggcgccccggggggatccactccttctagagcgggcgcgaaaagaatggaactccagctactgtaccctttagtgaggggggagggggcgcttggcgtaatcccgggcggagctgtttcctgtgagagaggggacccgcgtctaattcccaactatttatcgaggcggaagcacaaacggcaaaggggtggggtggctaatgaaacaaccctcacccacattatagtgcagttgcgactggctgcgtggctgtggcgagcggggaaaaccagggtgggggggagcggccgtgtaaggcaatccgtgcacacccacttggggaataatggccggtctctgccgggattggggggagcctctgtcccgcccctcccattggttgtggctggaacgatggccatgccgccgggtgtgtcctctgtcgggcggttgttaagggagaagtgcaggttaatcaattgtcggtaaatctcttgatgtgggcccccggttagttctagccctggtttatatacctctcactcatatactcttacgaggggcgactctctcgtgtgagtggtttaaccgagtaatttgtgtggttgggtcctcctaagaagagtgctcctcgagcgggaggtgcgcgcaccgggcaaccaccccacatagatagtcatgggatctcgtcttacgcccccggagcagtggtgtaaccacattttggtagtcctcgactctggggcggtctgagagagggtcgattaatagactgggagttggaacgtactgggcatatgcgcgatcgggtggggcgagcgagaaacccgccacccgccgacctactactaatagggagtcgtggggtgggaggttgttcactcgtttactaacccctcccccagagggtcgtgcgttgcggtgtggtcccccgccactgtgttgtttgtgtagtgtgttgtg

SEQ ID NO: 69763 - DNA, 639 bp, Zea mays
  misc_feature: Ceres CLONE 1548339
  misc_feature: Encodes the peptide sequence at SEQ ID NO. 69764
tccccgcggtggcggccgctctagaactagtggatcccccgggctgcaggaattcgtctcacccctagaaaaattgctggatggtgaacctgttggtggcgggcggggcccatgtggcggcggaggaggtggatgattcggccgcgaaggtgagaatggctcacgggtccctctctctatttctgacgtcgaatccaatgaccacagatcgctccctgcttgtggatgctgctgtagttaattcgctcgcagccgtccctcctgctgactacttttaacacatgaatacgcatgcttctgtatgttctgaacaacatcgtaactattgatatgttttctactgtctgacgattgtatcataatcacaatgccgtttatgtaccgccttatttacctgtagattcactctgggatagcacaaaaaacaaaacgacacgctcgaggtacccaattaaccctatagtgagtcatattagtcgcgttcaatggcacgtcgttgttcaacatctgtgattggtaaaaacagatggcgcttaccaagctgaaatttcccttgaagatgcatcaccccttatcgcccagattggccttttgatcggaagatggcccttttgccaaataagccctttcccaaaaata

SEQ ID NO: 69764 - protein, 44 aa, Zea mays
  misc_feature: Ceres CLONE 1548339
PRGGGRSRTSGSPGLQEFVSPLEKLLDGEPVGGGRGPCGGGGGG

SEQ ID NO: 69765 - DNA, 636 bp, Zea mays
  misc_feature: Ceres CLONE 1548343
  misc_feature: Encodes the peptide sequence at SEQ ID NO. 69766
gcggtggcggccgctctagaactagtggatcccccgggctgcaagaattcgtctcacccctagaaaaagccgcaattcacgggcgcagcgacctctcgtctcctctccatctagacaccactttcttctctccgcctcaagcggagcgcgcgcggatagcttcccggcctcccagcaacatcccgccaccacttcctcctcctcctccactctctccggccgcgcgcgccaacgtttttttttccaacggagagccgccgcgcgctgcctttagtttcggacccatccatccatacatagccaacatcacctatagcaggcggagggacggaagaccgtccgtctcgttcactccgcgccgcgcgtggcccgatccagcccggccctcggatagtcgccgctggcacgtacagcgacgacacctgcggcggcgggtgcgggtccatggagttctggccggagttcctggcctccagcggcgggcgcgagttcgtggccggacgggtgggcggcatggcaggcgtgctggcaggtcacccgctcgaaacgctcctcatccgcctccaacagccgcccgccgcggagacaacattgcctccgagacgcgcaccccttcagccccgcggcctcctacgc

SEQ ID NO: 69766 - protein, 64 aa, Zea mays
  misc_feature: Ceres CLONE 1548343
MEFWPEFLASSGGREFVAGRVGGMAGVLAGHPLETLLIRLQQPPAAETTLPPRRAPLQPRGLLR

SEQ ID NO: 69767 - DNA, 640 bp, Zea mays
  misc_feature: Ceres CLONE 1548347
  misc_feature: Encodes the peptide sequence at SEQ ID NO. 69768
ctccccgcggtggcggccgctctagaactagtggatcccccgggctgcaggaattcgtctcacccctagaaaaagctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcacggccagtatctggaagcagatggctgatgctgggatcaagtacatccccagcaacactttctcgtactatgaccaggtccttgacaccactgccatgctcggcgctgtccccgaacgttactcatggactggaggagagactggatttgacacctacttctccatggccagaggcaacgccactgttcctgctatggagatgaccaagtggtttgacaccaactaccactttattgtccctgaatcgtgcacaaacaccaagttctcctatgcttctcacaaggctgttaacgaatataaggatgcttacgcgctcggtgttgatacagtgccagtacttgctggaccagtctcgtacctgttgctctcaaagc

SEQ ID NO: 69768 - protein, 166 aa, Zea mays
  misc_feature: Ceres CLONE 1548347
  misc_feature (2)..(166): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MASHIVGYPRMGPKRELKFALESFWDGKSTAEDLEKVATDLTASIWKQMADAGIKYIPSNTFSYYDQVLDTTAMLGAVPERYSWTGGETGFDTYFSMARGNATVPAMEMTKWFDTNYHFIVPESCTNTKFSYASHKAVNEYKDAYALGVDTVPVLAGPVSYLLLSK

SEQ ID NO: 69769 - DNA, 665 bp, Zea mays
  misc_feature: Ceres CLONE 1548349
  misc_feature: Encodes the peptide sequence at SEQ ID NO. 69770
ggagctcaccgcggtggcggccgctctagaactagtggatcccccgggctgcaggaattcgtctcacccctagaaaaagccattgcgccgtggaaaaacacaggccgttgctgctttacagggttttgtgttttttcagctacttgagcatgggggccatgattctttgttcatcttggatgtaactagctgattggtgttccaacaatgttgtattggcggaacaatttttacctttttaaatcactaccaatccacctcactaggccttttctgtaacatcatacacgagccgtacgatttcaaagcatatcaccatttagcacttgacatatttgatgctgtcatgtgcttttgttcatccattgcaagtaagaaagttcaaatcgttttttacaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaa

SEQ ID NO: 69770 - protein, 95 aa, Zea mays
  misc_feature: Ceres CLONE 1548349
  misc_feature: SWISSPROT Homolog: EC 3.2.1.23 Beta-galactosidase
MCFCSSIASKKVQIVFYKKKKKNETLEVPNSPYSESYYARSLAVVLQRRDWENPGVTQLNRLAAHPPFASWRNSEEARTDRPSQQLRSLNGEWKL

SEQ ID NO: 69771 - DNA, 866 bp, Zea mays
  misc_feature: Ceres CLONE 1548351
  misc_feature (12)..(12): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (34)..(34): n is a, c, t, g, unknown, or other
  misc_feature (35)..(35): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (454)..(454): n is a, c, t, g, unknown, or other
  misc_feature (783)..(783): n is a, c, t, g, unknown, or other
ccttttgttccncnnnanannnnnnnnnnccccnnccgcgcctnnnaaaaataaaaaatctcaaccgtggcgcccgctctagactagtggatcccccgggctgcaggaattcgtctcacccctagaaaaaatgaaactacataaaatagcatgccgtctctgtcactggcaatggacggtggtgcctagcgcaactcagcgcacaactgtgtgtcttgatttttcttctgtttatcacggcattagtgcccatgcccttttatgttacagtgtctgtgtgctcccaaccatcccaaaatatgcgtctgagtttaaggttgggtcaaaattttcttttttcgcgctctggaaaaaaacaatgaacccgccttattttttgttgctggtaacttttttgcccaaccccccttcttttttttccccccccccccaaggggggaagaaaggggggttnttttttttttttcctcttccccccccccccttttttatttatacaaaaacctaccttttccccccccccgcccgtgtcccgcgccccccctccttttatatccccagttctcgtcccttttttttttttgcccccacattccgacccctgctctccccccccgcccactcccctcccatcatctcttctcgcgtgggtccccgggcatgaaaaccgcccagccgccctccaccccacccctcttgcacctcacatttcatattccccctttctcaccccttactaggacacctcttactatataaaaccccccacacaaaacacccacncttcgctctcatcttcgtccctgcctctcaccggacctccgtcgggcccccatatactcactttcacacaccgcccactctac

SEQ ID NO: 69772 - DNA, 625 bp, Zea mays
  misc_feature: Ceres CLONE 1548352
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaacatgatgccgtgccgtctcgttgacaactggtgcatcagtagatgcttactttgcttgtctttgttgctaatgtagtaaataagacgatgcgttgactgcttagaaaaaaaaaagatgacgagactctcgaggtacccaattcgccctatagagaatcttattacccgcgctcactggccgtcgttttacaacgtcatgactgggaaaaccctggcgttccccaacttaatcgccttgcaccacatccccctttcaccagctggcgtaatagcgaagaggcccgcaccgatcgcccttcccaacagttgcgcagcctgaatggcgaatggaaattgtaagcgttaatattttgttaaaattcacgttaaattattgttaaatcaactcatttttttaaccaatacgccgaaatcggcaaaatcccttataagtcacaagaatataccgagatagggttgagtgaatgttccagtttggaacaagagtccactattaaagaacgtggactccaacgtctaacggcgaaaaaccgtctatcaaggcg

SEQ ID NO: 69773 - DNA, 639 bp, Zea mays
  misc_feature: Ceres CLONE 1548354
  misc_feature: Translation starting site: 465
  misc_feature: SWISSPROT Homolog: EC 3.2.1.23 Beta-galactosidase
agctccccgcggtggcggccgctctagaactagtggatcccccgggctgcaggaattcgtctcacccctagaaaaagaacacctagaagaagtggtgtttgaaggagtctactccaatgcctgcttatcaagtggatggatctatctaactaaaggttgggtagaaggattttgggatcttctcctgcaacaaggaaaagttttattcccttatctttaggttagttacttcatgtggaggacttgaagcttagaaggtttttatatatcttttatggaaaggcttcacccttccaattattgtaataagttatgcacttcgagtactatcaggacttgtaataaatacatctctttctaccatgtaaaacttgagttctggaatgtaaagtgtactttgtaaaagtcttccgctctatctccaatgtgtgtgtatcaaatgtgattactgtaatatacctgttatgtgggtaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaa

SEQ ID NO: 69774 - DNA, 650 bp, Zea mays
  misc_feature: Ceres CLONE 1548355
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaattgaggatctatgtctcctcctggataagtcggtgtttcgtaccctatttaaggatgcttgaagcacgaaacatcttcatgggttgtgaaatagaagaaaaattctcttaattatatttgatcaattcttttgccttgcagggcctcatgactcccaacctagacgctcgaggtacccaattcaccctatagtgagtcatattacgcgcgctcactggccgtcggtttccaacttcgtgactgggaaaaccctggcgttacccaacttaatctccttgcagcacatccccctttcgccagctggcgtaatacctaataggcccgcaacgatcgcccttcccaacagttgcgcagcctgaatggccaatggaaattgtaagcgttaatattttgttaaaatgcgccttaaattttcgttaactcacctcatttttttaacctgtcggccgaaatcggcaaaatcccttctacatcgaacccatatacccatatagggattgagtgttgttccagtttgtaacacgagtccactattaaagaacgtggactccaccgtcaagtggcgaaaag

SEQ ID NO: 69775 - DNA, 629 bp, Zea mays
  misc_feature: Ceres CLONE 1548358
  misc_feature: SWISSPROT Homolog: EC 3.2.1.23 Beta-galactosidase
ccccgcggtggcggccgctctagaactagtggatcccccgggctgcaggaattcgtctcacccctagaaaaaaatcatgttgcaccaactcacttgcagctgtggtttggtttcggtttttcggactggctgtctgcagttcgacagctggttccatcttgcatgcatggtgccaagaatatgaccaagatgctgcttctgcctccctctctctctctcagctgctagtggcatcctgacaagcatgcagctggcatcttcttcttagtccagtctttttctctctaccttttcttttaatctttttttttctggtgacgcgtgacaagcaagcagctggcatcttgaaatcgttatcgcagctatttcattgcgtttgtaattcctactaagacaataaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaa

SEQ ID NO: 69776 - DNA, 634 bp, Zea mays
  misc_feature: Ceres CLONE 1548361
  misc_feature: Encodes the peptide sequence at SEQ ID NO. 69777
ccgctctagaactagtggatcccccgggctgcaggaattcgtctcacccctagaaaaatcagtgtcagcggtgagagcatgaatcgagtcattggagcattcagtcgtttgaaggatgggcttcctgggagtgagcaactaagatctatgctgccgactcgcgtactcccacaacagccgctgagcgcttgagtacatgcaccaaattttggtgggctgcttctagtgtcaatttttgttgcttatatgatcttgagaaagttcattctttttcttgtgctacttgattttatgttactgtaaattagcggacgagacttctcacggggctgttctttaaaacataccaaccgggaagggacatggtggaaacacagagggcactataacaatatgtatccatatcacctgttttactttctatctcaatgacatgtgcttgtagtctggcttacaaaagaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggccc

SEQ ID NO: 69777 - protein, 37 aa, Zea mays
  misc_feature: Ceres CLONE 1548361
MNRVIGAFSRLKDGLPGSEQLRSMLPTRVLPQQPLSA

SEQ ID NO: 69778 - DNA, 654 bp, Zea mays
  misc_feature: Ceres CLONE 1548362
  misc_feature (408)..(408): n is a, c, t, g, unknown, or other
  misc_feature (581)..(581): n is a, c, t, g, unknown, or other
  misc_feature (603)..(603): n is a, c, t, g, unknown, or other
acccgcggtggcggccgctctagaactagtggatcccccgggctgcaggaattcgtctcacccctagaaaaaagctggctggccaggctcctcctcctcggcctcgatccgcttctcctcctctgcccgcctacctggagcggggagcgggaagagcggcggcgggagcccggcattctgatccgcttctccgcgcgcaacaccggcctgccgcgaatgattcttgggaagccctgtacctgactactggatccactaccaagctcttcaagttccaggatccattcctctttgtcgggcaagagctcttggcctctgtggattatcagcctgattcacaactctctgcaagaattcgagcgcagatgggccaagaaagcgcggctgacgcgattcctggtttgatgngtttctgttggtgtttcgggctaacagactctctttttttttgtttacttcctcaaagttccacttcaacatatggatccgggcttcccgagttggaatctgatcactcgcgtcagtgcttcttagcttccttcatttgccgtcatggaggagcagaactcatggcttattangaccaagttctcccatactgcntacacctagagtggacccacgaagagtagcagctggttgctccggtgggca

SEQ ID NO: 69779 - DNA, 571 bp, Zea mays
  misc_feature: Ceres CLONE 1548363
  misc_feature: Encodes the peptide sequence at SEQ ID NO. 69780
  misc_feature (268)..(268): n is a, c, t, g, unknown, or other
ctccccgcggtggcggccgctctagaatagtggatcccccgggctgcaggaattcgtctcacccctagaaaaacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcanggagggatcggaaggatgacggcatcggtttccagagccatctgcgtacagaagccgggctcaaaatgcaccagggacagggaagcgacctccttcgccgccgatcggtcgcagcgccgaagcccccgcacgccaaaggcgccggcgtcatccgcctcgaactcggggcgggacgggggcagcattgctcgcccctgaaggcccgtccttgaccccccccgattccgacgaccaaaaagaagggggttcaccttcggccaggggcaaaacgagggcaacaagacctggaagaactggctggcg

SEQ ID NO: 69780 - protein, 84 aa, Zea mays
  misc_feature: Ceres CLONE 1548363
  misc_feature: SWISSPROT Homolog: EC 2.7.9.1 Pyruvate, phosphate dikinase
  misc_feature (19)..(19): Xaa is any aa, unknown, or other
MIVQPIELRAWTAFPGSAXGGIGRMTASVSRAICVQKPGSKCTRDREATSFAADRSQRRSPRTPKAPASSASNSGRDGGSIARP

SEQ ID NO: 69781 - DNA, 687 bp, Zea mays
  misc_feature: Ceres CLONE 1548381
  misc_feature: SWISSPROT Homolog: EC 3.2.1.23 Beta-galactosidase
ggcggccgctctagaactagtggatcccccgggctgcaggaattcgtctcacccctagaaaaagatatgggacacctgacctggtgagagacacgtagggctgcattgttgggaacttccgggggttgcttattgcacgagagatcgaatatggtgtagcagactctttttagcatttttttagcttattacgatcgtacatgtgcgttgctattgcaaaaaaatataacacgataattaaagtttagatatgtattctatgaaaaaacatttttttagtgtgatgtgtgtaacattcggtttgtaaccaatcatcattattatattgttagcaaaattggctacaaagttcgcctctataaaagaagaaaaaaaaacgagacgctcgaggtacccccctcgccctatagtgagtcgtattacgcgcgctcactggccgtcgttttacaagtcgtgactgggaaaaccctggcgttacccaacttaatcgccttgcagcacatcccccctttcgcccgcctggcgtaataccgaaaaaggcccgcacccaattgccctttcccaacagtttgcccagcctgaaagggcaaagggaaattgtaaggcgttcatatttttgttaaaaatttctcggttaaaatttttgtttaaagctcgcctccatttttttgaaaccaactaggcccg

SEQ ID NO: 69782 - DNA, 656 bp, Zea mays
  misc_feature: Ceres CLONE 1548383
  misc_feature: Encodes the peptide sequence at SEQ ID NO. 69783
  misc_feature (486)..(486): n is a, c, t, g, unknown, or other
  misc_feature (510)..(510): n is a, c, t, g, unknown, or other
  misc_feature (525)..(525): n is a, c, t, g, unknown, or other
ctccccgcggtggcggccgctctagaactagtggatcccccgggctgcaggaattcgtctcacccctagaaaaacctgtacccgcgtggtcttcgatcttgccaagtttcacgtttgcagatcggcgcagttttggtcgcaaaggcgtggtcgttctcctcgagcatcgatttagggttcttcggctttctatgatcaggaggagttgctggattattttatcagggaacagaatggtgtgattcgttgattggattacagtctggatctctcttgcatcaaatggttgagcaaggcaaaccacgaagcatcccgacgaaggcgaagaaatcgccgttcgtggaggtagaggttgacgagattggccaggctagtggggctggtgtttgcaagggaaatcaccgctggcgcctaagagcgaccaaggatgctgcgttagccatagtcatggcgacgacgaacacatgaatcggatgggtgcgtgcnaaggcaggggctagacgaagcatngtggggtggacttcngtcactcactgcagctggtgctgttctcgcgacagtgggacctcgccggaaagtcctgttgacctatcaaattcacacccaaagctggattatggcctggccaattgccttggagcccttttggtttttgg

SEQ ID NO: 69783 - protein, 61 aa, Zea mays
  misc_feature: Ceres CLONE 1548383
MVEQGKPRSIPTKAKKSPFVEVEVDEIGQASGAGVCKGNHRWRLRATKDAALAIVMATTNT

SEQ ID NO: 69784 - DNA, 642 bp, Zea mays
  misc_feature: Ceres CLONE 1548389
  misc_feature: Encodes the peptide sequence at SEQ ID NO. 69785
ccccgcggtggcggccgctctagaactagtggatcccccgggctgcaggaattcgtctcacccctagaaaaaatttttcccctcccccttgtccgccgcatcctggttcggattcgccgtcgcgctagggcaaacaggaaaggaagatggcggctgcggcggccgccagcatggtggtggtgcgggaggtcctgggcctcgacgtcgtcgacgaggtggaccagcccatcatcgactacatcgccaacgtcctcgccgacgaggacttcgacttcggggccccggaagggcacggcatcttcgaagcgctcggggagctcctcatcgactctgggtgcgtctctgaccaggagcactgccttcaggtctgcagtaagctttgtgaaaagtttggaaagcatggtctggtgaaaccgaaacaagctatgcgcagccttgtcacaccattacgaatgaatgcggggatggacgatgatgtcgctcccaaaaagccgcagcctgaagtattcgatggaccactgctgtcttcgcgcgataaagcccaagattgacgaaaaaaaaaaaaaaaacaagacgctcgaggtacccaattcgccctatagtgagtcgtattacgcgcgctccctggccgtcgttttacaa

SEQ ID NO: 69785 - protein, 134 aa, Zea mays
  misc_feature: Ceres CLONE 1548389
MAAAAAASMVVVREVLGLDVVDEVDQPIIDYIANVLADEDFDFGAPEGHGIFEALGELLIDSGCVSDQEHCLQVCSKLCEKFGKHGLVKPKQAMRSLVTPLRMNAGMDDDVAPKKPQPEVFDGPLLSSRDKAQD

SEQ ID NO: 69786 - DNA, 658 bp, Zea mays
  misc_feature: Ceres CLONE 1548391
  misc_feature: SWISSPROT Homolog: EC 3.2.1.23 Beta-galactosidase
tccccgcggtggcggccgctctagaactagtggatcccccgggctgcaggaattcgtctcacccctagaaaactactactgagactgacacgactgatcatcccatctatcgagatatgcatgcataactcgatatatatacggcccctagcgccgtacacgtgcgtgcgtgtaagtaaataacagcaaacgtcgtcacgtgtgtgttgctcaatcactactccatcgatctacttattatcgtctgcaaataacgactaagcgcatgcttctgcagcgtgcaacgatccatcactgttactatatctaatgatgcatgcatgcaattaagccaaaaaaaaaaaaaaatttgagacgctcgaggtagccgagcgccctataccgagtcgtattacgcacgctcactggccgtcgttttacaacgtcgtgactgggaaaaccctggcgttacccaacttagtcgccctgcagcacatccccctttcgccgggtggcgtaatagcgaagaggcccgcaccgatctctcctcccaacagttgcgcaacctgaagggcgaacggaaattgttcgcgttaatattttggtcaaattcgcctgaaatttttgttaaatcaaactccttttcttaaccaccaggccgaaaatcggcaaaacccct

SEQ ID NO: 69787 - DNA, 614 bp, Zea mays
  misc_feature: Ceres CLONE 1548395
  misc_feature: Encodes the peptide sequence at SEQ ID NO. 69788
gcggtggcggccgctctagaactagtggatcccccgggctgcaggaattcgtctcacccctagaaaaaaagcatataaataagcggaggagaagaaacttacgaggattcccctagtaacggcgagcgaaccgggagcagcccagcttgagaatcgggcggcctcgccgcccgaattgtagtctggagaggcgtcctcagcgacggaccgggcccaagttctctggaaagggacgcctgggagggtgagagccccgtccggcccggaccctgtcgcaccacgaggcgccgtcaacgagtcgggttgtttgggaatgcagcccaaatcgggcggtaaactccgtccaattctaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgct

SEQ ID NO: 69788 - protein, 55 aa, Zea mays
  misc_feature: Ceres CLONE 1548395
MKGGTQAVSLMVHLAVPWLCLASWAALLPALASGNVGAAAPILRADYIKLNFSTA

SEQ ID NO: 69789 - DNA, 870 bp, Zea mays
  misc_feature: Ceres CLONE 1548397
  misc_feature (14)..(14): n is a, c, t, g, unknown, or other
  misc_feature (15)..(15): n is a, c, t, g, unknown, or other
  misc_feature (25)..(25): n is a, c, t, g, unknown, or other
  misc_feature (26)..(26): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (52)..(52): n is a, c, t, g, unknown, or other
  misc_feature (502)..(502): n is a, c, t, g, unknown, or other
  misc_feature (533)..(533): n is a, c, t, g, unknown, or other
  misc_feature (543)..(543): n is a, c, t, g, unknown, or other
  misc_feature (547)..(547): n is a, c, t, g, unknown, or other
  misc_feature (577)..(577): n is a, c, t, g, unknown, or other
  misc_feature (579)..(579): n is a, c, t, g, unknown, or other
  misc_feature (711)..(711): n is a, c, t, g, unknown, or other
  misc_feature (800)..(800): n is a, c, t, g, unknown, or other
  misc_feature (870)..(870): n is a, c, t, g, unknown, or other
ttggggggggggcnncccctcctcnncnnagngggggggggttacaaccctncctgttagtgggggtccccgcggtgggggccgctctttaactagtggatcccccgggctgcaggatattcgtctcacccctcgaagaagtaccggagcgcctccccgctgttccccgcaacctatcgacccattctcgtccgacccggcgcgacgtctcctccagatctccgtcgccctctcccggctacagaaactgatcagctgcagcctgacaaagtggacggcttaggagcttctgcttcttttgtgtcatgacaagctttgcttattttcagaacgtgtgggagagtgcctcttgtgctacctttgaaaaggcaatcgggctgctctcacagttccaggcttgttgcagaccgggcggggttgtcttgttaaaggattctttggtttttgattggtgggtcgcgtgcccgtgtttgttttgccttggggggggaccccgccaccnacctcctccgagccggtgtgtccttttttgncttatggtgnagcngtgaaactcgcctatcttttcttgtgatcncnctattgttggagggttttcggggtaaagagtgaggcggccacgggacactccccaagctcatcgagtgtcagttcgtcgttacccgcattcatcctggtcgtggccccggtgaagagggggttgcacgtatncaatactaaatgtcctcaggggttagtatggtgtcttagacgaacaaaaaacactgggaagatttcaccgatgtatagaacccctattngcttaaaaatgatcctggatgtagagggtgtatatgtgtattacaaaagaggctgccgagaagtcactcn

SEQ ID NO: 69790 - DNA, 617 bp, Zea mays
  misc_feature: Ceres CLONE 1548400
  misc_feature (155)..(155): n is a, c, t, g, unknown, or other
  misc_feature (176)..(176): n is a, c, t, g, unknown, or other
gctctagaactagtggatcccccgggctgcaggaattcgtctcacccctagaaaaaatccatcaggcatccaagcttaaagcaagcagatctaagctccaggcagcgtcgcgacagagtgagtgagtagcacgacaacaacaatgggcttccctngaaggccgccgaagcccagcnggagttgcggcgcagggcaggagccggcgccaagctcagcgagacggcgacgaagccgtcagccgcgaagagcgggcggcgttaaaaaagcctgagcagaaacccccggggaaaccaaaaggaagggtgaagagcagcaaaaccggggggggcgggcaaaaaggggacctaccattcgttggggaagggaaaaggaaaccttccctggcctgggcggggaggggaaacccctggccctggtttttgaaaattaaggccccttccctttttctgtggaaacccccccaggggaaacgcgggcggggggggccccccctcttccgtggggagaaaaaaccccccctatgaaaaactccccaaaataaaaaaacgcttggggcgtggtccacacaaaaaaaaaaaaaaaaaaaaaaaccccccggggggaccccccatttcctc

SEQ ID NO: 69791 - DNA, 652 bp, Zea mays
  misc_feature: Ceres CLONE 1548417
  misc_feature: Encodes the peptide sequence at SEQ ID NO. 69792
ctggagctccccgcggtggcggccgctctagaactagtggaacccccgggctgcaggaattcgtctcacccctagaaaaaaaaaaaaaaaaaaaatacaaggataacagagtgacagaccatcgcttaaagatgaactttgagctgacaagcttccttttaggagacatcgaatcggctattcagtcttgtgctacgatggagcagcaggagctgttggaggaaatggccagttccgtgggcgcagtaaacgtatgattcatgcaaattcggcgttgaggccagcacatcaaactgaactgcgaaactcatgacgtgctcggactcggtgaagatgttcgatagctgtacatgaagaaaactgacaagatgaactccccccataggaacttttttccccctgtagtccgcagggtacaacacacacacccatgcatctcagcttccttgacggcagcagagtcactagtagaaaatatacatgggtttgtgcagttcaacgcttcaactgctccagtattcacagtttaatgcatttttaggtatattgctccaaaaaaaaaaaaaaaacgagacgctcgaggtacccaattcgcccctatagtgagtcgtattacgcgcgctcactgggccgtcgtttttacaacgtcgtg

SEQ ID NO: 69792 - protein, 84 aa, Zea mays
  misc_feature: Ceres CLONE 1548417
GAPRGGGRSRTSGTPGLQEFVSPLEKKKKKKYKDNRVTDHRLKMNFELTSFLLGDIESAIQSCATMEQQELLEEMASSVGAVNV

SEQ ID NO: 69793 - DNA, 621 bp, Zea mays
  misc_feature: Ceres CLONE 1548418
  misc_feature: Encodes the peptide sequence at SEQ ID NO. 69794
tcaccgcggtggcggccgctctagaactagtggatcccccgggctgcaggaattcgtctcacccctagaaaaatgggcccgcgcgtcagctcggctgctgggaggcgggcggcacagcacacacagtgcgtaccttcccctcggtgaattactgatacgaatccccatcatgtaatcgtatttttttagtggctctctttggtgcgctgctccgtgtggacaggtgagactggttcgttgctttggttgcaggaaaataccttttaatcggatcagttgatgtaccgtccgaaaaaatgacgtgtttaactattcgttgcgttttatgtatcatgtttaacctatgactgctaacgatggcatgtttattagttttatatatacactgatatatactattaatatagcatagcttttagaaaaaaaaaaaaaaaaacgagacgctcgaggtacccaattcgccctatagtgagtcgtattacgcgcgctcactgggcgtcgttttacaacgtcgtgactgggaaaacctggcgttacccacttaatcgccttgcagcacatcccctttcgccagctggcgtaataacgaagaggccgcaacgatcgccctcccaacagttc

SEQ ID NO: 69794 - protein, 57 aa, Zea mays
  misc_feature: Ceres CLONE 1548418
HRGGGRSRTSGSPGLQEFVSPLEKWARASARLLGGGRHSTHSAYLPLGELLIRIPIM

SEQ ID NO: 69795 - DNA, 659 bp, Zea mays
  misc_feature: Ceres CLONE 1548419
  misc_feature: Encodes the peptide sequence at SEQ ID NO. 69796
  misc_feature (264)..(264): n is a, c, t, g, unknown, or other
  misc_feature (291)..(291): n is a, c, t, g, unknown, or other
  misc_feature (332)..(332): n is a, c, t, g, unknown, or other
  misc_feature (532)..(532): n is a, c, t, g, unknown, or other
  misc_feature (533)..(533): n is a, c, t, g, unknown, or other
tggagctccccgcggtggcggccgctctagaactagtggatcccccgggctgcaggaattcgtctcacccctagaaaaagtcttctcccctgcgacaaagacgacgcaagtccctactcctccaaaccctcgccgactcagatccagcttcctcgcaccgccgtcgccatgccgttcactccaggcccctactctggcgtcagcaccctcgcccttgtggcgagggcgtcggcctttggcgtcggtgtcgtctacgggagcatncagctctcaatcctcagggtaacaaancctaaaaaggaggaagtgcatgatcatttactaggacgacnaggctgctacatttaattcccacatatggaagggatgttataattggcagtgcacccctcctcatacgtacattcaatttcgtttaggatttgggggacctgtcgggaaactacccggcatttttttttgggggtggaaaaaattccttttccaagggatggaaatccgggaagggggaaaacacagtttttttcccccnnaaaaaaaagggaaaaaaaaaaaaaaacccgggggcgcctgggggggcccactttccccccaaaaaggggggggttatatcccgggccctcggggggcggtgttttttaaaaaccggggggagggga

SEQ ID NO: 69796 - protein, 59 aa, Zea mays
  misc_feature: Ceres CLONE 1548419
  misc_feature (32)..(32): Xaa is any aa, unknown, or other
  misc_feature (41)..(41): Xaa is any aa, unknown, or other
  misc_feature (55)..(55): Xaa is any aa, unknown, or other
MPFTPGPYSGVSTLALVARASAFGVGVVYGSXQLSILRVTXPKKEEVHDHLLGRXGCYI

SEQ ID NO: 69797 - DNA, 632 bp, Zea mays
  misc_feature: Ceres CLONE 1548435
  misc_feature: Translation starting site: 164
  misc_feature: SWISSPROT Homolog: EC 3.2.1.23 Beta-galactosidase
gggctgcaggaattcgtctcacccctagaaaaaagtcaatcaggcatcctagcttatagctagcagatctaagctccaggcagcgtcgcgacggagtgagtgagtagcaccacaacaacaatggcttccctgagggccgcgaagcccaacgaagttgcggcgcatggcaaggaagcccgcgcccaagctcaacaagactgcgacgaagcctcctgccaccaagaacggcgaccttcacaaggctgatcagaatcccccggaaaccaaaaggaacgtgaagagcagcaaaccggcggcggcggccaaaaagagacgtacagtacgtgtggagtgtaatggagcttccatgcatgcatgagtggatccatgccatgttatgaatctagtccttcctttcttgtatcttccatgtgacgcggcgtgtgcgtcccttcatgtgtgatgatgccagatgaatactacaaataagacgttgtgactgtgccaaacaaaaaaaaaaaaacgagacgctcgaggtacccaattcgccctatagtgagtcgtattacgcgcgctcactggccgtcgttttacaacgtcgggactgggaaaaccatggcgttacccaacttaatcgcctagcagtacatccg

SEQ ID NO: 69798 - DNA, 673 bp, Zea mays
  misc_feature: Ceres CLONE 1548439
  misc_feature (344)..(344): n is a, c, t, g, unknown, or other
  misc_feature (621)..(621): n is a, c, t, g, unknown, or other
ccccgcggtggcggccgctctagaactagtggatcccccgggctgcaggaattcgtctcacccctagaaaaacttctccgcttttcccccatctccttctgggcgcaccaggaaaaaaattgatacattcctcggcagctgcgcgagtcctctgttgataccccggcgacccaaagcccccgtccgagcagcagcagcagccgccgcctaaaagtaacaggattggggatttttttttttgcttcgtgttctccttctcctgctgtaggcgttgattcgggtgatgagagatgggcttcttggcgtgcttgtgccgatgccctcaggacggggacgacgacgangaggagggggagcagttcagaatcaaccaccagggtcgcctcagtggtactaccccaaatccttcgaaaagcagccccttggaaaggccttgaaaaaaaagtgggttccattttttggacggaagcccccccctatttgggaaacctgatgaaagaaaaattcttcacctttggcgtcaccttggctaaaggttcccaataattttcaggaagagaccccttttgggggggaagggggaatttcggggtggcctcccaaagggaaacccttttaatntaagaaacaagtgttttttccccccaaaaaaacttgttgtttttaatggggc

SEQ ID NO: 69799 - DNA, 638 bp, Zea mays
  misc_feature: Ceres CLONE 1548441
  misc_feature: Encodes the peptide sequence at SEQ ID NO. 69800
ggagctccccgcggtggcggccgctctagaactagtggatcccccgggctgcaggaattcgtctcacccctagaaaaaatcttgtttggtggtggttgtctgccctccatgcatctcgccatcttctatttataatagccccgccttctctctgttacacgccatacaattctcacacgcgcgcgcccaacacactagcctgcaggatcgtcgagcgcgaggcggctgccccgccggccggttcgttcgctctatagcttgagaccgatcctagctaggccaagacgatatcggcggcgatgatgatggacgcggcgaggatcgtagagtacttcaagggcaagtgcatcctcgtcaccggctcaacagggtttcttggaaagatccttgtggagaagatactgcgggtgcagcctgacgtgcgcaagatttacctgcttgtacgcgcggtcgacgagccatcagcgaagcagcgcgtccaacaagaggtgatagacacggagctgttcggcctgctgagagagaaacacggcaagggcttccagcagttcgtagaggccaaggtcgtcgctttggccggagacatcgtatacgacggcctggggctggaggcagccgtgctggacgcgctggccaag

SEQ ID NO: 69800 - protein, 113 aa, Zea mays
  misc_feature: Ceres CLONE 1548441
MMMDAARIVEYFKGKCILVTGSTGFLGKILVEKILRVQPDVRKIYLLVRAVDEPSAKQRVQQEVIDTELFGLLREKHGKGFQQFVEAKVVALAGDIVYDGLGLEAAVLDALAK

SEQ ID NO: 69801 - DNA, 624 bp, Zea mays
  misc_feature: Ceres CLONE 1548442
  misc_feature: Translation starting site: 107
ctccccgcggtggcggccgctctagaactagtggatcccccgggctgcaggaattcgtctcacccctagaaaaaatcggcatttattccgttgggcctcgcttccgatgcgccggagctcgcacgcgatgggagcgcaagcgtttcggctgctgctgcttctgctgctcgcggcggcggcggcggaggcgcgcttcgttgtggagaagaacagcctgatggtgacgtcgccgacttcgttgcggggacgacacgacagcgctatagggaacttcggaatcccacagtacggcgggagcatggcaggcgccgtcgtctaccctaatgacaacgcctaggcttgcgacgatgtcgacggcatgcaccccttccgtgccaagcctggcgcgatgcccacgtacctcctcatcgaccgacgtgagtgcttatttgcctacgaaggtttggaatgcacaaaatgctggtgcctctgcagtacttgtagctgatgacaaggatgaacctttgtcacaatgattttacctcgtgaagaatgacacgcttccaagtatatgcaaactttacccttccgtctgcattatagatgaaaaattgggtgaccaattgaagacgctgctaacatggg

SEQ ID NO: 69802 - DNA, 679 bp, Zea mays
  misc_feature: Ceres CLONE 1548448
  misc_feature: SWISSPROT Homolog: EC 3.2.1.23 Beta-galactosidase
tggagctcaccgccgggggcggccgttctaaaattagtgaatcccccgggctgcaggatttcttctcacccctagaaaaagattaattattaattattattatttgttgtttacgttgccgggaaaaaaagaaagaaaagtgtctcaccaactgcatgcatgtgttcctggtccctcactgctgtgacttacagagtattatatatatattagtactatgtatactggtcctcatttacatatcaaatggtatagggttttctaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcaccacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcacctcatttttttaaccaataggccgaaatcggcaaaatcccttataaatcaaaagaatagaccgagatagggttgagtgttgttccagtttggaacaagagtccactattaaagaacgtggacttccacgtcaa

SEQ ID NO: 69803 - DNA, 707 bp, Zea mays
  misc_feature: Ceres CLONE 1548451
  misc_feature (232)..(232): n is a, c, t, g, unknown, or other
  misc_feature (233)..(233): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (287)..(287): n is a, c, t, g, unknown, or other
  misc_feature (288)..(288): n is a, c, t, g, unknown, or other
  misc_feature (301)..(301): n is a, c, t, g, unknown, or other
  misc_feature (302)..(302): n is a, c, t, g, unknown, or other
  misc_feature (303)..(303): n is a, c, t, g, unknown, or other
  misc_feature (304)..(304): n is a, c, t, g, unknown, or other
  misc_feature (305)..(305): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (314)..(314): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (420)..(420): n is a, c, t, g, unknown, or other
  misc_feature (563)..(563): n is a, c, t, g, unknown, or other
  misc_feature (565)..(565): n is a, c, t, g, unknown, or other
  misc_feature (609)..(609): n is a, c, t, g, unknown, or other
  misc_feature (628)..(628): n is a, c, t, g, unknown, or other
  misc_feature (629)..(629): n is a, c, t, g, unknown, or other
  misc_feature (633)..(633): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (643)..(643): n is a, c, t, g, unknown, or other
  misc_feature (652)..(652): n is a, c, t, g, unknown, or other
  misc_feature (654)..(654): n is a, c, t, g, unknown, or other
  misc_feature (656)..(656): n is a, c, t, g, unknown, or other
  misc_feature (657)..(657): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (692)..(692): n is a, c, t, g, unknown, or other
tggagctcaccgcggtggcggccgctctagaactagtggatctcttgggctgcaggaattcgtctcactcttagaaaatatttgttgtttcaacgtttatttaaaagaagagcaggtagttgtgggcttttgaacaatagctggagtgatatgaaacattagtgatgtagttgtaggcttttgaactgcttcaagctggagtgatgttgctgtgtgcttttgtgaaaaaaannaaaaaaaaaaaaannnnnnnnnnnnnnnnnnnnnnnnnnnnnnntttttccccnncgggggggggggnnnnnnnnnnnggntttttttnnnnnnngggggcgcctcgaggaccccaattttttcttcccccccccagggggggcgggggggccctttccccccctttttaccccccccccccccctnaaaaaaccccggggggacccccctttaagccgggggggggggaatacccctttttccccaagggggggtatgaaaaaaaaggggccccaaccaaaacccccctccccaaaatttggccccctccccagtccgcgaagcccaancngaaaagcacaacattttggttcaacccccccgcctccaatcctnccccaaaaccacgaccctnntctnaccnnnntgngcccccccntntnntgactctttccttctccccccccccnnntccccgnacacaccccccgccc

SEQ ID NO: 69804 - DNA, 629 bp, Zea mays
  misc_feature: Ceres CLONE 1548461
  misc_feature: Encodes the peptide sequence at SEQ ID NO. 69805
tggagctccccgcggtggcggccgctctagaactagtggatcccccgggctgcaggaattcgtctcacccctagaaaaatgtggcgacaaatgcatctcttgtatcgttagggtcttagttgtgaacttaattttcacatctgtatgattaaaagagattcatcaattggtactgaagtgttgtttttttgtcttgttgcctatctggagtttataaaaaaaaaaaaattaactaaaatcatcagttgtgtccttgagaatcgggcacttaatgtatcattttcggttcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaaa

SEQ ID NO: 69805 - protein, 84 aa, Zea mays
  misc_feature: Ceres CLONE 1548461
  misc_feature: SWISSPROT Homolog: EC 3.2.1.23 Beta-galactosidase
MYHFRFKKKKKNETLEVPNSPYSESYYARSLAVVLQRRDWENPGVTQLNRLAAHPPFASWRNSEEARTDRPSQQLRSLNGEWKL

SEQ ID NO: 69806 - DNA, 762 bp, Zea mays
  misc_feature: Ceres CLONE 1548462-R
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnncccaatagagtactcgagcgtctcgtttttttttttttttttaatcgcacatatgaacgcatgtctcagaaacgattcataattacaaccgatatttgtaggggtgcaaatctgcatctgaccatatttatcagcgtggcacagataacctggccaaaggaaccaagcaatgctagaaaattgcaaatggtcaaatatcctctcgactcggaaaggtgatggccttgaccatggatgctgaacacatggaaatgccataattttgtacagcagctgaaaagagcctataaggataaccaaatgtccaacaatatgccgaaatgatcagttaggttgttggttatgaccaagcaccgatggtagggtaggccaagcacagtttgagttgtcgacgtggagggcaggctaccagcactggcctcgtcagcaagctttagaagcttttgcttctctcccatgcggtaagggagccttttggtaggttagcttgtgtatctacaacatcgtattcaagttttcctttccctctgacccccccaatatttcctgttgccgcctcaggaatcccactggagccccgtttcccgacccccggcaaaaaaatttaacccccgggttcggcccaaaacccgggaagggaaatgttgttggtaaaggggggggttggaaaaaccttgggggggcaaacccaccgctccatttaaaacggggaaaaccctcctccaaattttttgggggtgaaaacaaagccctttttta

SEQ ID NO: 69807 - DNA, 583 bp, Zea mays
  misc_feature: Ceres CLONE 1548468
  misc_feature: Encodes the peptide sequence at SEQ ID NO. 69808
  misc_feature (534)..(534): n is a, c, t, g, unknown, or other
ggagctccccgcggtggcggccgctctagaactagtggatcccccgggctgcaggaattcgtctcacccctagaaaaagtcatcgcgtggtggccgcgccgctctgttcctccgtcccctcctccttccggctctcgctgtcacatgtcgtgtggtgtgggggcgctctgatccggatggtgcagcgccgcgggatcgcccacggccatgattgatcgcgaacgagcagaggaaatgcaagttaataatgaggcaccactagggtgcctcaagccaaatatttctcagtataactctccagaacagataggtggtagttgaagggtttcctgagaataatgaaaaaaggaatgatattgttgctgcagaaaaaatctgggaggcgactccaaaccaaggccttagcatgcccatctaccgactagaattttatgcctggccatatatgtattcagattatcaaatcgtgcgtcagccacttaccttatggtttttgacaccatttttatcagaaaattagggaccacgggtttncctatggaagaacaggtttcaatatccttccattcaaatgctccctcaa

SEQ ID NO: 69808 - protein, 37 aa, Zea mays
  misc_feature: Ceres CLONE 1548468
MIDRERAEEMQVNNEAPLGCLKPNISQYNSPEQIGGS

SEQ ID NO: 69809 - DNA, 650 bp, Zea mays
  misc_feature: Ceres CLONE 1548472
  misc_feature: SWISSPROT Homolog: EC 3.2.1.23 Beta-galactosidase
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
ccgctctagaactagtggatcccccgggctgcaggaattcgtctcacccctagaaaaactaaaacctagaccacgcgcgacgacggccgcctgatcgatcgaccaaccattccgccgtcgccgccggccggatcatcggtcgtcgtcatgatgatatctatcaatctacgcgtgatgatcgatggctacttgtctactgctatgtactactaaataaaatctctccccgtgtgtgtacacgtacgcttgcatgtgcatggtagcatgtacgtacgacgtcgtccatgtataagtgtgtgacgtgtgagacggacagagagagagagagacaggatcgatcgagagacggtcatgtccttttggctgtttggtttatttttgagttcatgcggtctttatttatttccatgtacccagtacccaccttgtaccatgcatgttccttatgatacactcacctctttttgttggcnnntggnnnttgtaaaaaaaaataaaaaagaaaaaaaaaaaaaaaaacgagacgctcgaggtacccaattcgccctatagtgagtcgtattacgcgcgctcactggccgtcgttttacaacgtcgtgactggaaaaaccgtggcgtaacccaacttaatcgccttgcagcacatcccc

SEQ ID NO: 69810 - DNA, 651 bp, Zea mays
  misc_feature: Ceres CLONE 1548482
  misc_feature: Encodes the peptide sequence at SEQ ID NO. 69811
tggagctccccgcggtggcggccgctctagaactagtggatcccccgggctgcaggaattcgtctcacccctagaaaaacttcctcatccagtgttctgtcctagcgccgccgccgccccagctcgccttgcgtgactgagagctcgtcggcttccgtccacgcgtgaagcgagagcatggacacccaggtgaagcttgctgttgtggtgaaggtgatgggcaggaccggctccaggggtcaggtgacccaggtcagagtgaagtttttggatgaccagaaccggctcatcatgaggaatgtcaaggggcccgttcgcgagggtgacatcctcaccctgctcgagtccgagagggaggcctagaggctgcgctgaagccctagcgttcttggtgggctcttgtatggtctttgggtgtctgaaatttgtgctatgtttgaacttctgtgaccctgtttttagagtagtaagcctgggttatagattgcagttttgtttatcttggttgaaaaaaaaaaaaaaaaacgagacgctcgaagtaccccatttcgccctataatgaggtcgattacgcgcgcctcactggcccgtcgtttttccaacgtcgggactgggaaaaacccctggccgtccccaaatttaatcgccctt

SEQ ID NO: 69811 - protein, 61 aa, Zea mays
  misc_feature: Ceres CLONE 1548482
  misc_feature (1)..(61): Pfam Name: Ribosomal_S28e Pfam Description: Ribosomal protein S28e
MDTQVKLAVVVKVMGRTGSRGQVTQVRVKFLDDQNRLIMRNVKGPVREGDILTLLESEREA

SEQ ID NO: 69812 - DNA, 648 bp, Zea mays
  misc_feature: Ceres CLONE 1548485
gtggatcccccgggctgcaggaattcgtctcacccctagaaaaactgaatccagcgcccggctcccgccgccagctaggggttctcctccccgcccaccccgaaaccatccccgaggctgctagtgcgtcgcgcggcttccatgagcgacggtgaggactccctcgacctctccgccctcggcgccgccttccccaactccggcgagatcaccacgtaagacaaaggctaacgttgtggcgtccatcaagaacactctcgatggattggcgtctcggcataccgacgtggtcgagaacctcgagcccacaggcaggtaagcgcgttgagaaggtcatgggagatccatgggcgaacaccactgaactttgaggcgaagtttttcgaagagaggaggggcttcttgaagcctaagtatcgagaagttggtctgaacctctttcacgactccgcgtttatgaaatttggccaatggtggcgggtcgatttttgaagggtatcaacaaagagaaaggtgccgcgtgaaacccttgaaggcgcaaaataagtggaatatgagaccgcctgcctgacccatttaataaatacaaatccctagacctgtccaaagtacccctattttgccccaaatatggaggtcgtttttacg

SEQ ID NO: 69813 - DNA, 649 bp, Zea mays
  misc_feature: Ceres CLONE 1548488
  misc_feature: Pfam Name: mTERF Pfam Description: mTERF
  misc_feature: SWISSPROT Homolog: EC 3.2.1.23 Beta-galactosidase
ccgcggtggcggccgctctagaactagtggatcccccgggctgcaggaattcgtctcacccctagaaaaacgttttctggtttccttgaagaaagctccaaagggtccatttcctctgagctcctttgtgcccacagatgagcgtttttgccagaggtgggctgggactagcttggaggcataccatacattcagacagaggttgctgctaacaagtttcacagggaagtctggaaggaaaacactagtctcaagacggtagatgcctaggtggtgggagtgtgtttgtcttgagcccatgctcctcctaacagtaagatgatctctttctgattttagagtttgtttggtagcagtctgcatacgcatagtactgattagtgattagttcacagttctcaggaaatgggcttggtttctgacttgggaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatgg

SEQ ID NO: 69814 - DNA, 638 bp, Zea mays
  misc_feature: Ceres CLONE 1548499
  misc_feature: SWISSPROT Homolog: EC 3.2.1.23 Beta-galactosidase
ccaccgcggtggcggccgctctagaactagtggatcccccgggctgcaggaattcgtctcacccctagaaaaatggtcggtaactgtatgtaaaatgtagttctgtctgttaggatttccttccggtattataacattgtacagagctattggtgatgagatgctgtcagcttgccctttccaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagacggagatagggtttgagtgttgttcccagtttggaacaagagtccactaataaagaacgtggactccaacgtcaaaaggcgaaaaaccgtctattaggggcgatgggcccctt

SEQ ID NO: 69815 - DNA, 661 bp, Zea mays
  misc_feature: Ceres CLONE 1548500
  misc_feature: SWISSPROT Homolog: EC 3.2.1.23 Beta-galactosidase
acccgcggtgacggccgctctagaactagtggatcccccgggctgcaggaattcgtctcacccctagaaaaacatgtctaaacgaacaagctcttaaaccttgttcggttatttcaattccatgtggattggagtatattggaatggattgtgataattttgacttgctatagatttaaaccgactcaataccacttaatccacatggattaacagtaaaacaaacaagcccttaatgagtctagttgatataaaatggattaactgacatggaaatagcagaccgttctctttgcaattttcctccattaaggcgttagctttattgcagtggccataagtcctcagcctatacggatgtttatattttcatcaaattatttaatgagtcaattcttctggtgataaaaaaaaaaaaaaaaacgagacgctcgaggtacccattcgccctatagtgagtcgtattacgcgcgctcactggccgtcgttttacaacgtcgtgactgggaaaaccctggcgttacccaacttaatcggcttgcagaacatcccctttccgcagctggcgtaaataacaagaaggccgccacccattccccttcccaaaatttgcccacccgaattgcaaattgaatttttaaacgttaaaatttttggtaaa

SEQ ID NO: 69816 - DNA, 714 bp, Zea mays
  misc_feature: Ceres CLONE 1548511
  misc_feature: Encodes the peptide sequence at SEQ ID NO. 69817
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
gctggagctcaccgcggtggcggccgctcctagaactagtggatcccccgggctgcaggaattcgtctcacccctagaaaaactagaaaaaatacgacgatgaagatgaaggggctctctgatatggaagatctgattagtgagctttctggtggcaaatcggatgctgactacgagtggggtgatggctggtttggtgagaacgatgactcaccgccagactttggagacgacgaagtcaaggtcgccatgaaaattgctgatggttctgccaacggcagcgcacctgttcctgtatttcctgatggcagaccaagggaacggtggtaaattgaggtgtttttgaacttctgattgatagaatcgttaatctataatcttagttcttttaaaannnnnnnnnnnnnnnnnnnnnnnnnnnnnnnnnnnnnnnnnnnnnnnnnnnnnnnnnngaaaaaaaaaaaaaaaccgagacgcttcagggtacccaaatccccccaatagtggagtcgtattaacccccgctccactggccgtctttttacaaccttcgtgactgggaaaaactttggcgttcccccaattaaattcgctttgggagaaatccccccttttccccagtgtgggaaaaaaacccaaaaaggccccccccccaattgccctttcccaaaatttgccccccccccgaaggggcaaagggaaattttaacccct

SEQ ID NO: 69817 - protein, 76 aa, Zea mays
  misc_feature: Ceres CLONE 1548511
MKMKGLSDMEDLISELSGGKSDADYEWGDGWFGENDDSPPDFGDDEVKVAMKIADGSANGSAPVPVFPDGRPRERW

SEQ ID NO: 69818 - DNA, 666 bp, Zea mays
  misc_feature: Ceres CLONE 1548512
  misc_feature (666)..(666): n is a, c, t, g, unknown, or other
agctccccgcggtggcggccgctctagaactagtggatcccccgggctgcaggaattcgtctcacccctagaaaaaacatgtattcggaccgactacccacccgtctattctggtcacttcttttggggttctccgttcccctccccattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctctcttttgagagagggggaagtaataaaagggaaaaagctagcacggggatttccttgatcccatcatcgtgctacagatcctttagttctagcgaggaggaggaaaaagagagagcaagcccatggatcccagccagatgatgttccccattctggggggccgccccctcccgcccgccttgaaaccgcccttccgatgaccaagcccgccgccccccaaaggggaagggggaggccctttcctccccccctccaaaatcccaaccgggggtggggagacccaaaaaaacccggcccgcccgccccctaacaagcaacgggggcccctgggggaattcccaaggn

SEQ ID NO: 69819 - DNA, 652 bp, Zea mays
  misc_feature: Ceres CLONE 1548516
tggagctcaccgcggtggcggccgctctagaactagtggatcccccgggctgcaggaattcgtctcacccctagaaaaatttttggcataaagatccactactagtaagcttttctgcaaaaatgagtcttcgaaatttgataagctttaccttgattcccaataaaccggcataccgttgagagtcttttctttaggcgggtaagtcttgctgagtaattgcgtactcagggttttattccctgttgtttttcaggttaaaattttgttctgttgtggatggtgctaagtgccggtgggctcgaccttcttatataagtatatcccatctttagcttctttattgagggctgtcacttaagctagcatgtattttaaaacttataaatgttttatacattcaaattgtaatatttttgaatcaaattctcttgtaatcactccgatgatatattgtaatatggttataacttataaatgttgtaacttgtaatcattttgtaataaagaatttatttccgctgcgaaaaaaaaaaaaaaaaacgagacgctcgaggtacccaattcgccctatagtgagtcgtattacgcgcgctcactggccgtcgtttttacacgtcgtgactggaaaaaccctggcgttaccaactta

SEQ ID NO: 69820 - DNA, 667 bp, Zea mays
  misc_feature: Ceres CLONE 1548517
  misc_feature: Encodes the peptide sequence at SEQ ID NO. 69821
  misc_feature (390)..(390): n is a, c, t, g, unknown, or other
  misc_feature (620)..(620): n is a, c, t, g, unknown, or other
ctccccgcggtggcggccgctctagaactagtggatcccccgggctgcaggaattcgtctcacccctagaaaaagtcccctacccgaaccgtgagatggctgagtacggcgagcgctaccagggcaacggcgaccaggccacggccgagggtggctatgcgcagaccgagtacgccgccggcgccggtggctcgccgccctccgacagcaatccctccgtgttctccgaccacgccgacggccgctcctcccagccccagcatgagacccagtcacatgacagtggttcctccaaatctcaagacagggaccgagaacgtgataagggcaaggacagggagcgaggcagagaccgtgtccgcgaaaaggagaggggccgagacagggacnacgatcgtgaaagaagtgacagagaccgggatcgtgatccccaccacagggatcgtcgcgagcgctccgagataaaggaaacaccgggatcgttctgatgatcctggaccgcccccggggtcatgtatcccgaaaagagaaaaagaacctgacaaaaatgggccatcgaaaggctcccccccccgttcccctccttaggggctggaaccgggaaccccaaattttatccncctctccccgcttaaataccaaaaaaacaccggggggggaagggttt

SEQ ID NO: 69821 - protein, 130 aa, Zea mays
  misc_feature: Ceres CLONE 1548517
  misc_feature (99)..(99): Xaa is any aa, unknown, or other
MAEYGERYQGNGDQATAEGGYAQTEYAAGAGGSPPSDSNPSVFSDHADGRSSQPQHETQSHDSGSSKSQDRDRERDKGKDRERGRDRVREKERGRDRDXDRERSDRDRDRDPHHRDRRERSEIKETPGSF

SEQ ID NO: 69822 - DNA, 639 bp, Zea mays
  misc_feature: Ceres CLONE 1548525
  misc_feature: Translation starting site: 207
  misc_feature: SWISSPROT Homolog: EC 3.2.1.23 Beta-galactosidase
agctccccgcggtggcggccgctctagaactagtggatcccccgggctgcaggaattcgtctcacccctagaaaaagctttaaataccttcgtcgcctccacaagtccacagcatctcaagccaccatcgaccttcaagtctcgccgacgaccccgaggccttcgccgagctcaaggtcaaggagctcaagaacggccgcctcgccatgttctccatgttcggattcttcgtccaggccatcgtcaccgggaagggcccgctcgagaacctcgctgaccacattgccgaccccgtcaacaacaacgcttgggcctacgccaccaacttcgtccccggcaagtgagggaggcgccgccggtgacctttaggtgtccggatgcatgtgagcgcacgctggttttcggtttgtaccttgatgtaaactattgttcaatcgacaaggaataattgtgttcattgtcattaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaa

SEQ ID NO: 69823 - DNA, 658 bp, Zea mays
  misc_feature: Ceres CLONE 1548550
  misc_feature: Encodes the peptide sequence at SEQ ID NO. 69824
acccgcggtggcggccgctctagaactagtggatcccccgggctgcaggaattcgtctcacccctagaaaaaaccgaggtccaaaaatccatctggattctggagagaggagaccccaaaatcgcagcgcgcgaaaacgcaggagcaacccgcccactcgccaccaccgcccgcgcgcacggcggcgaccgatggccccgctcgtgccgatgtcgcagccatgggtggagaaataccggccgaggcaggtcaaggatgtggctcaccaggaggaggtgattcgggtgctcaacaacaccctccagaccgccgacctgccgcacatgctgttctacggcccgccggggacaggaaagaccaccaccacactagccatcgcctaccagctctacggtccagagctgcacaagtcaagggttttggagctcaatgctagggatgatcgtggattctaatgggtgaggacgaaaaatcaagaaccttgcggctggtgctgatggggactgcccgaacaacggggtttcccttgcccaccttacaagatttttattactcggacgaagcagattccggtgccaatagattgccctgaatggccttagaaggcggtaccacaaaaaccttaaccccaaagttgcaccaaaatttttttttttat

SEQ ID NO: 69824 - protein, 87 aa, Zea mays
  misc_feature: Ceres CLONE 1548550
MAPLVPMSQPWVEKYRPRQVKDVAHQEEVIRVLNNTLQTADLPHMLFYGPPGTGKTTTTLAIAYQLYGPELHKSRVLELNARDDRGF

SEQ ID NO: 69825 - DNA, 628 bp, Zea mays
  misc_feature: Ceres CLONE 1548552
  misc_feature: Encodes the peptide sequence at SEQ ID NO. 69826
tggagctccccgcggtggcggccgctctagaactagtggatcccccgggctgcaggaattcgtctcacccctagaaaaaacgccccgccttgccttcatcctcctcctctcctccatctctcctcgccccagcgcgcgcgcggcatcgccgtcgagctacttactcgagcttcagttccagctactggagcacgcagttcatattaatacacagcttagctgtaccaagcggcatcttgcacgctagctaaactagaggaactcgctgcgcgcatgtctccaataatggcgctccaggcatcgtcgtcgtcgccttccgcgttccgtgcggtcccggccaccgccaacgcttcctgccggcgtcagttccaggtgcgcgctcaggtagccggcggcagcagcagtagcagcatcggagccgatggtgggaagatgatggtttccaaggagccggcggcggcggccacgtcgtcgggaccgtggaagatcgacttctccggcgagaagccgccgacgccgctgctggacaccgtgaactacccgctccacatgaagaacctgtcgatcttggagctggagcagctggcggcggagctccgcgcggaggtcgtgcacaccgtgtccaaga

SEQ ID NO: 69826 - protein, 114 aa, Zea mays
  misc_feature: Ceres CLONE 1548552
MALQASSSSPSAFRAVPATANASCRRQFQVRAQVAGGSSSSSIGADGGKMMVSKEPAAAATSSGPWKIDFSGEKPPTPLLDTVNYPLHMKNLSILELEQLAAELRAEVVHTVSK

SEQ ID NO: 69827 - DNA, 613 bp, Zea mays
  misc_feature: Ceres CLONE 1548553
  misc_feature: Encodes the peptide sequence at SEQ ID NO. 69828
  misc_feature (489)..(489): n is a, c, t, g, unknown, or other
  misc_feature (499)..(499): n is a, c, t, g, unknown, or other
  misc_feature (543)..(543): n is a, c, t, g, unknown, or other
  misc_feature (550)..(550): n is a, c, t, g, unknown, or other
  misc_feature (567)..(567): n is a, c, t, g, unknown, or other
tggagctccccgcggtggcggccgctctagaactagtggatcccccgggctgcaggaattcgtctcacccctagaaaaactggcgcgtgtatgtatacacattacacctcatcccttcccctccccccgccacgacccctcagccctcacacaagagacgcagctgcgagtccgccagccttatcctcctccccgtctccggctccaacccgcaagcgcggtaaggtatggcttcgacattcggtgccacttctactgtcggccttatggctgctccaacagggaagaatgtgcgccttcagaggagggtgaacttcagagtaagagcagctaaggagctgtacttcaacaaggatggctcagctatcaagaagctccagactggagtcaataagcttgcagacctagtcggagttcactcggaccaagggaaggaatgtgttttggagagcagtatggtctcctaaaatgctaacgatggtgttacangtgccagagnaggtgagctggaggaccctgtggagaacattggtgctaaatggntcaggcnagcagcagctaagaccnatgatctagctggagatgggacaccaacctctgttgtccctgctca

SEQ ID NO: 69828 - protein, 79 aa, Zea mays
  misc_feature: Ceres CLONE 1548553
MASTFGATSTVGLMAAPTGKNVRLQRRVNFRVRAAKELYFNKDGSAIKKLQTGVNKLADLVGVHSDQGKECVLESSMVS

SEQ ID NO: 69829 - DNA, 622 bp, Zea mays
  misc_feature: Ceres CLONE 1548564
  misc_feature: Translation starting site: 140
  misc_feature (284)..(284): n is a, c, t, g, unknown, or other
  misc_feature (356)..(356): n is a, c, t, g, unknown, or other
  misc_feature (358)..(358): n is a, c, t, g, unknown, or other
  misc_feature (373)..(373): n is a, c, t, g, unknown, or other
  misc_feature (387)..(387): n is a, c, t, g, unknown, or other
  misc_feature (396)..(396): n is a, c, t, g, unknown, or other
  misc_feature (409)..(409): n is a, c, t, g, unknown, or other
  misc_feature (423)..(423): n is a, c, t, g, unknown, or other
  misc_feature (426)..(426): n is a, c, t, g, unknown, or other
  misc_feature (430)..(430): n is a, c, t, g, unknown, or other
  misc_feature (431)..(431): n is a, c, t, g, unknown, or other
  misc_feature (438)..(438): n is a, c, t, g, unknown, or other
  misc_feature (440)..(440): n is a, c, t, g, unknown, or other
  misc_feature (457)..(457): n is a, c, t, g, unknown, or other
  misc_feature (459)..(459): n is a, c, t, g, unknown, or other
  misc_feature (471)..(471): n is a, c, t, g, unknown, or other
  misc_feature (472)..(472): n is a, c, t, g, unknown, or other
  misc_feature (478)..(478): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (490)..(490): n is a, c, t, g, unknown, or other
  misc_feature (503)..(503): n is a, c, t, g, unknown, or other
  misc_feature (511)..(511): n is a, c, t, g, unknown, or other
  misc_feature (527)..(527): n is a, c, t, g, unknown, or other
  misc_feature (529)..(529): n is a, c, t, g, unknown, or other
  misc_feature (543)..(543): n is a, c, t, g, unknown, or other
ggcggccgctctatcctagtggatcccccgggctgcaggaattcctctcacccctagaaaaaaacctcatcttctctacttgtgctcggaacgcactcctagcccggtcgtcgatgtccgatcccctcgtcgatccaagatgcagatcttcgtcaagaccctcactggaaagactatcttcctcgaggtggagtcttctgacaccattgacaacgtggagggcaatatgcaggacaaggaggggattcccccagaccagaagcggatcatcttcggtggtgagnatctcgaggacgggcgcacagttggctactactacatccagaaggagagaaggctccagtttgtttttggtntnaggggagggatgganatctttgttatgancgtttctgnaaagactattagngttgaggtggagtnttntgannggatcancncgttaagggcaatatcnangaaaaggagggnntaactncggaacnnnntngggtgatttttgntggcaatnagttctaggacggttncnagctgggccaatgntaccttctcaacgacagcaccctctcatctgcgtggcgtcacatgagtggactgtagatttcttgaacacgatgaagga

SEQ ID NO: 69830 - DNA, 1081 bp, Zea mays
  misc_feature: Ceres CLONE 1548565-R
  misc_feature (1)..(1): n is a, c, t, g, unknown, or other
  misc_feature (30)..(30): n is a, c, t, g, unknown, or other
  misc_feature (208)..(208): n is a, c, t, g, unknown, or other
  misc_feature (395)..(395): n is a, c, t, g, unknown, or other
  misc_feature (848)..(848): n is a, c, t, g, unknown, or other
  misc_feature (1043)..(1043): n is a, c, t, g, unknown, or other
  misc_feature (1081)..(1081): n is a, c, t, g, unknown, or other
nccccctgggggcctccagcctctcggccntttttttttttttctttgttgatgagcaaatgttattgtgaaacacgccctatctatgtactagtaaaaaaacatgtcgtaccaatccaattaagcaaagaaaggaggggaaaaaatgattcaaggaaataactttggtcagctagatgctatgagccagtgagggccggtggatcangccaccatctgctccagctccggccactgggcaaatatgtcgccggtgtggccctccttgacaaaagagttgaccccccaaacttccggctccggcggggggccctaaggatcccaacctaaacccaaaacacccccactttgggaactttttccccccccccagcggggggggggggggggggggntttttttttccgctaaccacttgtcccccccacccgcgggtgtgtcttttcgtgccggccgccgccctgttttcccgctaccagaacccttctttcccccgcgcggcggggccggggtcgtagttattagcatttattaggaacactcgttggtccccccccccctatctcactcccttattcttgtttcgcccgtttgttcggcgggagggcggggggggcgcattctcctatacgccgcggttcttttctcgcgggttggcggcgccgaggggctgtaccgcgcgtccgactcgcgtctatctcccgccctcgtggtctcgtgcgccgccctcggcgcctcgtcaggtcgtccccccatatcaggttgcctcgcccgtcacctacgacgtcgcccccgtcacgctattctgggcgcctccgcacgaagccgtatcccctatcaccctcccnctatttatcttatgtggcgcgccgtccggcggtagtatttcgtcccgcccccgcccgtattttacgtcggcggccctctccgagcgcgcgcgcgcggtgtgatgttagctcgcccctctattagcggcaccgggcggtggtgtgtttgagcgcgcgtacgcttgtgcctcgcgcagtagcggcgcgccctcccanatgccgggcgcggcggcctatccgtatatcgcggtgcn

SEQ ID NO: 69831 - DNA, 849 bp, Zea mays
  misc_feature: Ceres CLONE 1548565-R2
  misc_feature (849)..(849): n is a, c, t, g, unknown, or other
attggactcgtcgtgtgagcggccctatctatgtactaggaaaaaaacatgtcttacgaatcgaattaagcaaagaaaggaggggaaaaaatgattcaatgaaataactttcgtcagctagatgctatcagccagtcagggccggtggatcaagccaccatctgctccatctccggccactgcctaaatatgtctccggtgtggccgtccttgacaagagagttgacccaccagacatacggctcgctcgggggcggtcgggatcgatagcggaacgcaaacgacgcacacttacttaactagttcaggtcgtctacctgcattcaccagtccagcctgccgtccggccaagcccactcagacagaaaggacggcccggcccgctggcggcgggcctgcttctacatgaaccaagccgagcgggccggggcgggggccgccccccggtcgacaaaaactaatggcttggccctttggctaaaacccccaaagccagggggaagggtaaaggtaagggcacttttgccccacaggccaaggggggttcggacccccccaaaccccaaagttggtcttggggggtcccccaaaccccccccccccccatgggggggtgggaaggaataaacgttccccccatttatttttcgcacattggggggggtggctgcgggtagttttctttttcacccccccccccccatattaatagttaccctgatttgttctgtctccgtggcgggtcatgtattattttttcgctggtcggggtgtggggtgtgttttttgtttttacccttttccccccccctcccacacaaaaataatatgtggtggggtgcgtggggn

SEQ ID NO: 69832 - DNA, 631 bp, Zea mays
  misc_feature: Ceres CLONE 1548567
  misc_feature: Encodes the peptide sequence at SEQ ID NO. 69833
tccccgcggtggcggccgctctagaactagtggatcccccgggctgcaggaattcgtctcacccctagaaaaactccctccctcctccattggactgcttgctccctgttgaccattgggtattctgaaccatcgagccatggctgccaagctgactcgcctccacagtcttcgcgaacgccttggtgccaccttctcctcccatcccaatgaactgatagcactcttttccaggtatgttcaccagggcaagggaatgcttcagcgccatcagctgcttgcggagtttgatgccctgtttgatagtgacaaggagaagtatgcaccctttgaagacattcttcgtgctgctcaggaagcaattgtgctccccccatgggttgcacttgctatcaggccaaggcctggtgtctgggattacattccggtgaatgtaagtgagctggctgtggaggagctgagtgtttctgagtacttggcattcaaggaacagctggtggatggacaatccaacaacaactttgtgcttgaccttgattttgagcccttcaatgccgcctttcctcggccttccatgtcccaatccatccagaaatggagtgcaattccttaaccgaaaccggtcgtccaa

SEQ ID NO: 69833 - protein, 157 aa, Zea mays
  misc_feature: Ceres CLONE 1548567
  misc_feature: SWISSPROT Homolog: EC 2.4.1.13 Sucrose synthase
MAAKLTRLHSLRERLGATFSSHPNELIALFSRYVHQGKGMLQRHQLLAEFDALFDSDKEKYAPFEDILRAAQEAIVLPPWVALAIRPRPGVWDYIPVNVSELAVEELSVSEYLAFKEQLVDGQSNNNFVLDLDFEPFNAAFPRPSMSQSIQKWSAIP

SEQ ID NO: 69834 - DNA, 625 bp, Zea mays
  misc_feature: Ceres CLONE 1548569
  misc_feature: Translation starting site: 164
  misc_feature: SWISSPROT Homolog: EC 1.14.13.68 4-hydroxyphenylacetaldehyde oxime monooxygenase
ggagctccccgcggtggcggccgctctagaactagtggatcccccgggctgcaggaattcgtctcacccctagaaaaaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgtagagctcgtccgcgacgtcccccaaatggaagcagcacaggctgccgccgacgccctccgggaagctccccatcatcggggcactcctactcatcggctccctaccggaagtctccttccgcgacctccacggcaagtacggccacaacgggctgatgctggtgcaagtccgccgcgtgccccccatcctggtgtccacagcggcaggcgcccaaggccgtgctcgcacgcacgaacactgggctggcgtcccgccggcggacccccgtcgccgacatcatccgctacacttccacggacgtggccctcgcgccgtaccgcgagtactggcgccggccgcg

SEQ ID NO: 69835 - DNA, 643 bp, Zea mays
  misc_feature: Ceres CLONE 1548575
  misc_feature: Encodes the peptide sequence at SEQ ID NO. 69836
ggagctccccgcggtggcggccgctctataactagtggatcccccgggctgcaggaattcgtctcacccctagaaaaagaacctcgcgtcctcctcgcctgcctgcctacaagtctcccccctcccctccccgtgcctccctcgggcctcgcttctcgcgctcttcctctcttgcctccgcctgcctccaggctccaacaacccgggagggcgccgtccgcccccgcctccgggagcgatgatgatcgcgcgacgcctgctccgatccaataatgcccccgcccaggcaaccagcttattgaagcatgtaactggcaccgcaagtttgcaaggcaatgcggatagcttgttggatggtacagtcagacattttggctcagcaccgtctgcccagcctgaagaaaatgggttcaagggccacggcatgctggcgccttttacagctggctggcagagcaatgatttgcaccctctgatcattgagagatctgagggttcctatgtctatgacattaatgggaacaagtatctggactctcttgcaggattatggtgcacagctttaggtagtagcgagcctcgcttagtcaaagcagcaactgagcaattaaacaaactacccttctaccattccttctggaag

SEQ ID NO: 69836 - protein, 135 aa, Zea mays
  misc_feature: Ceres CLONE 1548575
  misc_feature: SWISSPROT Homolog: EC 2.6.1.62 Adenosylmethionine--8-amino-7-oxononanoate transaminase
MMIARRLLRSNNAPAQATSLLKHVTGTASLQGNADSLLDGTVRHFGSAPSAQPEENGFKGHGMLAPFTAGWQSNDLHPLIIERSEGSYVYDINGNKYLDSLAGLWCTALGSSEPRLVKAATEQLNKLPFYHSFWK

SEQ ID NO: 69837 - DNA, 634 bp, Zea mays
  misc_feature: Ceres CLONE 1548580
  misc_feature: Encodes the peptide sequence at SEQ ID NO. 69838
tggagctccccgcggtggcggccgctctagaactagtggatcccccgggctgcaggaattcgtctcacccctagaaaaaaacgcgacacaagtccaaattccagacgccgagggacgcggctgccggcctggcgctggcgactggcgagcgccgcaggaaagagaagagaaagaaagagcgcaggcaggctgcaccgctgcaggcatcggcagtcggcaccagtcaaagccaccgttttgattccccttccgttagtaaaacctctgcctcgccgacgcccaccaataaagtccacaaccatttcatttcttctttccccaattcccgtccatcagctcgcaccagcgaccagagcagcagaccaagcaagcgcgagggagagaagagacgaagaagaaaagaaaagccggagctctgccgagcttagtccgcggaggcggcgaccggcgacgcgtaaccatggagcgggcggaggaggcgcagcccgccgccgagcggagggcgccctcgacggcgccgtcggcgcgggtgtcgatctgggagtcggtacgcgcgtgcggggtgtgggggaaggagctggacaaggccgagctgtggaggcaggtcgtcatgccacgctacctgcgccgggcc

SEQ ID NO: 69838 - protein, 58 aa, Zea mays
  misc_feature: Ceres CLONE 1548580
MERAEEAQPAAERRAPSTAPSARVSIWESVRACGVWGKELDKAELWRQVVMPRYLRRA

SEQ ID NO: 69839 - DNA, 645 bp, Zea mays
  misc_feature: Ceres CLONE 1548582
  misc_feature: Encodes the peptide sequence at SEQ ID NO. 69840
  misc_feature (645)..(645): n is a, c, t, g, unknown, or other
ggagctccccgcggtggcggccgctctagaactagtggatcccccgggctgcaggaattcgtctcacccctagaaaaactccgccaatccatccgcacccgccaccatgtccggcctcctccggtggcgtcgactctccgacgccgcctcacgcgccgtctccaccctgcccgcggccgagtgctccccggccgccgcgtctgctgctggcgcgggtgcccagccgccgccaccgcacctgcgcctcctggagcggcgctagtgggagtcctcctcgggctccgggggcagctcctcatcctccaccaatgagcccgagccgcgccgtatctcgcgcggaggcccactgcccgcgctgctccatggtcatggacatcctctttgccagcggggccctccgaccgcagccgccgtcgtcggctatcaggcgctcaacctctgccctaattgccgcaacgcctacttcttccacccccacgtactagagccgctccagagcaccttcaacaagatcggtcgcggttgggacgaccatctctacctccccgtcgcatggccagggacagggacccagtcttctgagaggctatcaagaactgctccacgtctcgcaacaactggggacgctgcagcttccccatgcan

SEQ ID NO: 69840 - protein, 51 aa, Zea mays
  misc_feature: Ceres CLONE 1548582
MSGLLRWRRLSDAASRAVSTLPAAECSPAAASAAGAGAQPPPPHLRLLERR

SEQ ID NO: 69841 - DNA, 618 bp, Zea mays
  misc_feature: Ceres CLONE 1548584
ccgcggtggcggccgctctagaactagtggatcccccgggctgcaggaattcgtctcacccctagaaaaactttttccccttcacagccccgtactactatccccgctaccgctagccgccgcgctgctcatctggtggcgggtcgcctccctccccccatccgccgccgccggctcctcctctagctccctccttaccccgagctttaagctcgtgctacctgcctacctatccgtagggagagagagagagaggggagaaggttcggtcggtcggtcaggggctctcggatctcgccgctgcctccccgtttcttcgttgggatctcgctcgcttcgcgccatggacgccgtctcgacgccaccgagaccccgcgcccgccgcgccagcaccggcaccggcaccgggtgctgctccggctcccgtcaccgacgcccctgccgcggaccagaccacggatctgctgcagaagttgtcgctggattcacagcccaaggcggcaggtgcgacagagcctgctgctgctgccgctgcctccaaggatggtgctgtgacaaaccagcagctgagtgtggccatcccgccagatcggtctatcacgccggtgcatcccagac

SEQ ID NO: 69842 - DNA, 681 bp, Zea mays
  misc_feature: Ceres CLONE 1548585
  misc_feature: Encodes the peptide sequence at SEQ ID NO. 69843
  misc_feature (477)..(477): n is a, c, t, g, unknown, or other
  misc_feature (556)..(556): n is a, c, t, g, unknown, or other
aagctggagctccccgcggtggcggccgctctagaactagtggatcccccgggctgcaggaattcgtctcacccctagaaaaaagaaatcttccgtggcaagctctcagaagacgcagtcgcttcgcttctctctcgtgcgctcggttcccctcgtctcgctctcgcccgtcgcccctcccgggacaagaaagcaacggaacatcacggaaagcgagagccggcctgacctgacctcactcgacctgcgctagccgactgtctgaagttttgcccccctttttctccttcccttttgggccgtgggccggccgcgcgccccggcgcatggcgtcttcgcgggtgatggcgtcctcgtcaccgccgcatcacgccggagccggctcgtcctcggacctagcgcgattcatgagcagcggcggcatcggatccatgagcatggacaacattatgcgtgaaatctacggccccgacgccntccaatcgccaccgtcaacgggtcggggtggagccctcccccggcggcccctggatgcatgctgcccaggcggacgtcngaaggaaggggggaaatgagatcttccgccgccggggggggctgtcccgttcccggggcctcccttcccccctcccggcgagaggaactgggccccgggggccaaaagggggaggggggccggcc

SEQ ID NO: 69843 - protein, 82 aa, Zea mays
  misc_feature: Ceres CLONE 1548585
  misc_feature (51)..(51): Xaa is any aa, unknown, or other
  misc_feature (77)..(77): Xaa is any aa, unknown, or other
MASSRVMASSSPPHHAGAGSSSDLARFMSSGGIGSMSMDNIMREIYGPDAXQSPPSTGRGGALPRRPLDACCPGGRXKEGGK

SEQ ID NO: 69844 - DNA, 971 bp, Zea mays
  misc_feature: Ceres CLONE 1548586-R
  misc_feature: Pfam Name: GlutR_dimer Pfam Description: Glutamyl-tRNAGlu reductase, dimerisation domain
  misc_feature: SWISSPROT Homolog: EC 1.2.1.70 Glutamyl-tRNA reductase
  misc_feature (971)..(971): n is a, c, t, g, unknown, or other
agatatgggtccataatgctataatttagtctttcttctgtggggaattgggacacgtagctgttattgacaacacgctgccatggctctaattcacagacacagttaacgatcactgtgagcaggagaagggctctctgagtgaaaggataaaaaaaaggaatgagattggagacgctatatatatagataatggtggtagaaaaattgcttcctggcctcagttttaggtcttctccaccttggccttgatcttctgctcgatgatcgccttctcactgtcgaggctgaacatccggttgagggcgtgcatgatctcgagcgtctcctcaagggtgctgctgtctctgcctatctcacctcgaggtggtgtagaggaccacgaaggacctttgtatccatccccccgctcagctccaggattgggctcccactcttctttcttggacgaatggtgtccccttcctacctttcttgaacgcaactttcttttttgctttaaagcacccctgataccctgttcccactgagaaaaccccccctccttttctttgaagcggttaggaaaaaagatactcatatccctcggtccccccctccatggcccttagcgaacacccttccatccgcatttcccttctattgtaagcaaggaaatccgccccctccgccctcccagcccagtcgagctttttgctcattgaagagatctagtgacactgcgctggtagctgccgactacgccccatctctgctgaccgtcttctaacgttctgcttcgcaagattgggtattctccctcccatcgccgcccggcccacacctctttttaatcatatccattatgcgcgccaaacttatcgttcgtgttagcctctaataccatccttgctcttatggagtgtctttgctccgccggccccttttggcagtcccagccaaccgtgtcactgaagttggctcccctaccn

SEQ ID NO: 69845 - DNA, 616 bp, Zea mays
  misc_feature: Ceres CLONE 1548586
ggcggccgctctagactagtggatcccccgggctgcaggaattcgtctcacccctagaaaagattttgccgatgagactgtgaactcccgcagcttcctacttcctctctctccgtagaccctcgctgcaagttctgaacgtgaagagagggagagaggtgagcgcacgagagtttctgctcctactctcggctcgacacgactccgtctcctttccctctctggttctctctctgcgattctcggagatttggctccggtacctcacttaaggctgttgctttctgtcttacctgatctagctcgataatggcgacgacgacatcagcctccacgggcacaccgacctgcgcctccaccttgtagccgaggaggtcgccatcagccctctgccagacggtggccggctgcggctggcagagctccagtgtggtgcggcgtcacgccccccgcctggacgcccacgcacgagtcctgtggaaggcggtgctcgtcgcccccatctatctatgattgatatccgccgaccgcggcttctactgataggtacaccatagctgagataggcctcattgcccacacagctcccgtggacatgcgtgacatacttgatgcc

SEQ ID NO: 69846 - DNA, 628 bp, Zea mays
  misc_feature: Ceres CLONE 1548587
  misc_feature: Translation starting site: 235
  misc_feature: Pfam Name: Peptidase_S28 Pfam Description: Serine carboxypeptidase S28
ggcggccgctctagactagtggatcccccgggctgcaggaattcgtctcacccctagaaaaaacgctgcttcttcgctcccccacaaagggaagaaaaaaaatttccgtggacagtttcgcccggggccgcctttggcattggtttgcttgctgttgccctggtgagctgcaaaggatgtccatttcaccactcccatcgatcccagctaccggtcctcatcaagcagccggcgatggggtccgcatccgcccgtatcgacaccggcgccgtgcacctcgtcaccgtggccgccatcctcctaatgctcgatcgaggcggtgaggccgtcagtctctggctcccgccgcctaccgcccgaggacggggcttcctcggcggagcggaccgttacctgactcgagaggagcactggatgaacctaccctggatcacttcaacccgacggaccatcggcaattcagacagcgtgactacgaatttctcgactactaccgagctccaaatggcccgatattcctatacatctgaggacaatctacttgcaatgggattggcaataactacttagctgtggtggcaaagaaatttggtgctgcattagcttcgcctgagcatcgatactatga

SEQ ID NO: 69847 - DNA, 678 bp, Zea mays
  misc_feature: Ceres CLONE 1548588
  misc_feature: Translation starting site: 238
  misc_feature (436)..(436): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (464)..(464): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (495)..(495): n is a, c, t, g, unknown, or other
  misc_feature (496)..(496): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (666)..(666): n is a, c, t, g, unknown, or other
ctccccgcggtggcggccgctctagaactagtggatcccccgggctgcaggaattcgtctcacccctagaaaaagcggccgccggggcgtcccggatcgtggtggtgcttgccgtcgctggtgagtccatgagacgtgtgtcacccggccgttcagcgcagagcccatccggccatcccgttcgtacctaaccggcaccttcttctgcggatcaatccggcaaagccagcgcgcgcgatgcgccggcggtgggacagctgcttctcgggcggcgacgtccgcgtgggcgggcgcgtcccccccgaggagccggagccggaggtcttctccttcgccgagcccctcccgtcgtggcccacaggcgggggattcgcgcgggggaggatacgtatcggcggaggggagctggagctcgccgcggccaccgcgttccagngatctgcacctgctccgnnnnnnnnngnggggggggnnnnnnnnnnnnnnnnnnttttnncggggcggggggggtccccggaggggttctcgcctcctgggtttcctcctggcccgccctatcggccgccccggtcccccgggccccttccctcttttgcccgagcggggggaagcgccccgtcccggggcccttccccttnnnccgcccgcccgccggcccgttcttgnaagcccgcgtgt

SEQ ID NO: 69848 - DNA, 653 bp, Zea mays
  misc_feature: Ceres CLONE 1548590
  misc_feature: Encodes the peptide sequence at SEQ ID NO. 69849
  misc_feature (653)..(653): n is a, c, t, g, unknown, or other
gcggtggcggccgctctagaactagtggatcccccgggctgcaggaattcgtctcacccctagaaaaaagcaagccaagcgcaccaccaccacagacatcatcagatcaccacctagtgctagtgatgacagaaagaaagaaaagaaataaggcaggcgcgccaaaatggacaacggcggcagcaacaggatccgccaccgcctccgcctgctggaacggcaaatattaaccgcgggccgcacgtgagctgatgctggcgacgcccggcatggggcacctgatcccggtggcggagctggcgaagccgctggcgtcgcgggacggctgccacggccaagctcatcacgttcacgtccacagcatctcccacgcagcgcgcgttcctagcctcgctcccgcccgcggtgtcctcgctgctcctcccgaccgtcgacctctccgatctgccacgttccgccgccatagagactcgcatgtcggatgaatgctcgcgctgagtgccagcgctgactgccgtactcagcggcctcatgcatatcacagcaggccgcctaggagacttcatggacgacgtcttcggctgctactcgctggactccgcccgcgccgcgagggtccgccgcaagtgcatcttcttcacatccaagctgcn

SEQ ID NO: 69849 - protein, 29 aa, Zea mays
  misc_feature: Ceres CLONE 1548590
MDDVFGCYSLDSARAARVRRKCIFFTSKL

SEQ ID NO: 69850 - DNA, 1044 bp, Zea mays
  misc_feature: Ceres CLONE 1548590-R
  misc_feature (1)..(1): n is a, c, t, g, unknown, or other
ncaaattgggaccgggccccccctcgaggtcgacggtatcgatattttttttttttttttttttttttttttttaggttaaagtaatcaatatattcggcaaccggagacatttacactgaggtctagtttggcaatcatattttaacaagggatttccattttcctaaagaaaattaattcattttttcttggaaaaataagaatgtcttggaaaaatagagctgtcaaactagcactgaaggtacaaactatagtcgccttattccgtcctctccaccttcacacatcaagttgatcgatctctcgatgggcatgggcatgcatctcatgaacgaagtagtaccagcaagcttgcagagtcaactgctctcctgcttcgtcacagggcacagggaggggccccccccccatccaaggctcgctaatgaaaaaccccagccttctggaacatcaaccaggcttataaaagatcccccaccggcgtttgggtgtttccaaaaggaaaaaaaatttccccccctcctgcttcaatacgggggagaaggccaaaatttcttgacccttaaaagatttgcccccctccaaggcctccaggtgggttggagaaacaaccttcttccccaaaaaggtcccaaaccaaaaaatgggggaagtggttcccccacaagacaaacaaaaaaacccggcgccccctgggggtatttctctaagactctgggggccccctttgttttgttccaaaaaaaaacaacactcggggtggtgtcttgtagagccccttttgggccccttttggggagggcagcttttctcaaaggtagggggtgggccccttcatgattcttttgtgttgagagggctcctccttggagcgccccgcaccctcaattataacccccctctttttgtcccccggacggaacatatttggtgacgttctcctggggaaagagggagtgtttatataacgggtttcccctaatgcccgctgtttggccgccactttgttgtgcccgccaacagcgtggagacttccgccccc

SEQ ID NO: 69851 - DNA, 641 bp, Zea mays
  misc_feature: Ceres CLONE 1548602
  misc_feature: Encodes the peptide sequence at SEQ ID NO. 69852
  misc_feature (374)..(374): n is a, c, t, g, unknown, or other
aatctggagctccccgcggtggcggccgctctagaactagtggatcccccgggctgcaggaattcgtctcacccctagaaaaagtctgctgccgacgaaagggcggccgccgccagacctccatcttcgtgaccttcgtaggcggcgagcacccaccaggagaaggcatggcttcacgcatgacaccttccaagaggccttttcagagaagatcttcagactacgatggccggggcaagtggcagaagacgaagcacccttctccacataaatctcagttcaaaatcgagcctggtgttcccattttccgtattctctgcccggcttcaaaatctggtaatgtgattggcaaaggaggtgtcattattgcaaanatacggcgggaggcggggatgagaatcagggttgatagggcacccccccgctgtgacgagagagtcatcttcataactgctgccaacaaagatgaaaaagctggcagcgaccaaggcggaaagaatgacggaagtgctgctgcttcctccgggggggaccctgagaaggataaagatacccccgccagggaccaaaccttgtcccgaagaaaaccactgccacaagccaattgtgattcccaaaaaagggaggggtaaggaaaaaaa

SEQ ID NO: 69852 - protein, 209 aa, Zea mays
  misc_feature: Ceres CLONE 1548602
  misc_feature (101)..(163): Pfam Name: KH_1 Pfam Description: KH domain
  misc_feature (124)..(124): Xaa is any aa, unknown, or other
SGAPRGGGRSRTSGSPGLQEFVSPLEKVCCRRKGGRRQTSIFVTFVGGEHPPGEGMASRMTPSKRPFQRRSSDYDGRGKWQKTKHPSPHKSQFKIEPGVPIFRILCPASKSGNVIGKGGVIIAXIRREAGMRIRVDRAPPRCDERVIFITAANKDEKAGSDQGGKNDGSAAASSGGDPEKDKDTPARDQTLSRRKPLPQANCDSQKREG

SEQ ID NO: 69853 - DNA, 641 bp, Zea mays
  misc_feature: Ceres CLONE 1548607
  misc_feature: Encodes the peptide sequence at SEQ ID NO. 69854
  misc_feature (566)..(566): n is a, c, t, g, unknown, or other
gcggtggcggccgctctagaactagtggatcccccgggctgcaggaattcgtctcacccctagaaaaaaacggacgccacctcctccccctctctcgcccgcttcctgctctctctttctctttctcccctgcttccccttccattcccgacggacgacgcaacaacccgcctgccctgccctgcctcacgctcgcacccgcggcggcgcggagggccggaacctaaaccctaaccctagcggcccgcccgcgatggggcagtgctacgggaaggcaggcggcgcgtcgtcgcggcgggcggaccacgacgaccacgcccacgcggtcgcgccgccgtccccgctgccggccaacggcgcgccgccgccgcagcccgccacgcccgggcgccgcaagtccggatcggccacgccggtgcaccaccaggcggcgacgaccgcctggcccagcccgtaccccgccggcggggccagcccgctccccgcgggcgtgtcgccgtcgcccgccaggtccacgccccgcatgttcttcaagcggcccttcccgccgccctcgccccgcaagnacatcaaggccactctcgccaagcgcctcggcgggggcaagcccaaggaaggcaccataccgggaggaagggcgg

SEQ ID NO: 69854 - protein, 129 aa, Zea mays
  misc_feature: Ceres CLONE 1548607
  misc_feature (105)..(105): Xaa is any aa, unknown, or other
MGQCYGKAGGASSRRADHDDHAHAVAPPSPLPANGAPPPQPATPGRRKSGSATPVHHQAATTAWPSPYPAGGASPLPAGVSPSPARSTPRMFFKRPFPPPSPRKXIKATLAKRLGGGKPKEGTIPGGRA

SEQ ID NO: 69855 - DNA, 638 bp, Zea mays
  misc_feature: Ceres CLONE 1548609
  misc_feature: Encodes the peptide sequence at SEQ ID NO. 69856
  misc_feature (524)..(524): n is a, c, t, g, unknown, or other
ctggagctccccgcggtggcggccgctctagaactagtggatcccccgggctgcaggaattcgtctcacccctagaaaaaacaccttcaagcgccggtagcaaaaccacagctttcctccatccccagcaagaaaaccgagcgatctagcataccaccacagaagatttcctactcggccgcacgtgcagacccagatctgactgaaagaggcaggcagcagctcaatcggcagtaaccgtgagcgagccatgggactggcctggatggtgacggcggccgtcgcggcggtgctggcgtcgtgggcgttcaacgcgctggttcaccttgtctggcgtccctacgccatcacccggaggctccgcgcgcagggcgtgcgcgggccgccctacacgttcttcaccgggagcctcagcgagatcaagcggctccgcgccgagggcgccgccgtgacgctggacgtcgacgatcacgacttcatccccatggtgcagccccatctccgcaaatggatcgcgctctacnggcggacgttcgtgtactggaccggcgcgaggccgaacgtgtgcgtggcggacgtgaacgtggtcaggcaggtgctcttcgaccgcaccgggctctaccccaagaacctcatga

SEQ ID NO: 69856 - protein, 129 aa, Zea mays
  misc_feature: Ceres CLONE 1548609
  misc_feature: SWISSPROT Homolog: EC 1.3.3.9 Secologanin synthase
  misc_feature (92)..(92): Xaa is any aa, unknown, or other
MGLAWMVTAAVAAVLASWAFNALVHLVWRPYAITRRLRAQGVRGPPYTFFTGSLSEIKRLRAEGAAVTLDVDDHDFIPMVQPHLRKWIALYXRTFVYWTGARPNVCVADVNVVRQVLFDRTGLYPKNLM

SEQ ID NO: 69857 - DNA, 620 bp, Zea mays
  misc_feature: Ceres CLONE 1548610
ctccccgcggtggcggccgctctagaactagtggatcccccgggctgcaggaattcgtctcacccctagaaaaaactctctctttgcggccggtctctgctttcagattcatttctaaccagggttcctccagcccagccgccgccactgttgaggagctcacatcgcctcgacacaacacggtctctggtttcaacgtaagctctaactattccctctttgatccgttctgttccaccctgacccaatcttacaatattatggatacatatgatcttttcttcattaacaaggatgatgaagaggaagaattacgaattttttttttgtcacagcagtgttccgttcgttttattttgcaagtgagggttttaatttagctgctaagccgataaaaggccgtccgatttgaaatactagaaccgaattgaatcttccagtactgaggtacaagatttcaggagcgaactcaggctgttcacagatctgtactggaatatgggtgggtactgtgtaggccataagaagatgcagtgtttgttttcttttaatttaaactcatcaatgaatccatcgttgttgcttggggatcatagggccatgcacaattgaatttaatt

SEQ ID NO: 69858 - DNA, 549 bp, Zea mays
  misc_feature: Ceres CLONE 1548612
  misc_feature: Encodes the peptide sequence at SEQ ID NO. 69859
ctccccgcggtggcggccgctctagaactagtggatcccccgggctgcaggaattcgtctcacccctagaaaagtccgcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactgggagtcataggcttgcagacctagttggaagtacactcggaaccgagggaaggaatgtcgtttttgagagcaagtacggctctcccaaagatcgttaaccatgggcgttaccatttgcaaaaaaaggttgaacttggaagaaccccgggggaaaaactttgggggcttaaatggggcc

SEQ ID NO: 69859 - protein, 84 aa, Zea mays
  misc_feature: Ceres CLONE 1548612
MASTFGATSTVGLMAAPTGKNVRLQRRANFRVKAAKELYFNKDGSAIKKLQTGSHRLADLVGSTLGTEGRNVVFESKYGSPKDR

SEQ ID NO: 69860 - DNA, 670 bp, Zea mays
  misc_feature: Ceres CLONE 1548620
  misc_feature: Encodes the peptide sequence at SEQ ID NO. 69861
  misc_feature (606)..(606): n is a, c, t, g, unknown, or other
  misc_feature (670)..(670): n is a, c, t, g, unknown, or other
ctccccgcggtggcggccgctctagaactagtggatcccccgggctgcaggaattcgtctcacccctagaaaaagtcgcggagccgcctctacccagcgtcccccgaagtctaaccctagatccggaccggccatggcgtcccgccgggtcgtgctctcgctcctccgctccgcgtcccggctgcgggccgcctcgcccgctgcgccacgcccgcgcgcgccaccgcaccgcccgtccccggccgggtacctcttcaaccgcgctgccgcctacgcctcttccgccgcgtccccagcggcacctgccaccccgccgccggccaccgggaagaccgggggcggctagatcccctacgagttcaccggctctggcgccatcggccaggtgtgccaggtgatcggcccccgcccttgacgtgcccttcaatgaggggctcccgcccatccttaccgggctcgaggtgctcgaacactacatcccgcctcgggctcgagggtggcgcaaccccttggcgagaacctggggccgcccctccctttggaccggcacggagggggcttgtccgccggcccgccccggtcctcaaccctgggttcccccatccncccgaggcctgtttgggcagggccccccccttgggaccccttccctagcagggtccttgggggn

SEQ ID NO: 69861 - protein, 70 aa, Zea mays
  misc_feature: Ceres CLONE 1548620
MASRRVVLSLLRSASRLRAASPAAPRPRAPPHRPSPAGYLFNRAAAYASSAASPAAPATPPPATGKTGGG

SEQ ID NO: 69862 - DNA, 578 bp, Zea mays
  misc_feature: Ceres CLONE 1548627
acccgcggtggcggccgctctagactagtggatcccccgggctgcaggaattcgtctcacccctagaaaaatgtatagtaaaatttatgtacaaaaaaaaaaagtcaaagcgacatagtttggaactgaattagggggtgtttggtttctagagactaatttctagtccctacattttattttattttagttccaaatttgcaaatatagaaactaaaactctattttagtttttatattttgacattttatatactaaaatggataaaatgattggagtaaacattagtctataaaccaaacaccctaattaccctatctccggtgaactttccgtttctgcctacttgccaaactaaaaaaaaaaacttgtgttttttttttttttaaaaagaaaagggtttgtcaactgggcccccgggtccccccccctttcttttccagatatcttaaaccttaaaaaaaataccccaaaggtttgttttttccctggggcccccccacagggttttggggccaaataacccccttggccctttttttttttttttttccccaaaattttgccacttgtttaa

SEQ ID NO: 69863 - DNA, 642 bp, Zea mays
  misc_feature: Ceres CLONE 1548631
  misc_feature: Encodes the peptide sequence at SEQ ID NO. 69864
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (524)..(524): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
tggagctccccgcggtggcggccgctctagaactagtggatcccccgggctgcaggaattcgtctcacccctagaaaaattcatcttctccaaactgcctctccccacccatctcgcccatgttcgcgaaacccagagccgaaccgcccccagtcgacctcggctctccggcgagctgccctccatgtcgtggccacacagtcgttcgtcgcgccgatcgcccaggaagatctgcgatgcgctcgtcgttgccgaggtgccttcggtgcaatctatgcttaggtaaagaagaatgcgtcgaggcggatctccaggagttccaagacttcgacgagttcgaggattaggctagcgacctcccccagtcagctgcctgtggtgggtttatttacgttggctatgtttctattctgtgtactttgattatattatgtaaatgactctagtctttaatattattactcattctatattgttattcgaagcattgtgctaaaaaannnnnnnnnnnnnnnnnnnnnnanannnaaaaaaaaaaaaaatttaaaaaaaaaaaaaacgagacgctcgaggtacccaattcgccctatagtgagtcgtattacgcgcgctcacttggccgtcgttttacaacgtcgtgac

SEQ ID NO: 69864 - protein, 75 aa, Zea mays
  misc_feature: Ceres CLONE 1548631
MFAKPRAEPPPVDLGSPASCPPCRGHTVVRRADRPGRSAMRSSLPRCLRCNLCLGKEECVEADLQEFQDFDEFED

SEQ ID NO: 69865 - DNA, 674 bp, Zea mays
  misc_feature: Ceres CLONE 1548632
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (299)..(299): n is a, c, t, g, unknown, or other
  misc_feature (399)..(399): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (475)..(475): n is a, c, t, g, unknown, or other
  misc_feature (543)..(543): n is a, c, t, g, unknown, or other
  misc_feature (589)..(589): n is a, c, t, g, unknown, or other
  misc_feature (590)..(590): n is a, c, t, g, unknown, or other
  misc_feature (601)..(601): n is a, c, t, g, unknown, or other
  misc_feature (602)..(602): n is a, c, t, g, unknown, or other
agtcgagcgttcactggagttcgaaannnttnntngtggatccccgggctgcagattcgtctcacccctagaaaaagtagagctccctgctttgttcagacttcagagctattcctcttgtgtccgtgcaaattggtgatacttgaacgggatctcctccatattagtgagcggatgttatcctcccagtgggcaggacatgtcctactacgatcatgtgcagaagctcgatgagagaaggctgcctatttgctgcctgttcactgcgtgctgctgtgtcggctgaatccccccttgtnagtgctgcatcgagggggctcctacatctcccacccgcgattggagggcatggcgcccccccaaccttcaaaacacacatctttgggaagtccccccccncaacaccgggcaacacggtctttagtcccgtccgcgaatccttcaccgccccgcgtgannngccccttgggtggtnggacgtccccaacgcttatagaaaccgtacaccaacttttccgacggacaagtcgcgcaaaaagcgtntcttattaccccggttcagcaccaccattggcaaccactccctcanncccaaccacgnntcctgatcatctcccgcgtgcagaaagataacccttcacggagtttatagtagtagccgttggcgggttaca

SEQ ID NO: 69866 - DNA, 631 bp, Zea mays
  misc_feature: Ceres CLONE 1548635
  misc_feature: Translation starting site: 171
  misc_feature: Pfam Name: Trypsin Pfam Description: Trypsin
ctggagctcaccgcggtggcggccgctctagaactagtggatcccccgggctgcaggaattcgtctcacccctagaaaaaggtccagattactctgaccggaccgacctttcttcgtcttccccgttcggtatttccgccctcggcgccgggaaaccctagcccgcgtccatggacgatccctcctccgcctccaacaagcgcaagcgcgggcgcaagcccaaggtgtcgccgccctcccccgaccgctcatccccctctgcggtggccgcccccgctcccgttccggttgcgcgccgtggccgcaagccgcgacgtcatgaggaccccgccgacgcggacgccgcgcgtccgccgtccccgctccgccgcagggtgcttaatacggtggcaaatggaggcgatgcggtggcggaggcaggccccgcgagctgggacgaaggtggtgaggggtggtgccgtgcatggacgccgtggtcaaggtgttctgcgtgcacacggagcccaacttctcgctgccgtggcagcggaagcggcagtacagctctagcagtagcgggtttatcatcagcggcccgccgtgtcctcaccaatgcccactccgtggagcactatacccaggttaagcttaa

SEQ ID NO: 69867 - DNA, 633 bp, Zea mays
  misc_feature: Ceres CLONE 1548641
  misc_feature: Encodes the peptide sequence at SEQ ID NO. 69868
  misc_feature (373)..(373): n is a, c, t, g, unknown, or other
  misc_feature (374)..(374): n is a, c, t, g, unknown, or other
  misc_feature (388)..(388): n is a, c, t, g, unknown, or other
  misc_feature (601)..(601): n is a, c, t, g, unknown, or other
  misc_feature (604)..(604): n is a, c, t, g, unknown, or other
ggagctccccgcggtggcggccgctctagaactagtggatcccccgggctgcaggaattcgtctcacccctagaaaaaacacggtcacacacaccacaacccagccacccaccacctcccccaattgcctcttctcttctcccagcagctgccgcgacgcagtcctactcctgcggtgcctccagtttcgcagcaccgttgccacacatcgccaactaacgccatcgatcacccggcggccgcccagagtcctgccctgccatatccgaacctgctcctgcagctagccagcaacacagacagaataggtcggtcggtcgatcgatcgatggccagcgttatcgacggcaatggaggcagccggctggtggtnngacgagctgggcanctcaaggagctggcgatgcagctggaagggcaccttcggcggtcctccgcggaactctgcaagcactccgctcccagaatttcctcaatcaccgaacggctcattcaagctggtcataaccggcaactcatcaaagcccccaagggggggccctctgaagcggcccccctttcataagggctcctaccaagaaaagggaagaggatgggacanaanaagcatgaaggggaaggtgggggtcccgc

SEQ ID NO: 69868 - protein, 78 aa, Zea mays
  misc_feature: Ceres CLONE 1548641
  misc_feature (16)..(16): Xaa is any aa, unknown, or other
  misc_feature (20)..(20): Xaa is any aa, unknown, or other
MASVIDGNGGSRLVVXRAGXLKELAMQLEGHLRRSSAELCKHSAPRISSITERLIQAGHNRQLIKAPKGGPSEAAPLS

SEQ ID NO: 69869 - DNA, 782 bp, Zea mays
  misc_feature: Ceres CLONE 1548651
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
gcagaagctccgcctcgtagccgtccaactaatatacttaaaaaannnngggctgcaggaattcgtctcacccctagaaaaaaaagccatggcaggttgagagcatctcctctagttctgggatagggataggaatcagggtcagtttgctctgctggctacttccagcagcggtggaaggggcatgcagaggagcacgagctaggtgtggctggaagaagcaccccgcccctgtgtgctataaaccccctcgcaagctctcctctcctctcctctcctgtgcactgcctcttgcattccttctgctaccccattaatatgttttgcaaattttcaaaagtgcaagcttcctgcactttcacttgttaacaagttcaacccattgcgcaaacattctccgttgggaattcccttttcccgcctaggtccacccggcacttgtggctaactctttataggcttccttacgggcccttccacccttgactttcccttgaaattatcttttaaactcggccccttttgttctaatttttttcacattcccagtgtaacccccagctgagcaaataaatataattaaaatgcttcgttggtccgtgtgttccccctttttcccccccctcttgggtaagtcgtaataatcacaccgtcccctcccagtgctccctttcttttctactcacctcctggtccactggctgaaacaccccgtgcgcgggaaaccacaatatgaaaatcatttttatcctatttattttccccccctcatcacagtagcg

SEQ ID NO: 69870 - DNA, 649 bp, Zea mays
  misc_feature: Ceres CLONE 1548654
  misc_feature: SWISSPROT Homolog: EC 2.7.9.1 Pyruvate, phosphate dikinase
ctccccgcggtggcggccgctctagaactagtggatcccccgggctgcaggaattcgtctcacccctagaaaaaacaagttcacctctcttcttgttactgcactcactctccacatcacaccccctctcctgctccgttggagctcaagtacaccattttgctctgggcggccacatagcaatcagctctctactccctctcccattgctctatatgatcatacaacccatccatctacacgcgctgactgcattctctggttccgcccaagcatgggatcagaaggatggcggcgccccgtttccaaggccactctgcaaatcagtaagccgtggctcagaatgcaacacggacatggaaacgacctacgtctccatccgataggtccaagcatccatgcccccgcactccagaatcgccggcctcataatctccgactcgggagctggacgtggtcatcattgctcgccagataacgaacgtcatcgactccacgccaattcagacgacccaaaagagggtgttccacgtcggctacggcaataccgacgggaacgagactatgaatgaactgctggaaggcaagggcgctaacctggcggaaatgcgtagcatctggctgtcggtgacctcctgggctcactgat

SEQ ID NO: 69871 - DNA, 720 bp, Zea mays
  misc_feature: Ceres CLONE 1548660
  misc_feature: Encodes the peptide sequence at SEQ ID NO. 69872
  misc_feature (670)..(670): n is a, c, t, g, unknown, or other
ctggagctccccgcggtggcggccgccctagaactagtggaacccccgggctgcaggaattcgtctcacccctagaaaaaaaaacccgactccgtttgacgcggctccgatggtcacaaccggcgccctcgtcgccggcgccgcagtcaacacctgagacctcctcctgcctgcctgggaagggcgtgagcttgccgctgccgcgatccgagtacgagcccccgcggatgcattatcagcatgccggtagccgcagccgcatgccgccgttcgcacgcggcggcggcgcctacagccgcggacagaaacagttctacccgccgccacctcctcccctcccggcggccgcgctgcctctgctgccgcagaacaagcatgaggtgctcatggaagccggccgcctcgctgccgagtacctggtggcgaagggcgtgctccctcctggctccttgcagcagcgcggcagcacagtctcgctgggttgggtggggccagctaccgcctccacctccaccgccgctttcggtgacacaggaagccccagcataccatatcgccaggaatagccggcggcagatcgatgatgagcgtggtattcgtaacgcccgctcacggcgggaaccgtggtggcgactacagtagcagcaacggtagtaactataatggaaanggggaaaaggaaatttggggctgaacataagtattcaattggacaaggaa

SEQ ID NO: 69872 - protein, 112 aa, Zea mays
  misc_feature: Ceres CLONE 1548660
MHYQHAGSRSRMPPFARGGGAYSRGQKQFYPPPPPPLPAAALPLLPQNKHEVLMEAGRLAAEYLVAKGVLPPGSLQQRGSTVSLGWVGPATASTSTAAFGDTGSPSIPYRQE

SEQ ID NO: 69873 - DNA, 685 bp, Zea mays
  misc_feature: Ceres CLONE 1548665
cgccatggcagccgctctcaaggggggggagcccgggctgcccgaataaggctcacccctgaggaaaggcagcctgcggctctcatcacctgagttgcccacctattaccttcctcttttgcgatttagaatcacccatagatctacctgctctcggtcctctgtgaagtctgtcgtcttctaggtttcccaggcctcaagataggcctctggaccaaagcttgaaaccaggtgctgttcgtgccgctttttttaattcttcatttcggggttcctggatttttgggttcttaagtttcttgtatgttcccccaacctcccaaaatcttgtggagaagtttcttcgggttcggtgtttcgggaccctggacaaaaggattccgccggcgtccctattgcaattacgcggagtccccggcctgattcttccccccatgccctactgtctatgaggggattcttcctctgaaagagaaagggggacggttggcccttgaattacattaatgactggtggccactattgttcccccggggtggtcttgggagaaggttggtttttgtattgtgagacctgccctcttgcagaatctcttctcaaggggctccaagatttggattcctggcgggggaggagtccggcctaatatgaaaactttctgggagacccagaggtttcccctat

SEQ ID NO: 69874 - DNA, 922 bp, Zea mays
  misc_feature: Ceres CLONE 1548666
  misc_feature (12)..(12): n is a, c, t, g, unknown, or other
  misc_feature (14)..(14): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (24)..(24): n is a, c, t, g, unknown, or other
ttttgggttggngngtttgnnnanactaccggtatatactcctaacctttcctgtccctggagctcaccgcggtggcggccgctctatactagtggatcccccgggctgcaggaatgcgtctcacccctagaaaactatctatagttcgtgttaccgttcgcttctgtcaccgtgttagtgtccgttctacctttggattaggtgttggtacccctgttgttccctttgtttgctcccgctatgaaacgagacgagagaagaatgagcaaggttttcgttcccagctatttttgtcccatgatatggatatgttgttccaaaaaaaaaaaaaaaaacgagacgcgtcgaggtacccaattcgcccttttagtgagtccgtatttaaagggggtgacttgtccaaccattttaccaaccgttcttgaacccgggaaaaaacccgtgggggggggtcggccgagttgattcggccctttgcaatcaaaatccggggcgcccccccccccgtgttttggccggttaattcgccctaaatatgcgccccgcctacccggtattcgcccccctttccccaaataagttttggcccgccagcccctgataaattgggcccgtaattcgttacatattttgtagagccgccgctctatttcgtctttcgctttataaaaacttccgcgccccatcaaaattatatttgcgttctagaatatcagccactacccttttattttttttatcccccattcagtggcccctagagcatcctgtgggcatctactcctcctccctgttcacgcttctgctaagaatatgtatgttatcctggagtatatctgcgacttgcatgcgcttttgttgttctccgttctttttgtgaacaccggtgattgtcgctagcgtttggtaagacagataccg

SEQ ID NO: 69875 - DNA, 763 bp, Zea mays
  misc_feature: Ceres CLONE 1548667
  misc_feature: Encodes the peptide sequence at SEQ ID NO. 69876
  misc_feature (40)..(40): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
ttttggttttgttttttcgttttcgagccgcgggcctttncccccttaaacnnnnntataatggagctccccgcggtggcggccgctctagaactagtggatcccccgggctgcaggaattcgtctcacccctagaaaatccgcatttccatcctgtcgtgggatcccagccaccgccgctagaagaagagctcggcgattcccaggtcccgcgagaatatgccgaagcagatccatgagattaaggacttcctcctcaccgcgaggaggaaggatgcccgctcagtgaagatcaagaggagtaaggatgttgtcaagttcaaggtgcgctgctccaagtacttgtacacgctctgcgtcttcgatgctgagaaggcaaacaaattgaagcaatctcttcccccaggtttgaccgtcgaggacggcctgatggatacatggcaaccccaagttgaactacccaaacctcggccacccacaccagaggttggttctcccacccccttttggaaacctagacctattagacctgtccagtggtttgaatgtctggaactctgcatttttgggaagaaaatcccatttttccccgggtttaagggaggccttaaaaaaaaaaaaaaaaaaccgggccccttccagagtacccacatttccccccttttggtgcgggccttatttccccccccctctcttggccccccgtttttcccacctttcagacagggggaaaaacccgtggggttccccccatatatagtcc

SEQ ID NO: 69876 - protein, 181 aa, Zea mays
  misc_feature: Ceres CLONE 1548667
  misc_feature (2)..(69): Pfam Name: Ribosomal_L38e Pfam Description: Ribosomal L38e protein family
MPKQIHEIKDFLLTARRKDARSVKIKRSKDVVKFKVRCSKYLYTLCVFDAEKANKLKQSLPPGLTVEDGLMDTWQPQVELPKPRPPTPEVGSPTPFWKPRPIRPVQWFECLELCIFGKKIPFFPGFKGGLKKKKKKPGPFQSTHISPLLVRALFPPPSLGPPFFPPFRQGEKPVGFPPYIV

SEQ ID NO: 69877 - DNA, 872 bp, Zea mays
  misc_feature: Ceres CLONE 1548668-R
  misc_feature: SWISSPROT Homolog: EC 2.7.11.1 Non-specific serine/threonine protein kinase
tgggggcctcgacggtctgttcttttccctatttgttgtttcctgcatgattttgagtacctccttccgagacgagcgattcacctaccatatataatgagaaggacgacagggaggggggctaaaaagaactatctaacattctgcctctgtaggatggatgtgatctcagagaactgagggcgcttcaaaggggaactgtcccagcacctgttcatcagtgacctcaggataggaggacagtctctggggatctccggcctcaccccgcatgcagcgatcccgacagctgctcgacctggcgagtaggtggagtaggcctcctctcccgtgatcatctcacagagcaccattccgtagctgtagacgttgctcatgcatgtcccgagagacgtgtttcatgatctccagcaatgatctctggtaccagcccatcgggacccagatgtcttgtactcgggtgacctcaccgacattactacaaggaggtaacattgcccatatccccaaagcaagcattcccttgcctgtgcagcaggatctttccgagcatcgaagatcacatgatcccgtatgccataggccgcttcatcaaagggtattgcgttcagccgaccttctagacgctatccctaacccttgtcttcgagaggggacagccctctttgtgttctcttgcacaaataactatcatgaaaccgaatcctccctctccaatcattccctcgtttactaaggagagtagcccccatgggtatcatgttgtgaaaaacaatagggactctgggaaattgggttgggaatgttttccctttgtgggccactagccttcattcaacgctatccatacctagggtccttgaaaagcaaat

SEQ ID NO: 69878 - DNA, 716 bp, Zea mays
  misc_feature: Ceres CLONE 1548668
  misc_feature: Encodes the peptide sequence at SEQ ID NO. 69879
  misc_feature (626)..(626): n is a, c, t, g, unknown, or other
aagctggagctccccgcggtggcggccgctctagaactagtggatcccccgggctgcaggaattcgtctcacccctagaaaaagcctccctctccaccttgtttggctgccttcttcttctccctccctccctgtacgagctgagcagcaacgtgactagttttatgtagaacaaacatcacagcgagggaaaaaaaaactcttccctcactcagagattcgccacaagactacaacattttttagttgtttcacttactactgagcaaacatcacagttttttttgttgctattttccttcgcatcttgtagacagcccttccttcagtgtgctacaaacaattagtaggttcatccagcagaaaaacggaatcctcgttttgttctggtcactctcggtccaatctcccaaaacgatcccgccttcagtagcagcaagcttcccatctttacaagcagctgccaactcttcaagcaagcaaggtgaagattcagcagcggggaaaaaggttaggtctccagcgatggcggcggcgctggagtgctggtcggggcggccgagcaccgatgaggagacggtggagcacgttctcatgaagccccacgggcgttcagatgactcccntccgaccctgcgcgattctgcccgcgctgccggcgagcccgacgcggggccggggcccgcgcccgcgccccccaagagtggcagcggctg

SEQ ID NO: 69879 - protein, 63 aa, Zea mays
  misc_feature: Ceres CLONE 1548668
  misc_feature (34)..(34): Xaa is any aa, unknown, or other
MAAALECWSGRPSTDEETVEHVLMKPHGRSDDSXPTLRDSARAAGEPDAGPGPAPAPPKSGSG

SEQ ID NO: 69880 - DNA, 590 bp, Zea mays
  misc_feature: Ceres CLONE 1548670
tggagctccacccgcggtggcggccgctctagaactagtggatcccccgggctgcaggaattcgtctcacccctagaaaaagacatcatcgtcctcaccagggtacagacgtgcccctcctcccctccccttgtccacagcccccgtagaccatggaagatgcatggcttgagcatctgcatggttcttgagagttaaagctgcacgacgatggatagtggaaacagagcttctcaagaagcattcgttttcgtggtgcctttcctgaccctcttggtggtcagctgaggtgcgcacaaaccggcaagtcacaatacggcaatggcggattccattaggagtcctccctttttattctttccccctttttaccatctagttgtgtgaatgtggtcagcgggaacctcaagaacaaataacctaggtatcccggggggagggaataaccctaacctttggggagaacaaggtttggctccagtggcacccccggtcttccgaaaacaaggggcgttaaaaaaaaaagtgttggctttttcccaaaaaaaaaaaaaaaaaacccggggccccctcggggggtccccactttt

SEQ ID NO: 69881 - DNA, 740 bp, Zea mays
  misc_feature: Ceres CLONE 1548672
  misc_feature: Encodes the peptide sequence at SEQ ID NO. 69882
  misc_feature (624)..(624): n is a, c, t, g, unknown, or other
  misc_feature (633)..(633): n is a, c, t, g, unknown, or other
  misc_feature (682)..(682): n is a, c, t, g, unknown, or other
  misc_feature (683)..(683): n is a, c, t, g, unknown, or other
aaaactggagctcaccgcggtggcggccgctctagaactagtggaacccccggggctggaggaattcgtctcacccctagaaaaaactagtagccagccattgggcttcattttttagccaaagacaacaggaggagggatggttctccttcgtccctggcacatcctcttcttcctcacatgcttctctccatcctttgttcatcctatggaaccaggcacctaccgttgctccaatgtttccatcccatatccttttggcgttgctgcatattggctagtgctagttctcagcagtgcataggagggacggcgaactctagcgttaaccttgaggggaccgtcttcacattctcagacacaaggaacaagttcacagctctgggttgtaacgtggtggccatgcttttgaatggcagcacggggtatagcggtggctgtgcttccttttgctctagcagaaataacatcatcgacggctcatgctctggtgtgacttgctgccaagcgccggttcccaaagggctaaagaagctggacttagagttcagtaatattaatataaccaacagcggcatcgattacgattactggccatgtggtcaggccttcgtcgtggagcangattcatantgtgttttcagttcttgatctgaacaacacaaacaacacaagacctcanntaccgacatgtttgtgcctcgagtggtctataaacggcagcagctgtgaagaagcga

SEQ ID NO: 69882 - protein, 156 aa, Zea mays
  misc_feature: Ceres CLONE 1548672
  misc_feature (148)..(148): Xaa is any aa, unknown, or other
  misc_feature (151)..(151): Xaa is any aa, unknown, or other
MLLSILCSSYGTRHLPLLQCFHPISFWRCCILASASSQQCIGGTANSSVNLEGTVFTFSDTRNKFTALGCNVVAMLLNGSTGYSGGCASFCSSRNNIIDGSCSGVTCCQAPVPKGLKKLDLEFSNINITNSGIDYDYWPCGQAFVVEXDSXCVFSS

SEQ ID NO: 69883 - DNA, 765 bp, Zea mays
  misc_feature: Ceres CLONE 1548673
  misc_feature (6)..(6): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (51)..(51): n is a, c, t, g, unknown, or other
  misc_feature (53)..(53): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (62)..(62): n is a, c, t, g, unknown, or other
  misc_feature (765)..(765): n is a, c, t, g, unknown, or other
cccctntggggggggtgggggggtgaggaaaaaaannnnttctttnttttnantattnnnanttcccgcggtggcggccgctctagactagtggatcccccgggctgcaggaattcgtctcacccctagaaaaagaagaagaaggaccacaaggacgccgaggaggctagcggcgagaagaaacaccaccacctcttcggctgaccgtagtaccggccggcgcgcgaccgagctagctagctccggcgcacacaaccacacacctgtttaattctgtactgcatgcgtgtgtaatttgatggttcacaataatgagtccctctccggaccttggtagctgcttgcttgtggtgagtgagagtgtgagactgagggagaagaggtggtgggcgtggggctacgtcgagagaggcgtgtccccgcactcgcttcgttttctctgcatgcgtgtataattgtgttcacccccacgtgagagcggtgtgatgtgtggctcccccttgtcaaaaaaaaaaaaaaaacgagaccctcgaggtacccaattcccccctatagggagtcgtattacgccgcgctccctggcccgtccttttaccaacgtccgggaccggggaaaaaccccgggcgttcacccaaactttaatcgccctttggagacacaatcccccctataccccccaaccgtgggggtaattagccgaaagaaggcccccgccacccatttttgactcctttcccccaagaagggttgtgcggcaaggctcn

SEQ ID NO: 69884 - DNA, 695 bp, Zea mays
  misc_feature: Ceres CLONE 1548674
  misc_feature: Encodes the peptide sequence at SEQ ID NO. 69885
  misc_feature (384)..(384): n is a, c, t, g, unknown, or other
gagctccccgcggtggcggccgctctagaactagtggatcccccgggctgcaggaattcgtctcacccctagaaaaaaccctagccgccgccagaccattcgtttctcgcgagccatcgcttctgtaattctcaggcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctcccgcttgagggggggggggggctttangacccttgggttttgcggccccccccacttaagtggtgttactgtatgatggcaaggaccttttgctgccaaaggttatgttttgagtttcctgtttcccttcaaagtacggattaccttgtggccgacaaaaaaaaaaaaaaacgatacccttccagggaccccatctcccccccataggcgagtcctttttaccctcccctcacccggcccgtccgtttttaacccccccgtgcatcctggggaaaccccctgggcgtataccccaaccttaaacccgttttagaccccacattctctccatgttcgcc

SEQ ID NO: 69885 - protein, 60 aa, Zea mays; identical to SEQ ID NO: 2158
  misc_feature: Ceres CLONE 1548674
  misc_feature (3)..(42): Pfam Name: Ribosomal_L29e Pfam Description: Ribosomal L29e protein family

SEQ ID NO: 69886 - DNA, 645 bp, Zea mays
  misc_feature: Ceres CLONE 1548681
  misc_feature: Encodes the peptide sequence at SEQ ID NO. 69887
  misc_feature (645)..(645): n is a, c, t, g, unknown, or other
ctccccgcggtggcggccgctctagaactagtggatcccccgggctgcaggaattcgtctcacccctagaaaaaagctagccgccgccagaccattcgtttctcgcgagccatcgcttctgcatccggaagaaatggccaagtcgaagaaccacacggcgcacaaccagtcgttcaaggcgcacaagaacggcattaagaaacccaagcgccaccgccagacctccaccaaggggatggaccccaagttcctgaggaacctgaggtattctaggaagggcaacaaaaagagtggtgaggctgaagctgaggagtaggaaggaaagcatggctttgtttcctctgtttttagctcagttccacctttaggacctggggttttgctaaagatggaacttaagtggtgttactgtatgatggcaaggaccttttgctgccgaaggttatgtttttgagttcatgctaccttttaaagtacggattaccttgtgcctatgttcattactaaaaaaaaaaaaaaaacgagacgctcgaggtacccaattcgccctatagtgagtcgtattacgcgcgctcactggccgtcgttttacaacgtcgggacttggaaaaaccctggcgttacccactttaatcgccttgcccn

SEQ ID NO: 69887 - protein, 60 aa, Zea mays; identical to SEQ ID NO: 2158
  misc_feature: Ceres CLONE 1548681
  misc_feature (3)..(42): Pfam Name: Ribosomal_L29e Pfam Description: Ribosomal L29e protein family

SEQ ID NO: 69888 - DNA, 678 bp, Zea mays
  misc_feature: Ceres CLONE 1548685
  misc_feature: Encodes the peptide sequence at SEQ ID NO. 69889
  misc_feature (29)..(29): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
cccgttcagcgatcttcatagccgctctngaactagtggatcccccgggctgcaggaattcgtctcacccctagaaaaagaagctgcatgctcgtgacatgtctgattaatattggttcataggaagcaaatcacctaggacaaggtgaaaccttctctgtaggcaagcaggcaaaaaggaataaatgttcccatcctgatcaaaaggaataaaaatattctgaaaattgccacatccaagctattagatggtatgcttaggaagtattgttattgttaagatataaatccatccatcatgacaaagaaggtgatctttttgtaatccttcttgaaaaaatagaatgatttgaattnnnnaagaaaaaaaaaaaaaaaaaaaaaacaaaaaaaaaaattaaaatacccccccaaaacaggaaaaaaacaaaaaaagccgagacgctcaaggtacccaattccccctatagtgagtcgtattaccccccctcacgggccgcctttttacaacgtcttgattggaaaaaccctggttttacccaactaaatcgccttgcaacacaccccccttttcccatctggcgtaaatcgaaaaaagccccccaccaatccccctttcccaaaaatttccccatcctgtaatgggcaaatggaaatgttaaaccttttaaatttttt

SEQ ID NO: 69889 - protein, 31 aa, Zea mays
  misc_feature: Ceres CLONE 1548685
  misc_feature (10)..(10): Xaa is any aa, unknown, or other
PFSDLHSRSXTSGSPGLQEFVSPLEKEAACS

SEQ ID NO: 69890 - DNA, 620 bp, Zea mays
  misc_feature: Ceres CLONE 1548686
  misc_feature: SWISSPROT Homolog: EC 3.2.1.23 Beta-galactosidase
ctccccgcggtggcggccgctctagaactagtggatcccccgggctgcaggaattcgtctcacccctagaaaaattaaataattttagtttaaaaatgaataggaataggatccgatcctaatccgattagatccttaaagtttgtagcgtaaaattgaaagctcattaccacccctatgtccatacatcttatcagtgcaagtttgtgatcatgtgatacattaagcatatacgtgtatgtatttcaccagagtacctgcaccggtgagcaagatgatctcctacttgcaccaccattagagcagtggatatgatctcatacttgcgcgttacactagtagagttgtggatacttaggatccatcattgcaaactctgatacaaaccagtgtaagctgagctgcatggattgcagatctgtataccttcggctcatgcagctataccgtcctggattgtaccacacaatcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccc

SEQ ID NO: 69891 - DNA, 712 bp, Zea mays
  misc_feature: Ceres CLONE 1548688
  misc_feature: Translation starting site: 252
  misc_feature (517)..(517): n is a, c, t, g, unknown, or other
aaagctggagctccccgcggtggcggccgctctagaactagtggatcccccgggctgcaggaattcgtctcacccctagaaaaaatcacacaccaccgccgctcaccaacaaccgagcaggagcagcctaccccatccacccaccccatcctctgcgctgcacggctgctgctggtgctggtccggccggtccggtccggtctcctctgttccagcgagctccctccgatccatcgggtaggacactccccatggcgtcgcacaacggcaccaagcacctggcgccgatggaggtgtcggtggaggccgggaacggcggcggcgccgagtggctggacgacgacgggcggccgcggcgcacgggcacgttctggacggccagcgcgcacatcatcacggccgtcatcggctcgggagtcctgtccctggcctgggccatcgcgcagctgggggtgggtggccggccccgccgccatgctgctcttcgccttcgtcacctactacaccgccacgctgnctcgccgagtgctaccgcacgggggacccggacacgggcaagcgcaactacacgtacatggacgccgtgcgctccaacctcggcggcgccaaggtcgccttctgcggcgccatccagtacgccaacctcgtcggcgtcgccatcggctacaccatcgcctcctccatcagcatgcaggccgtcagcagggccggg

SEQ ID NO: 69892 - DNA, 792 bp, Zea mays
  misc_feature: Ceres CLONE 1548689-R
aatgtctgtctacaatcatatttttcagcccaacaattgtttctaagaagattacagcatgcaatcgcatgaatccctgttgctaggacaattaataataagtatgctccaactgacaagtctagcaatatatctaaattctttaaccgaaatcagaatgacaagcatggtaccatccacaacgacaaacagtgatacaacaaataacagcaccaattaattgaacatacaaatataaaagaatttaaagggctcaaggaataaccatgtcatccaattttcatgactcgtgacttgtagagcaggctccacgcggttgtctttgaaaatggaaacagaaaagctcctcaacatcaaagcacccatcagtgctttccatcttgatggcctgccactgcttccactcgaaaggtctggtcctatccgatcatccaaatcctcgggcaaaacatcactgccggcattgtctagcgcaccactgtcatccacactccgaccatcctgcaactcaccagctccaccaggtgtgtcaaaattcacagcaagagctccattcctgctagcccggaggtgctcagcacactcagaggtcacccgacggcacttcttcaccttaaccttgacaaggcgtgggcagccttcagcaagcttattcattcctgcatcagacactggacatgccttgatgcacagcttacgcaaagcagaacatttggaggcgacacatgacatctctgcatcaccaaacgtgtcggacccacacagtgcgagccgctctaaggtggggcagtt

SEQ ID NO: 69893 - DNA, 721 bp, Zea mays
  misc_feature: Ceres CLONE 1548689
  misc_feature: Encodes the peptide sequence at SEQ ID NO. 69894
  misc_feature (651)..(651): n is a, c, t, g, unknown, or other
aaagctggagctccccgcggtggcggccgctcctagaactagtggatcccccgggctgcaggaattcgtctcacccctagaaaaaacccaaccactcctctcctccccggtcctcctccccttcctcggcagatccgccgccgcccgttcccatgggccagtgcctctccgccccgcgccaccgcaagcccccgcccctgcctctgtcgcccgcgctgtccgttccgccgcagatcctctcttccatcgccgacgccgtcggggaggatcacaccgccgacctccctgaggagctcctcgccctcgtcttcggtcttctcggctccggcgaccgcaagcgatgttccctcgtttgccgccgctggctggtcgtagaggccgcctcccgcttccgcctcgcgatcgacgccagggcatcgccgctcgccgaatccgccctcccccgcctcctcgcgcgcttccccgccgtctccaagctcgcgctcaagtgcgaccgccgcgccgagagcgtgggcgacccggccctcgcgcaagttgcggaccgcctcggcccgggccttcggcgcctcaagctccgctccctgcgtgcggtcaccgacgatggggtcgccgcgctcgccgccgcggccgccaacctccgcaagctctccngtcggatcctgcgacttcggggccaagggaatcgaggctgtcctccgctcgtgcctccacctcgaggagc

SEQ ID NO: 69894 - protein, 189 aa, Zea mays
  misc_feature: Ceres CLONE 1548689
  misc_feature (39)..(86): Pfam Name: F-box Pfam Description: F-box domain
  misc_feature (167)..(167): Xaa is any aa, unknown, or other
MGQCLSAPRHRKPPPLPLSPALSVPPQILSSIADAVGEDHTADLPEELLALVFGLLGSGDRKRCSLVCRRWLVVEAASRFRLAIDARASPLAESALPRLLARFPAVSKLALKCDRRAESVGDPALAQVADRLGPGLRRLKLRSLRAVTDDGVAALAAAAANLRKLSXRILRLRGQGNRGCPPLVPPPRG

SEQ ID NO: 69895 - DNA, 758 bp, Zea mays
  misc_feature: Ceres CLONE 1548695
  misc_feature: Encodes the peptide sequence at SEQ ID NO. 69896
  misc_feature (223)..(223): n is a, c, t, g, unknown, or other
  misc_feature (224)..(224): n is a, c, t, g, unknown, or other
  misc_feature (243)..(243): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (295)..(295): n is a, c, t, g, unknown, or other
  misc_feature (297)..(297): n is a, c, t, g, unknown, or other
  misc_feature (298)..(298): n is a, c, t, g, unknown, or other
  misc_feature (300)..(300): n is a, c, t, g, unknown, or other
  misc_feature (307)..(307): n is a, c, t, g, unknown, or other
  misc_feature (308)..(308): n is a, c, t, g, unknown, or other
  misc_feature (309)..(309): n is a, c, t, g, unknown, or other
  misc_feature (310)..(310): n is a, c, t, g, unknown, or other
  misc_feature (311)..(311): n is a, c, t, g, unknown, or other
  misc_feature (312)..(312): n is a, c, t, g, unknown, or other
  misc_feature (314)..(314): n is a, c, t, g, unknown, or other
  misc_feature (315)..(315): n is a, c, t, g, unknown, or other
  misc_feature (316)..(316): n is a, c, t, g, unknown, or other
  misc_feature (317)..(317): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (331)..(331): n is a, c, t, g, unknown, or other
  misc_feature (332)..(332): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (346)..(346): n is a, c, t, g, unknown, or other
  misc_feature (347)..(347): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (426)..(426): n is a, c, t, g, unknown, or other
  misc_feature (428)..(428): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (480)..(480): n is a, c, t, g, unknown, or other
  misc_feature (514)..(514): n is a, c, t, g, unknown, or other
  misc_feature (540)..(540): n is a, c, t, g, unknown, or other
  misc_feature (621)..(621): n is a, c, t, g, unknown, or other
  misc_feature (637)..(637): n is a, c, t, g, unknown, or other
  misc_feature (638)..(638): n is a, c, t, g, unknown, or other
  misc_feature (645)..(645): n is a, c, t, g, unknown, or other
  misc_feature (659)..(659): n is a, c, t, g, unknown, or other
  misc_feature (718)..(718): n is a, c, t, g, unknown, or other
  misc_feature (758)..(758): n is a, c, t, g, unknown, or other
tggagctcaccgcggtggcggccgctctagaactagtggatcccccgggctgcaggaattcgtctcacccctagaaaatccacgttcacgtggtggaagagttcatttgtttctgttggaggttcttaggagagttcaataatcattacgagaaagaagacaattgtttggaatcatcattgatagaccactgatgagataatggctaatccttaagctaatnnaaaaaaaaaaaaaaaaaanaaaaannnnnnnnnnnnnnnnnnnnnnnnnnnnnnnnnnnttttttcccccnannanagggggnnnnnnannnnnnnntttttttttnnttnnnnnnnntttnnttttnnntnnntttttttttttttcccccccccccccggggggggggggggggggnnnnntnnnnnntnnnnnnnnttntntttccctnnnccaaaaacaaactacacacaccccacctaacaccccacaccncaacaccccctctccaattcacaataaaaccatnaactaaaaaccccacaactacacaanacctatcacccccccctctaccctctactatacactacttctctaaaaatactacttaaataactcccccaccaccctacnctcttaagcaccaccnntctcacnctcccccacacacnccacccctcttacctaccacccctattcatctctctactcaataatcacacccctctcncacctcactctctccaccccacaatataacatcccacccn

SEQ ID NO: 69896 - protein, 46 aa, Zea mays
  misc_feature: Ceres CLONE 1548695
GAHRGGGRSRTSGSPGLQEFVSPLENPRSRGGRVHLFLLEVLRRVQ

SEQ ID NO: 69897 - DNA, 649 bp, Zea mays
  misc_feature: Ceres CLONE 1548698
  misc_feature: Encodes the peptide sequence at SEQ ID NO. 69898
  misc_feature (338)..(338): n is a, c, t, g, unknown, or other
  misc_feature (401)..(401): n is a, c, t, g, unknown, or other
ctccccgcggtggcggccgctctagaactagtggatcccccgggctgcaggaattcgtctcacccctagaaaaactcctcagctcaggccgagcagcaggagccgaagcagagcctcgagatcccgcccaccatttgccctccggccgacgcggagccgatcgcttcaccggcagcgaggacgatgggttccgtcgcggaggactccaccgcggcagcggcagcagcggcgtcggtagtgttccgctacaagctacccgacatcgagatcccgcgggacctctcgctgcatgcctactgcttcgagcggctccccgaggtgtcctcccgccccctgcntcatcgaaggggcaaaaggggcgccgtgcacaccctacggcggaggtgggacccccttgttancgctccgcgaggcggcggcccttcctccgggttcggggtgggccaggggggcaacttggtgatgggggtttttcccccaattggccccaagtttccccttggacctttccccgggggagggcgggattgggggcccccccccccccccggggcaaaaccttttttaaaccccgccccgaagaaaaacccgcccccgggggcccccggggggggggccaaggggggggtttcccccaaggcccgcgggg

SEQ ID NO: 69898 - protein, 155 aa, Zea mays
  misc_feature: Ceres CLONE 1548698
  misc_feature: SWISSPROT Homolog: EC 6.2.1.12 4-coumarate--CoA ligase
  misc_feature (52)..(52): Xaa is any aa, unknown, or other
  misc_feature (73)..(73): Xaa is any aa, unknown, or other
MGSVAEDSTAAAAAAASVVFRYKLPDIEIPRDLSLHAYCFERLPEVSSRPLXHRRGKRGAVHTLRRRWDPLVXAPRGGGPSSGFGVGQGGNLVMGVFPPIGPKFPLGPFPGGGRDWGPPPPPGAKPFLNPAPKKNPPPGAPGGGAKGGVSPKARG

SEQ ID NO: 69899 - DNA, 663 bp, Zea mays
  misc_feature: Ceres CLONE 1548702
  misc_feature: Translation starting site: 164
  misc_feature (347)..(347): n is a, c, t, g, unknown, or other
  misc_feature (422)..(422): n is a, c, t, g, unknown, or other
  misc_feature (427)..(427): n is a, c, t, g, unknown, or other
  misc_feature (448)..(448): n is a, c, t, g, unknown, or other
  misc_feature (507)..(507): n is a, c, t, g, unknown, or other
ctggagctccccgcggtggcggccgctctagaactagtggatcccccgggctgcaggaattcgtctcacccctagaaaaaagcgaggggcaacagttttctcgaagaagggaaggcagcctcttcctcgtcgccggcgacgtcaccctcagcggctatcagggatgccggtcagggtggtagataccgccacgccttcctcccagccctccccagggcaagaagcaaatactggacacccatctcctcctagctgttcactcttaagtgctggaagatcttttgctgggactcaaaatgtttcaagcctgcagaaggatgaagcatggaaagtgaatgtacgcatcncatggttgtgatcttgaacagggttatttatgtggaacgatggaagcgcttaatgttccattagcagatacaccntgtgntgactttctgggagggggagnaatagtggatgctaaaaatttacacttttttccctggaaaagtggggaggcatcccccngatgatgatattaggacattggttccaagttccccatcatttacgccctcttctggggtcaaaattgaaaaccaaatggtgggcaaagtttcctgggacttttagcacaacttcccctttaatttttttttttggagaaaatgggggaaaaaaaaa

SEQ ID NO: 69900 - DNA, 638 bp, Zea mays
  misc_feature: Ceres CLONE 1548703
  misc_feature (427)..(427): n is a, c, t, g, unknown, or other
ctccccgcggtggcggccgctctagaactagtggatcccccgggctgcaggaattcgtctcacccctagaaaaattcctggcgcgcacgttcaggcgcttctcttgccttgccgtaacggcttttaactatttcctcctctcctcccgatccagctagcctggcctcccacctcccctcccctctcttgaactgaatcccccactccgtcctccagttcgatcgcgttcgcggccccccactccgtgttccggaataagtagccggcggtttcctcaccccaggttttgcagttgctggggagtgggaaattcgtccggctccggtttggccaatgctcctgcggtttcttggagaggccgctgaagcagcagcccttgcctgagggattctccttttctcgggcggagagttcggttgcggcgaanaaaaaaaaagattctttcgtcggattggcccaagttcttggttgatccgttacaaagcccccactgtacgctgtgttagcctttttccacgcgtttctttcctactctaaatcggtgtccccgcccgattatttggggggataggcagcccatcgatcggggaaagagggatttggagggcctgactcccaatgaggtgcagcccacttca

SEQ ID NO: 69901 - DNA, 679 bp, Zea mays
  misc_feature: Ceres CLONE 1548707
  misc_feature: Encodes the peptide sequence at SEQ ID NO. 69902
tctggagctccccgcggtggcggccgctctagaactagtggatcccccgggctgcaggaattcgtctcacccctagaaaaactttgtgttttttataggcttgagagcttggaatagcggggggtggaggaagcggaagaggagcttcgttttgtgttctagaggggagtcatgttccatggcggcaggcctctgtccctccgggggtctctcaaggcgcttgaagctgatatccaccatgccaacaccctggcgcatgctatacacagggcgtatgggggtgcctgcgtgcagatgaggctgtcctacagctccatggctccaatctttctcaaccttatccaatggatggactgcagctgctccctgtcatacacgctccctagctaccttggcctgctcgaggttctcgtctacaaggtaccgacgaatagcacttgccgagagagtttgctgaatccacgacgaactgactggtatctcctgaggctttgaatgttgacacggtcttggtggttgaacacgcaggtttatgtcgatgaagatgcctccatatccaccatagaaaggagggcgagcctgaaggaattctacagtatgcttactatccaccatagaaactagtgattaagaagctttttttttctgttcaagatttttttttgttgatgctgctgct

SEQ ID NO: 69902 - protein, 107 aa, Zea mays
  misc_feature: Ceres CLONE 1548707
MFHGGRPLSLRGSLKALEADIHHANTLAHAIHRAYGGACVQMRLSYSSMAPIFLNLIQWMDCSCSLSYTLPSYLGLLEVLVYKVPTNSTCRESLLNPRRTDWYLLRL

SEQ ID NO: 69903 - DNA, 700 bp, Zea mays
  misc_feature: Ceres CLONE 1548709
  misc_feature: Encodes the peptide sequence at SEQ ID NO. 69904
ctccccgcggtggcggccgctctagaactagtggatcccccgggctgcaggaattcgtctcacccctagaaaaaatttacctgcccatcgatcatatcgtcaactggtccggcagttcgcgacaccatgagctccacggagtgcggcggcggcggcggcggcgccaagacgtcgtggcctgaggtggtcgggctgagcgtggaggacgccaagaaggtgatcctcaaggacaagccggacgccgacatcgtggtgctgcccgtcggctccgtggtgaccgcggattatcgccctaaccgtgtccgcatcttcgtcgacatcgtcgcccagacgccccacatcggctgataatatataagctagccgctatttcctttctttgccccagaacttgaaacaccatatatacgatgaaataacgcgggcatgccgaataatggatgtgtgaattctcactaattaagtaatggataaataaacgtattcaacacccaccatcggtatgttttacatcccccccgtgccgcctaatttttgtaaaaataaaaaaaccggagccgccttggaggtaccccatttccccccctataggggggtcctaaattacccccctcctcccctggccctctcttttttcccccgcctctgtggcttgggaaaaaaccccttggcgcttccccccaatctttaaaccgccctt

SEQ ID NO: 69904 - protein, 73 aa, Zea mays
  misc_feature: Ceres CLONE 1548709
  misc_feature (14)..(73): Pfam Name: potato_inhibit Pfam Description: Potato inhibitor I family
MSSTECGGGGGGAKTSWPEVVGLSVEDAKKVILKDKPDADIVVLPVGSVVTADYRPNRVRIFVDIVAQTPHIG

SEQ ID NO: 69905 - DNA, 639 bp, Zea mays
  misc_feature: Ceres CLONE 1548712
  misc_feature: Encodes the peptide sequence at SEQ ID NO. 69906
  misc_feature (308)..(308): n is a, c, t, g, unknown, or other
ggagctccccgcggtggcggccgctctagaactagtggatcccccgggctgcaggaattcgtctcacccctagaaaaacgccacacgcactctccccgaccgtgtggcccggtcgtccaccccaccgccgcagcctcgccccgaggagacaggagaacagaatgatgccggctacacctacgatcatcggagccgtcctgggactgggcactctcatgtactccaacgtcttccgcaagcttccctacatgcgctatgatgatgaatagctgttcagattagtccgtcaacgacctgtatctgtttgncacatgtcgtcactatccctgctcgggactgtggatccaccatgacttagttgttgcctcaccttccatggttcaactgtagcctcgtacgaaaatgtcaacgcccaatgtatctgatggatccacgttgaaagctacttattatggggctttgaatatgatcgcttgctgtctctggtgcaatctcttattataacgagactctcgcgggacccggttggccgtatttgagtcggatacgcgggcaaattggcggagttttactctacgtgcctgggaaacctcgcccttcccggctaggcccttgcaaaaatccccttttatcagctgg

SEQ ID NO: 69906 - protein, 34 aa, Zea mays
  misc_feature: Ceres CLONE 1548712
MPATPTIIGAVLGLGTLMYSNVFRKLPYMRYDDE

SEQ ID NO: 69907 - DNA, 845 bp, Zea mays
  misc_feature: Ceres CLONE 1548714
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (58)..(58): n is a, c, t, g, unknown, or other
  misc_feature (61)..(61): n is a, c, t, g, unknown, or other
tttttgttactgaggggggggggaaactattatccnnncgctgccncccccgcccccnccncagccggtggcggccgctctagaatagtggatcccccgggctgcaggaagtcgtctcacccctagaaaacaaaaaaaggaaaccgacttaaaggggaaaaggctatctagacctcgatgaattactatagaattattagcaaatgtaaagggcctgggtgtaattttacatgggctgcgtcccgtgcctataaatagatgaacagtactcccgtactgttcacgctgactgggcatttgcttttgcgccacgcttgtacttttaccttccttcaagccgaaggtacttttgtaacttgaaattatttttatttttccttaataacgaaaatagaaatgattttgatgatttaaaaaacacccacaaacaagagcctcaggggtaccccatttcgcccctattagtggaagcccctaattacctccgcgcctcccctgggcccgttcgtttttttacaacccctccggggacttggggaaaaaaccccttggcggtttaacccccaaatttttaaatcccgccctttggtaaaaacaaagattccccccccttttcccccccaaacctgggggggttaattattccccaaaaaaaggccccccactcccaggattgggcccctttccccaaacaaggtttgctcttaaaccctccaaaatgggccaaattggcaaatttgtgcaaagactgttaaaatttttttgtttaaaatatttcccttaaaaatttttttgtataaatcccgccctattttttttgacccccgaacgcccacactatctcc

SEQ ID NO: 69908 - DNA, 675 bp, Zea mays
  misc_feature: Ceres CLONE 1548721
  misc_feature: Translation starting site: 233
  misc_feature: SWISSPROT Homolog: EC 3.2.1.23 Beta-galactosidase
agctccccgcggtggcggccgctctagaactagtggatcccccgggctgcaggaattcgtctcacccctagaaaaaaaacggcccaagcccaaaaaggcaggctgatatctcagacatagagcccactcgtcgagcgcgctcgcacgccgcgaatcgccggaccggtcggcgacggagacgacagagcccaagtcgaagcgatccgattttgccggcggcagcgaccggagtatggggctgggaggccggggcgtggtgggagacaggtggtcgcaacgcatcctctggatttgcgccctgggcagcgccgtgagcctctacttcgtggcggtggagaggcaggctcagaatcgtgcgcgggcggtggcggagggcctcaaggcgctcgacggcgccggggatgacgtgtgacagcggtggacgctgccgtgcagagggcctcctttggttcacatgttcacagaacctcatagcgttgcaataatgtactaaacatctgtgctcagtctttgtagaataaaaaaaaaaaaaaaaacgagacgctcgaggtacccaattcgccctatagtgagtcgtattacgcgcgctcactggccgtcgttttacaacgtcttgactgggaaaaccctggcgttacccactttaatcgccttgcggcacatcccccgtttcgc

SEQ ID NO: 69909 - DNA, 485 bp, Zea mays
  misc_feature: Ceres CLONE 1548730
gcggggcggccgctctgactagtggatcccccgggctgcaggaattcgtctcacccctagaaaaacaaattgccacgttatgctttcatcatatgtctgccgttgaatgttgtagtataaaattgtaggggtaaatgttttcttgtaagtcatgtgtataccaccaaatcaagaatctacagttggccataatgcatgtgctacgttcttgtgtagtttgagttctgttatcaaggtatttgggcttcaggaaatgctccaggggtcatggtttatttgaaaactataggggtattgcaaaaaaaaaaaaaacgaaaccctcgagggaccaattcccccaaaggggtcggtttaccccccctcctggcccccttttaaaacgtcgggaggggaaaaccccggggttccccaattaaaaccctttggaaaaaaccccccttttttccggggggggaaaaaaaaaaaaagccccccccaatttccct

SEQ ID NO: 69910 - DNA, 709 bp, Zea mays
  misc_feature: Ceres CLONE 1548743
  misc_feature: Encodes the peptide sequence at SEQ ID NO. 69911
  misc_feature (672)..(672): n is a, c, t, g, unknown, or other
  misc_feature (692)..(692): n is a, c, t, g, unknown, or other
ctccccgcggtggcggccgctctagaactagtggatcccccgggctgcaggaattcgtctcacccctagaaaaagagggtcctgcgttcccttcttctgctgcggcggcggaggctctttcagttccatccatcttctccctcgtggctctccttcctctctcccgtagtcccgccgaccccccgcgccggccaaggaaatcaagcgaaaacgccagattttgattgttccacatcttctttcatctctgaggggtttcccgtcttcctcgcctgctctaatggctaaagaacaggatggatcccccaaggtgcgccacccagaattccaaaggatgcgcgtaactctcaccataggtgtcattggcctctgtgtcacagcatacattcttggtgcttggcaaggtacctcgaacggcattagttcccccttaataagtaccagaacccagtgcaaagatcccgtgcgatcatctggtgctcgcctggatttccaagcccaccaccaggtgggcttcaatgaatcggcgcttgctgtggagaaattcccaccttgccagctcaagtacagtgagtataccccttgccaagatccaaggaaagctaggaagttcccaaagaaaatgatgcagtacagggagcggcactgcccaaagaaagaagacatgctccnggtgcttgatccctgcgccntcaaactatagcaaccc

SEQ ID NO: 69911 - protein, 140 aa, Zea mays
  misc_feature: Ceres CLONE 1548743
  misc_feature (131)..(131): Xaa is any aa, unknown, or other
  misc_feature (138)..(138): Xaa is any aa, unknown, or other
MAKEQDGSPKVRHPEFQRMRVTLTIGVIGLCVTAYILGAWQGTSNGISSPLISTRTQCKDPVRSSGARLDFQAHHQVGFNESALAVEKFPPCQLKYSEYTPCQDPRKARKFPKKMMQYRERHCPKKEDMLXVLDPCAXKL

SEQ ID NO: 69912 - DNA, 890 bp, Zea mays
  misc_feature: Ceres CLONE 1548744
  misc_feature: Encodes the peptide sequence at SEQ ID NO. 69913
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (18)..(18): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (57)..(57): n is a, c, t, g, unknown, or other
  misc_feature (58)..(58): n is a, c, t, g, unknown, or other
  misc_feature (60)..(60): n is a, c, t, g, unknown, or other
  misc_feature (390)..(390): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (460)..(460): n is a, c, t, g, unknown, or other
  misc_feature (479)..(479): n is a, c, t, g, unknown, or other
  misc_feature (500)..(500): n is a, c, t, g, unknown, or other
  misc_feature (505)..(505): n is a, c, t, g, unknown, or other
  misc_feature (523)..(523): n is a, c, t, g, unknown, or other
  misc_feature (555)..(555): n is a, c, t, g, unknown, or other
  misc_feature (562)..(562): n is a, c, t, g, unknown, or other
  misc_feature (570)..(570): n is a, c, t, g, unknown, or other
  misc_feature (573)..(573): n is a, c, t, g, unknown, or other
  misc_feature (574)..(574): n is a, c, t, g, unknown, or other
  misc_feature (590)..(590): n is a, c, t, g, unknown, or other
  misc_feature (604)..(604): n is a, c, t, g, unknown, or other
  misc_feature (605)..(605): n is a, c, t, g, unknown, or other
  misc_feature (614)..(614): n is a, c, t, g, unknown, or other
  misc_feature (660)..(660): n is a, c, t, g, unknown, or other
  misc_feature (661)..(661): n is a, c, t, g, unknown, or other
  misc_feature (689)..(689): n is a, c, t, g, unknown, or other
  misc_feature (690)..(690): n is a, c, t, g, unknown, or other
  misc_feature (694)..(694): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (724)..(724): n is a, c, t, g, unknown, or other
  misc_feature (725)..(725): n is a, c, t, g, unknown, or other
  misc_feature (752)..(752): n is a, c, t, g, unknown, or other
  misc_feature (775)..(775): n is a, c, t, g, unknown, or other
  misc_feature (792)..(792): n is a, c, t, g, unknown, or other
  misc_feature (802)..(802): n is a, c, t, g, unknown, or other
  misc_feature (873)..(873): n is a, c, t, g, unknown, or other
  misc_feature (890)..(890): n is a, c, t, g, unknown, or other
nnnnnnggggggggtttnttttttannnnnnnnnnnnnnntttnnnnnaaaaaaaanngngctccccgcggtggcggccgctctagaatagtggatcccccgggctgcaggaattcgtctcacccctagaaaaaaaaaaaaaaaaacaagaaatggatgcaacatgaggccgggggatatatttgcaactggcacactcagtggacctgaaccggactccctcggatgtctattggagctaacatggaacgggcagaaggacataccagtgggcaatttgacccgcaagtttctagaagatggaaatgaggtcatcttgacaggatgctgaaagggttaaggctacaagagtggttttggaactttaacttgttaaggtattggcgggcncctttctttgaattcnnngcttttttttttttttaaggattttccgggggggagggggggggggaggttnagcataaggacgcacgttnacaatttggaaaacacgtttnggggntctttttccccccagtcngacaaaatttaatgcctgcgagataatgtggngccaggngagaaganagnntatcctttaagtcctntaaaattctacccnntaaacatcncatcgcattaacgcatgaatagaacggtgccgtgaaatgaacaaanntggggagagaaacagaaaacaaaatggnncgancnnnaccaacacgataattaaatatgtgcnntagcatttgaagaaacagagaaaaaancccgcggaccaaggtaaagcagnccacaaagacagaattncaccaggagnacgtaataaacgtaggtgtgaaggaggatagaccggtcgaaagccggtaacgacagaagtgaaccttaacngagaaggaagaacaccn

SEQ ID NO: 69913 - protein, 55 aa, Zea mays
  misc_feature: Ceres CLONE 1548744
  misc_feature: SWISSPROT Homolog: EC 3.7.1.2 Fumarylacetoacetase
MRPGDIFATGTLSGPEPDSLGCLLELTWNGQKDIPVGNLTRKFLEDGNEVILTGC

SEQ ID NO: 69914 - DNA, 714 bp, Zea mays
  misc_feature: Ceres CLONE 1548768
  misc_feature: Encodes the peptide sequence at SEQ ID NO. 69915
ctggagctccccgcggtggcggccgctctagaactagtggatcccccgggctgcaggaattcgtctcacccctagaaaaaactcgctcatcactgggtgggccgttgtggtggctgcctggctgtggctggtgcgagaaaaaaagtagcctgtatcaggcgctagttgcgattctcgggagttcgttgaggagtcacatagaaagtttggtggtgaggcaaaggtttccttccctggttcgtcaggaacgatgcgactcgcaatctgaagcctttcgtccgttccgtctagctgccccccctcggattcggccatggagcggcactccagcatccggctgggcgcactggagaacctgacgagcttccggcggatggagaagcagaagagcttccgcgggatcatgtccctcgagcggcggagcatggacagcccggggaaacacggcgacacgccgctccacctcgcggcgagggccgggagcgtggcccacgcgcagaggatcctcgcggagctcgaccgggcgctggccgccgagatgtgctccagacagaaccaggactgcgagacgccactgtacgtcgccaccgagaatggacacgcggaggtcgtgcgcgagatcctcaaggtctgtggagtgcagacggtctgcatcaaagccagcaatagtttcgacgcgttccacatcgccgccaagctggccctctttgaagt

SEQ ID NO: 69915 - protein, 133 aa, Zea mays
  misc_feature: Ceres CLONE 1548768
  misc_feature: SWISSPROT Homolog: EC 2.7.11.1 Non-specific serine/threonine protein kinase
MERHSSIRLGALENLTSFRRMEKQKSFRGIMSLERRSMDSPGKHGDTPLHLAARAGSVAHAQRILAELDRALAAEMCSRQNQDCETPLYVATENGHAEVVREILKVCGVQTVCIKASNSFDAFHIAAKLALFE

SEQ ID NO: 69916 - DNA, 674 bp, Zea mays
  misc_feature: Ceres CLONE 1548771
  misc_feature: Encodes the peptide sequence at SEQ ID NO. 69917
  misc_feature (455)..(455): n is a, c, t, g, unknown, or other
ctccccgcggtggcggccgctctagaactagtggatcccccgggctgcaggaattcgtctcacccctagaaaaagtctccatccaattcacaggctcaccacaccaaccaacaagcaaaaattccccaatcctctcgtctccgcggcgaagatgtcggggcgcggcaagggcggcaagggcctgggcaagggcggcgcgaagcgtcaccggaaggtgctgcgcgacaacatccaggggatcacgaagccggcgatccggaggctggcgcggcggggcggcgtgaagcgcatctcggggctcatctacgaggagacccgcggcgtgctcaagatcttcctggagaacgtcatccgcgacgccgtcacctacaccgagcacgcgcgccgtaagaccgtcaccgccatggacgtcgtctacgcgcttaagcgccagggccgcaccctctacggcttcngcggctaggcctgccgcgccgcgcttcgccgtcgctgcggttctggtgttgctgcagttcgcaagttgtttgtgtggggcggaaaatgctagatactgtagaactgcagtgcggtatgctgcacatgcctgtgtttgtctgaaagaaaatgttgcaatgctgggcttgctctggactaaaaaaaagcccgaccagaccagcacagaatcactgctaccc

SEQ ID NO: 69917 - protein, 103 aa, Zea mays
  misc_feature: Ceres CLONE 1548771
  misc_feature (25)..(94): Pfam Name: Histone Pfam Description: Core histone H2A/H2B/H3/H4
  misc_feature (102)..(102): Xaa is any aa, unknown, or other
MSGRGKGGKGLGKGGAKRHRKVLRDNIQGITKPAIRRLARRGGVKRISGLIYEETRGVLKIFLENVIRDAVTYTEHARRKTVTAMDVVYALKRQGRTLYGFXG

SEQ ID NO: 69918 - DNA, 705 bp, Zea mays
  misc_feature: Ceres CLONE 1548772
tcccccgggctgcaggaattcgtctcacccctagaaaaaccgcacacgcatcgagcggctccgtctcatgagagccgtcgctgctgccgcctcgcccccgctccgcggcctcctcctcctctcccgccagccacgccgcgcaggcttcaccaactggccgtctctgcctaggggccagaacgcaagaccctcagccccgccgggcgccgccgcccccaagcctgctgcgccgtccaggaggcaaggccgcggcctcgctgccaggcctgcctcgccaagtggcccggatgtcggacgccccacctgcggccgccggcgaccccgccaaggggccctgacagacgccatcacagccacggagttcgtgcgctggctggttgtccgcggaagacggtccgccacctccgtgctccaacctggcacctccggttcagcatgaagccgtcgtccacctcctccgcctctggggggtaccactccagggccgcttgccttcgcttccccgcagccagccctgcggtggcggcagatcagcgattatggccggccgccgtccaagatggggagcgaccgcgttcggcgctcattgggcccctgcctgatcgaggggtgttcgcgccgacatgagcgagcggtatcttcccccctaggatattaagggacctgatcggttagcgtggcggcgttcccgctaaccttggctgt

SEQ ID NO: 69919 - DNA, 846 bp, Zea mays
  misc_feature: Ceres CLONE 1548781
  misc_feature (36)..(36): n is a, c, t, g, unknown, or other
  misc_feature (38)..(38): n is a, c, t, g, unknown, or other
  misc_feature (39)..(39): n is a, c, t, g, unknown, or other
ccccctttgttttgtttttgggacgaaggacaatgncnncgcgcatacacttctcttactcatataccagtggcggccgctctagtatagtggatcccccgggctgcaggaattcgtctcacccctagaaaaatcaaaaaaaaaaaagtacagtacgtgtggagtgtaatggagcttccatgcatgagtgaatacatgccatgttatgaatctagtccttcctttcttgtatcccccatgtgacccgacgtgcgcgtcccctcatgtgtgatgatgccaaatgtaatactatagataagacgttcttaggaactgtgtgccaaaaattttgaataatgtataaaatatattttaaaaaaagagaaagaaaataaataattaataaaactatcaaacactcccttgggcttctctgcttctcctcccccccccccctgggggtttgctttttcccccctttttatgtggctcttttttttccccccccccctgttttcccgcgacctttttcacctttttgatttgttacccgccatttaacaaccttcaggaattctaccccttcatctgttttctgtcttcttttcctccatacataccaaatctatttcgcaacatctggccctccatttctctttcaatataatttctttccttacttttttaacctatcattaaccctctaacattttattaactcaccagaacagacacttaataacctaccccgccctccccttctaactaccttatctatacatatttattccttttggatttcttatgtactaatcctccctcaattttcttttccaccacctaacactgcctctacactataaaaat

SEQ ID NO: 69920 - DNA, 721 bp, Zea mays
  misc_feature: Ceres CLONE 1548783
  misc_feature: Encodes the peptide sequence at SEQ ID NO. 69921
ctggagctcaccgcggtggcggccgctccagaactagtggatcccccgggctgcaggaattcgtctcacccctagaaaaagccacacacaccctataacgcgccgtcatggccctctctatcatcccgagtacaagcagcggggagcacgctgcggcgtcagcatcggccacggccaccaccacgacgaagctgggtcagctgaacgcggcggtggaacggtcatgggtggggcgaacggttccgcctcgcagcgcgcgggactacgttcaccacggagctgcgtgccggcacggccacgttcctcaccatggcttacatcctccccgtcaacgcatccatcctctccgactccggcgccacgtgcacggtggacgactgcgacgtgccgtctccagggtgcaagttcccgcccgtggaccccgggtacgccgcttgcgtggcgcgcgtccgccgggacctgatcgtggccaccgcggcgtcgtccgtgatcgggtccttcatcatgggcgccttcgccaacctccccatcgcgctagcacccgggatgggcaccaacgcctacttcgcctacacggatgtcggcttccacggctccagcacgctcccctaccgcagggcgctcgcggcggtcttcctcgagggcctcatcttcctctttatctccatcgtgggcatgacggccaagctcgcgcagttcatccccgctcctgtgcggatcc

SEQ ID NO: 69921 - protein, 137 aa, Zea mays
  misc_feature: Ceres CLONE 1548783
MAYILPVNASILSDSGATCTVDDCDVPSPGCKFPPVDPGYAACVARVRRDLIVATAASSVIGSFIMGAFANLPIALAPGMGTNAYFAYTDVGFHGSSTLPYRRALAAVFLEGLIFLFISIVGMTAKLAQFIPAPVRI

SEQ ID NO: 69922 - DNA, 654 bp, Zea mays
  misc_feature: Ceres CLONE 1548785
  misc_feature: Encodes the peptide sequence at SEQ ID NO. 69923
ctggagctccccgcggtggcggccgctctagaactagtggatcccccgggctgcaggaattcgtctcacccctagaaaaaacaccaactcctccatccaactcggcaactccacgcagccagcccggcgcctcccatcagtgggtgggtgggtggttcgcctcctcatcctctcctccccgcacgtccacggcgatggcgcccgcgcccccgcactgctgacccacccccgccgcgcactctcatgaccgtggtttggtaggtggggcggaggttggtaggccgggacgtgccggcaggcggttacgggaggcgcggccgcgatcccgggccggatctggacgccgcgatggaggacgccgttgccgctgagaatgggatcgagggggagggctacgtcgtcgtcaaaggcggcggcggccgcggaggcggagggggactccggcgccagcgatcgtggggatctcgccgcccccgctgaggacgcggcgccggccggatctgaggacgccccggccccggcggtgacgccggacgagaccgcggcacctgccaaggcgccggccaagaagggtggatccggggacgcccgcggggtccggaaaggcgagccgcagaaacgcagggtgcccgccgccgcgccgccgcgccgagg

SEQ ID NO: 69923 - protein, 93 aa, Zea mays
  misc_feature: Ceres CLONE 1548785
MGSRGRATSSSKAAAAAEAEGDSGASDRGDLAAPAEDAAPAGSEDAPAPAVTPDETAAPAKAPAKKGGSGDARGVRKGEPQKRRVPAAAPPRR

SEQ ID NO: 69924 - DNA, 731 bp, Zea mays
  misc_feature: Ceres CLONE 1548787
  misc_feature: Encodes the peptide sequence at SEQ ID NO. 69925
  misc_feature (228)..(228): n is a, c, t, g, unknown, or other
  misc_feature (542)..(542): n is a, c, t, g, unknown, or other
  misc_feature (543)..(543): n is a, c, t, g, unknown, or other
  misc_feature (572)..(572): n is a, c, t, g, unknown, or other
ccccgcggtggcggccgctctagactagtggatcccccgggctgcaggaattcgtctcacccctagaaaaatctttttcttcctcgcgccgccgccgccgtgacggaaggaagaggaggagcaaggagcacgacccgatgggtcacttccacgttttggaactcgcaccccaaaaaaataaaggccctggctccccgccttttgccgggtttgcgccaaaccctcccngtcttatctagaaatacgggtttcttttgtttgcaagaatgttttttttcataaaacgccaaaggaaaattggttttttctctcgaccccccttaaaaaaaacccctttttttcctgcttgttaaaaaattatttgtgggccccccccccccccccctttttctttttgggggggggtgggggccccccccggcgacccccttttttataattttttttttttgtacaatagtgggtgtcaccaacaattggttgaagtcaactgtttgttttttttttcctttggtcccctatataggctctcctcctggtgnngtttgttttgttgggggggcccttctggnattggttttttccccccaaaaaaaaaaaaaaaaagaaacgcccgggggtgcccttattttgtcctttgtgggggggttgtgttttttccgcccgtctcccttcgggtgccgctccttttatattctccttcctcgacccgcggggataaaccctcttcg

SEQ ID NO: 69925 - protein, 33 aa, Zea mays
  misc_feature: Ceres CLONE 1548787
  misc_feature (31)..(31): Xaa is any aa, unknown, or other
MGHFHVLELAPQKNKGPGSPPFAGFAPNPPXLI

SEQ ID NO: 69926 - DNA, 647 bp, Zea mays
  misc_feature: Ceres CLONE 1548788
tcccccgggctgcaggaatgcgtctcacccctagaaaaaaacgagaacagaaatctcgtgtggaacaaaagggtaaaagctcgtttgattctgatttccagtacgaatacgaaccgtgaaagcgtggcctatcgatcctttagaccttcggagtttgaagctagaggtgtcagaaaagttaccacagggataactggcttgtggcagccaagcgttcatagcgacgttgctttttgatccttcgatgtcggctcttcctatcattaaagatatggaaatagccataatacataaaaaaaaaaaaaaaaaacgagacgctcgaggtacccaattcgcccctatagggagtcgtattacgcgcgctcactggccgtcattttacaacgtcgtgactgggaaaaccctggcgttccccaactttattcgccttgcagcaaatccccccttttcgccaggttggcgtaaatacgaaaaaggcccgcaccgattcgccctttcccaaaagttggcgcctccctggattgggcgaatggaaaatttgtaaaccgtttaatattttttgttaaataatccggcgttaaattttttgtgttaaaacccacccccttttttttttaccccaaatagggcccaatatctcggcaaag

SEQ ID NO: 69927 - DNA, 655 bp, Zea mays
  misc_feature: Ceres CLONE 1548792
  misc_feature: Encodes the peptide sequence at SEQ ID NO. 69928
ggagctccccgcggtggcggccgctctagaactagtggatcccccgggctgcaggaattcgtctcacccctagaaaaatctcgcccatgttcgcgaaacccagagccgaactgcccccagtcgacctcggctctccggcgagctgccctccatgtcgtggccacacagtcgttcgtctcgccgatcgcccaggaagatctgcgatgcgctcgtcgttgccgagatcgcgattcgtttatgagcttcgaggaatcgatgatcaagcatggcgacaaagtgatcgaactcttcgagttctacgagatcgaagaccctgagcatctgtttggtgaaggtgccttcggtgcaatctatgcttaggtaaagaagaatgcgtcgaggcggatctccaggagttccagacttcgacgagttcgaggattaggctagcgacctcccccagtcagctgcctgtggggggtttatttacgttggctacgttcctattcgggggaccttgataaattaaggaaatgactccagccctttaaattattacccctttctaattggtaatccaaagccttgtggcttaaaaaaaggaaaaaaaaaaaaaaaccggaaacctccggggtccccatttcccccctaatggggggccaattccccgcgcccc

SEQ ID NO: 69928 - protein, 40 aa, Zea mays; identical to SEQ ID NO: 9274
  misc_feature: Ceres CLONE 1548792

SEQ ID NO: 69929 - DNA, 632 bp, Zea mays
  misc_feature: Ceres CLONE 1548795
  misc_feature: SWISSPROT Homolog: EC 3.2.1.23 Beta-galactosidase
  misc_feature (302)..(302): n is a, c, t, g, unknown, or other
tgtggatcccccgggctgcaggaattcgtctcacccctagaaaaacttacctggacggggttgacgggcgatcaagaagcctcgtggcctaggccagtggcccacattgcacatggtgggtgcgctggcttaccatctccccaagtgggagagtggacgtcataatttgtggtagagggggtacgcgttcgcgcggcccccgccaaatcttataaatttcatgtaagtccccttatctgaagggcttgaaatgttatctttatttcgccacattttataaattataatttaatttttcgctnatccaaacaacaatgatcaaaaaaaaaaacaaagaaaactcttccctccacattattacgggaacaaaaaaaacccaacgggcgagacgctcgaggtacccaattcgccctatagtgagtcttattacgcgcgctcactggccgtcgttttacaacgtctggactggaaaaaccctggcgttacccaccttaatccccttgcagcaaatccccctttcgccagctggcgtaatagcaaagaggccctcaccaatcccccttcccaacattttcccaccctgaaaggccaatggaaaattgaaagggtttatatttttgttaaaattcccg

SEQ ID NO: 69930 - DNA, 658 bp, Zea mays
  misc_feature: Ceres CLONE 1548798
  misc_feature (414)..(414): n is a, c, t, g, unknown, or other
  misc_feature (422)..(422): n is a, c, t, g, unknown, or other
  misc_feature (425)..(425): n is a, c, t, g, unknown, or other
  misc_feature (440)..(440): n is a, c, t, g, unknown, or other
  misc_feature (443)..(443): n is a, c, t, g, unknown, or other
  misc_feature (639)..(639): n is a, c, t, g, unknown, or other
ggagctccccgcggtggcggccgctctagaactagtggatcccccgggctgcaggaattcgtctcacccctagaaaaaacaacagcgcctcaccagccagccaccaccgcgctccatttcctttctctctctctctcggctcctccgctctcttgcccgagtcgctagcttccctgccccgcctcctcccgtccccgtggacagacagctccccccacctccgcttccatagcatccgagctaaggtcaactcctccgtcggcggagcgagagcggggaagagacgggagggtcccggatccgagccgagctgcgctccccgcgcgaccgacacccaggtctcgtcgtcccatgcagatctgctcctcctcctgagatctaaaccgaagcttgagctccggttgttggtggttnggtcggcngcngcaggggaagctgcnaanatgtcgtcgagcacgatccgcaagggcctgggccgcgtgaaggacccagacagcatcggcctcgccaaggtcacagcaacatcgcgccgaagctggacgtgctcatcgtcaggccacgagccacgacgacgagccggccgaagagcgccacatccgcgagatcctccactcacatccggatcccgcgcccacgtcnctgctgccgtggcaagctc

SEQ ID NO: 69931 - DNA, 716 bp, Zea mays
  misc_feature: Ceres CLONE 1548801
  misc_feature: Encodes the peptide sequence at SEQ ID NO. 69932
ctcaccgcggtggcggccgctctagaactagtggatcccccgggctgcaggaattcgtctcacacctgagacctgctgagtacaagaggtctaggttgccaaggaaccgcaggactgtgaaccgtccatatggtggtgttctgtctggtaccgcagtcagagagaggatcatccgtgcctttttggtcgaggagcagaagatcgtgaagaaggttttgaagatccaaaagaccaggataaggcctccaagaactaggcgatataggcatcttccacaatgttcaagtcccttagatgatatggtttaaattttgagcggaagttgccgatccttttatttttttaaaatctcggtgggaaggtttttcagtgcgggcgggggggatgtccagatattttggctgagggccccccccccccttttgcttccgtgttggaaataacccacacttaatcggtcaacaactacttattttaaaccgaaaacccctccaaggttccccaatttcccccttttgtatggggttccctttctccccccccctcatccggccccttcttttttacaccctccctacaccgcggaaaaaccccgttggttgtacccaaattttatcccgccttgaagaacaccccccctttttttcccattgtgcgttttaataaccttaactaacccccctcctatttttcccttttctaaaatagttggcacc

SEQ ID NO: 69932 - protein, 101 aa, Zea mays
  misc_feature: Ceres CLONE 1548801
  misc_feature (1)..(68): Pfam Name: Ribosomal_L34e Pfam Description: Ribosomal protein L34e
HRGGGRSRTSGSPGLQEFVSHLRPAEYKRSRLPRNRRTVNRPYGGVLSGTAVRERIIRAFLVEEQKIVKKVLKIQKTRIRPPRTRRYRHLPQCSSPLDDMV

SEQ ID NO: 69933 - DNA, 634 bp, Zea mays
  misc_feature: Ceres CLONE 1548802
  misc_feature: Encodes the peptide sequence at SEQ ID NO. 69934
agctccccgcggtggcggccgctctagaactagtggatcccccgggctgcaggaattcgtctcacccctagaaaaaaccgagactctctcaattccccactcatatagtcatatttgctcagccttttgcaaacgagttgaaatcaccttgttcaaatcgtcccctcctctctctctctcgctcgctcgccaagcacaatcttctgcgcgttcgtgttgcggatttgttaattggttggtcagctcctctctgacccagaggcaaagccatggctctcacgctgcgttcctcgacgtcgttcctgtcgcctgtggaccccacgtccaagctcctccacaagcccgccgacgaggcgcagccctgctgcgtcgccgtaccccctgcgcccggccgcaggccgcgcgcgctcagggcggccgcggccgcggccgcggcgccctcaccggcgacgggccgcgcgccggcggatgcaggcgagctgctgcacggcggcggcacagagcagcaccacgggcttccgcgcggcggggtgccggtatacgtgatgctgcagctggacacggtggggccagtcggccagctgtcgcggcaacgcgcgttggcggacagtctgatggcgctgcggggcgcggg

SEQ ID NO: 69934 - protein, 121 aa, Zea mays
  misc_feature: Ceres CLONE 1548802
MALTLRSSTSFLSPVDPTSKLLHKPADEAQPCCVAVPPAPGRRPRALRAAAAAAAAPSPATGRAPADAGELLHGGGTEQHHGLPRGGVPVYVMLQLDTVGPVGQLSRQRALADSLMALRGA

SEQ ID NO: 69935 - DNA, 654 bp, Zea mays
  misc_feature: Ceres CLONE 1548807
  misc_feature: Encodes the peptide sequence at SEQ ID NO. 69936
  misc_feature (391)..(391): n is a, c, t, g, unknown, or other
  misc_feature (478)..(478): n is a, c, t, g, unknown, or other
  misc_feature (484)..(484): n is a, c, t, g, unknown, or other
tggagctccccgcggtggcggccgctctagaactagtggatcccccgggctgcaggaattcgtctcacccctagaaaaaagagagcgcgcgctggcaatggcgggagccgacgacctgaaggtgctgggcctgtggacgagcccgttcgtgatccgggtccgcatcgtgctcaacctcaagggcctggcgtacgagtacgtggaggaggacctcggcaacaagagcgcgctcctgctcagctccaacccggtgcacaagaccgtgcccgtgctgctccacgcgggtcgccccgtaaacgagtcccagatcatcctgcagtacatcgacgaggtctgggcggggaccgggccggccgtgctgccccgcgacccctaggagcgcgcggcggcncggttctgggctgcctacatcgacgacaaggtgaagtccgcgtggctgggcatgctggtcaagtgcagggacaagggggagcgggcngaggcngtggcccgggcccgcaaggccctcgggactctggagggcgcgctcaaggggaagcccttctttgggggggacggggttcggtttgtggacccctggctccggcggtaccccgggtgggttcgggggcctccggagggttcatcggccccagggttaatcgaccccactaa

SEQ ID NO: 69936 - protein, 92 aa, Zea mays
  misc_feature: Ceres CLONE 1548807
  misc_feature (5)..(78): Pfam Name: GST_N Pfam Description: Glutathione S-transferase, N-terminal domain
  misc_feature: SWISSPROT Homolog: EC 2.5.1.18 Glutathione transferase
MAGADDLKVLGLWTSPFVIRVRIVLNLKGLAYEYVEEDLGNKSALLLSSNPVHKTVPVLLHAGRPVNESQIILQYIDEVWAGTGPAVLPRDP

SEQ ID NO: 69937 - DNA, 709 bp, Zea mays
  misc_feature: Ceres CLONE 1548811
  misc_feature: Encodes the peptide sequence at SEQ ID NO. 69938
  misc_feature (507)..(507): n is a, c, t, g, unknown, or other
gagctggagctccccgcggtggcggccgctctagaactagtggatcccccgggctgcaggaattcgtctcacccctagaaaaagttccgcttcgtcccagcctctagttcttcctttcctccagagtgatggccaaatgctactcagattggcccccgattccgcctttccatccatcgcgaagaacgccgccgcaatcccacgcctccccgatcacgatcaggcggcagctcgcgtccttcgtgctccactgctccagatcctgcgctcccctcctcgagcccaagaacctgcccgatgagttcgaggccgtaccggcgacgccgccgccgccgctgccggacgccgccccgaagctggggatttctaacaagttcatccgaggcctctgcggtgacccgcagaccgagcagctggccttcgagggctacaggagggcgctgctgcagcccgagttccggctggagaagagacggcccacgcgctgaccctgcagctgatcagggnagagcagtggggctccctggagctgctggtcgaagacttcaggccccacggcgtgctcccggaaaagcggaacgtgcgcgcgggtcgtcccctgcttgatagggccggggaaggtcccgccttccccaaaccggtgctccgggtctttcaggcaaaaagggacccccccttggcatggccttaacggggccattgaagggta

SEQ ID NO: 69938 - protein, 119 aa, Zea mays
  misc_feature: Ceres CLONE 1548811
MAKCYSDWPPIPPFHPSRRTPPQSHASPITIRRQLASFVLHCSRSCAPLLEPKNLPDEFEAVPATPPPPLPDAAPKLGISNKFIRGLCGDPQTEQLAFEGYRRALLQPEFRLEKRRPTR

SEQ ID NO: 69939 - DNA, 864 bp, Zea mays
  misc_feature: Ceres CLONE 1548813
  misc_feature: Encodes the peptide sequence at SEQ ID NO. 69940
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (35)..(35): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
tttttttttttttttgttggggggggnncnnnncncgcgaaannnnaaacaatgggcccaaacaagtttggcggtcgctcttgactagtggatcccccgggctgcaggaattcgtctcacccctagaaaaaaatatccactccggtacagtagtaggtaagttagaaggggaacgcgaaataactttaggttttgttgatttattgcgcgatgattttattgaaaaagatcgttctcgcggtatcttttttcactccagactgggtatccatggccagtgttatacggtggcttttggggggattcctgtttgggataacccccttccgacccaaatcttctggaaaaaatcccaaataaacaattggggggaaaaaatttaagaaataccttgggaaaaaacaaccctttttttttctccccccccccccggggggggggggagggggggggattaaatcactcactactaaatggggtcatatttcttcctttgtcagaagtatttgaaaaattttttttaaaatacctctcttgctacaaatattcttcgctcgttaatttcactcccgcccctcttttctttttaacatctttcacactttcctcaagaaacctaggggggcgggttttttataagaaaatattcttttcactctccctttttttattcccccttatcccctcagtatcttcagttgggggggggggggcgccttccggtttcccccctaccttcccttcccattaaccccagagtgcccgctcattatattccgtcagcccattttagggcgtcacctccgctcgttgcaaaagatgtgtccccggtttgtgaaaaacacaaccaccctatctcccacc

SEQ ID NO: 69940 - protein, 126 aa, Zea mays
  misc_feature: Ceres CLONE 1548813
  misc_feature: SWISSPROT Homolog: EC 4.1.1.39 Ribulose-bisphosphate carboxylase
  misc_feature (9)..(9): Xaa is any aa, unknown, or other
  misc_feature (10)..(10): Xaa is any aa, unknown, or other
  misc_feature (11)..(11): Xaa is any aa, unknown, or other
  misc_feature (14)..(14): Xaa is any aa, unknown, or other
  misc_feature (15)..(15): Xaa is any aa, unknown, or other
FFFFCWGGXXXREXXNNGPKQVWRSLLTSGSPGLQEFVSPLEKNIHSGTVVGKLEGEREITLGFVDLLRDDFIEKDRSRGIFFHSRLGIHGQCYTVAFGGIPVWDNPLPTQIFWKKSQINNWGEKI

SEQ ID NO: 69941 - DNA, 667 bp, Zea mays
  misc_feature: Ceres CLONE 1548816
  misc_feature (484)..(484): n is a, c, t, g, unknown, or other
  misc_feature (485)..(485): n is a, c, t, g, unknown, or other
ggagctccccgcggtggcggccgctctagaactagtggatcccccgggctgcaggaattcgtctcacccctagaaaaagaaagaacagagggaccgccgcagtgagagcttggccaagaggaggtctaagctttctgccgccgccaaggcttctgctgccacctctgcctaagaatgatcagtgctttgagatgttttcaaggcctattttgttacagcttataagtaccttatgctgccctggctgtgttgcatcagtcgaccctccctacttagacttatgagtaattgttgcaattttgtatggacatggtactggcttgtcgggattttttgagtaccagaggtttgatatgttgttttattctgtgaacgtcagctagccttgttcttttgtctgcagtctgcaccatatgttgaactgctggattttttctgcttcttatggagtcattgagccaataactaaaaaaaaaaaaaaaannaaacactcgaggtacccaattcgccctataatgagtcgtattaggcgcgcttcctggccgtccgttttaaacccccctgactgggaaaaaccttggggttccccgcgtgaggcccttgaagcccctccccctttccccttttggcccatagcggaaaagccctttaccaatcccctcccaac

SEQ ID NO: 69942 - DNA, 670 bp, Zea mays
  misc_feature: Ceres CLONE 1548817
  misc_feature: Encodes the peptide sequence at SEQ ID NO. 69943
gcggtggcggccgctctagaactagtggatcccccgggctgcaggaattcgtctcacccctagaaaaaaccgaaatcttccgtctccaaatcctcctagcgaattcaccacagcttctcaccaccgctaccttcgatggcacccaaggcggacaagaagccggcggcgaagaagcctgcagaggagcccgcgacagagaaggcggagaaggctccggcggggaagaagcccaaggccgagaagcgcctcccggcgggcaagtccgccggtaaggagggcggcgagggcaagaagggcaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagataggggttgagtggtcgttccagt

SEQ ID NO: 69943 - protein, 132 aa, Zea mays; identical to SEQ ID NO: 66907
  misc_feature: Ceres CLONE 1548817
  misc_feature: SWISSPROT Homolog: EC 3.2.1.23 Beta-galactosidase

SEQ ID NO: 69944 - DNA, 696 bp, Zea mays
  misc_feature: Ceres CLONE 1548827
  misc_feature (166)..(166): n is a, c, t, g, unknown, or other
  misc_feature (696)..(696): n is a, c, t, g, unknown, or other
ctccccgcggtggcggccgctctagaactagtggatcccccgggctgcaggaattcgtctcacccctagaaaaatcattttctaccacttttcattacctaacgctgagctttttatgtactatatcttatatgaggaataataatatgaccgccttgtgatctcntggacgagatggagttcaccgaggccgaaagcacatgaacgacctcgtgtcggagtaccagcagtaccaggacgcgactgccgacgaggaggagtactaggacgaggaggaggtgcaggccgatgacatgtgaggggagggctgttatcgtgtgaaaccttgtggtccctagggcaagcggacctcgatgagttcggtgttcccttgcgtgtagttgccatctttctactgctagcgtacccaccctcgtggcccattccgcactgtagacggatgatttatcttgggcatggaaccttgcttatagtacggtacaatcctgctaaaatgcttggcctttgaaggtcctggggcaaaaaaaaaaaaaaaacccaaacgccccgggtaacccaattccgcccaaaagggaatccgtattaaccggcgtttcaagggccagtcccttttaacacccaaccgggaaaagggaaaaacccctgggggggtaccccaaaactttaatcccccctgggcaaaaaccatcccccccn

SEQ ID NO: 69945 - DNA, 675 bp, Zea mays
  misc_feature: Ceres CLONE 1548829
  misc_feature: SWISSPROT Homolog: EC 3.2.1.23 Beta-galactosidase
  misc_feature (494)..(494): n is a, c, t, g, unknown, or other
  misc_feature (501)..(501): n is a, c, t, g, unknown, or other
  misc_feature (571)..(571): n is a, c, t, g, unknown, or other
  misc_feature (675)..(675): n is a, c, t, g, unknown, or other
tccccgcggtggcggccgctctagaactagtggatcccccgggctgcaggaattcgtctcacccctagaaaaatgaatgcgatgttgtcgtgacagaactgcatttcattttgtattatggttgttcaagatgttatattaccatgaggcgaggtagcttgactgagtgttgctatactttatgcagcagttcaagtgatttatgtggtaactgtattagacgatggtggatcggcagatacgatatcttcgatgatttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaagcccgcaccgatcgcccttccccacagtgcgcagcctgaatggcgaatggaaattgtnaagcgtnatattttgtaaaaattcgcgtaaaattttttgtaaatcagctcatttttttaccaattaggccgaaatcngcaaaatcccctataaatcaaaagaataaaccgaaatagggttgaattgttgtcccagtttgaaacaagagtcccctttttaagaacgtgaacctccacctcan

SEQ ID NO: 69946 - DNA, 881 bp, Zea mays
  misc_feature: Ceres CLONE 1548836
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
acacacactttctccgccacccctcttaccttcttnnnnnnnagtannnnnaaattcctggagctcaccgcggtggcggccgctctagactagtggatcccccgggctgcaggaattcgtctcacccctagaaaaaggtgctctgcggccactggactgccctgccagtgctcggtgcccgtgcccgcgcgcgctagcctagctgctcctgcctggttcgccgtagcccgtaccccgtagcacaacaacaacaaaaaaaatctcctcggcgcggggggaggtggtctgttccccttggggagcagcggcgggccttccacccaaaaaagcctgggggcgccctcctcctcaacggcaccggcggccgtatggcggactacgcgggggggcctcaccgtcccccgttgtttatgccccggcatcaggggggggccggggggcaccctcccctttccgtataccaaaacccccccccccccccccgaccgtgtttccaagtaaccgcgagcgaatttatcctgaaacccaagctcccctctcctcggagggttcgcctttcacatgaggcacgggggcctgtttctccctcccccctggtcagcgctagcccaacgccttttttctcccacaccacttttctcgctagtccttctccccgcctccccccaccctttcatagcccctcgatccccccccctttaatcctgatgttaccgcgagttacgccgtccgattgcccagataactctttctacccctccaccagtgtccgtcgctcacccgttcctttgtgattccctgtattgtacacttctgtccgccaccccttctctccttttttaccgtcggtttcctttctccccgctctttccccgcccttc

SEQ ID NO: 69947 - DNA, 656 bp, Zea mays
  misc_feature: Ceres CLONE 1548838
  misc_feature: Encodes the peptide sequence at SEQ ID NO. 69948
ctccccgcggtggcggccgctctagaactagtggatcccccgggctgcaggaattcgtctcacccctagaaaaatcccccctagaaaaaagaaagcttggtcggcgttgaagatgtcaggccttatatagcaaggaagttcaacctaagggagaaggtagccaccgcatcttctcttacaatagacatgcagatgtgatccgtccaatgctgccaggtatttttcaggtgccaaaggtcgccgtgatgacaaatgtaggaccggagctgatatagtggttcttgttgaatgtagcatgtcaggatctcctggctccttgcattattgtatgctctaccgaccgcaatgtacaattttcgctgcagttggcagttgtagacttcacttgcattttgttggcccagttgacatgggaagggcctacttgaacattttgtcgatcagttaatatcgtgttgattcaaaaaaaaaaaaaaaaacgagacgctcgaggtacccaattcgccctatagtgagtcgtattacgcgcgctcactggtcgtcgttttacaacgtcgtgactgggaaaaccctggcgttacccaacttaatcgccttcagcacatccccctttcgccagctggggtaatagcgaagaggcccgcacagatctccct

SEQ ID NO: 69948 - protein, 50 aa, Zea mays
  misc_feature: Ceres CLONE 1548838
MSGSPGSLHYCMLYRPQCTIFAAVGSCRLHLHFVGPVDMGRAYLNILSIS

SEQ ID NO: 69949 - DNA, 675 bp, Zea mays
  misc_feature: Ceres CLONE 1548844
  misc_feature: SWISSPROT Homolog: EC 3.2.1.23 Beta-galactosidase
  misc_feature (583)..(583): n is a, c, t, g, unknown, or other
  misc_feature (673)..(673): n is a, c, t, g, unknown, or other
ccccgcggtggcggccgctctagaactagtggatcccccgggctgcaggaattcgtctcacccctagaaaaagttcagtcgtcctcttcctccaaacctttccgctgccggtgaacttcctccacctgaagcccctaccacgataagccctatgaacaactttatcttcctccacatgtaatcataataatactcagattctccccacagccagattctcagaaaagctggttaaaaaaaaaaaaaaaaacgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggaaattgtaagcgttaatattttgttaaaattcgcgttaaatttttgttaaatcagctcatttttttaaccaataggccgaaatcggcaaaatcccttataaatcaaaagaatagaccgagantagggttgagtgtttgttccagtttggaacaagagtccactattaaagaacgtggactccaacgtcaaagggcgaaaaaccgtctatcangg

SEQ ID NO: 69950 - DNA, 635 bp, Zea mays
  misc_feature: Ceres CLONE 1548845
  misc_feature: Encodes the peptide sequence at SEQ ID NO. 69951
cgcggtggcggccgctctagactagtggatcccccgggctgcaggaattcgtctcacccctagaaaaagcagcaaaaccgcgccccaccgctttcccgttccccaccccgaccgactgctcccccctccccgcaccagcctcaagccctcaaggcatcgccggcgccgcaacttcgctgaggaagcccgcacccctgcccggatccgatggccaacagcaacctcccgcggcggatcatcaaggagactcagcggctgctcagcgagccagcaccggggatcagcgcgtcgccctcggaggagaacatgcgctacttcaacgttatgatccttgggccggcgcagtcgccctatgaaagtggagtttttaagcttgaactctttttactgacgaatatccaatgctgccccaaaggtaggttcttgacaagatttatcatcccacatccacaagctgggtaggaatgcctccaccttctcagggacaatggaagccagcccttcagattcaaacggtcttttggttaaccaggccctactgagtgggcccaaatccaaagaaccctctttccgaaaacctttgcaaacccttggaaagccccatggggtaaaaaccttttttaaacacctagggg

SEQ ID NO: 69951 - protein, 84 aa, Zea mays
  misc_feature: Ceres CLONE 1548845
  misc_feature: SWISSPROT Homolog: EC 6.3.2.19 Ubiquitin--protein ligase
MANSNLPRRIIKETQRLLSEPAPGISASPSEENMRYFNVMILGPAQSPYESGVFKLELFLLTNIQCCPKGRFLTRFIIPHPQAG

SEQ ID NO: 69952 - DNA, 715 bp, Zea mays
  misc_feature: Ceres CLONE 1548852
  misc_feature: Encodes the peptide sequence at SEQ ID NO. 69953
  misc_feature (329)..(329): n is a, c, t, g, unknown, or other
  misc_feature (410)..(410): n is a, c, t, g, unknown, or other
ggagctcaccgcggtggcggccgctctagactagtggatcccccgggctgcaggaattcgtctcacccctagaaaaaaccgggcacacaccatcacagtacacacacacacacgcacacgctcatcaagcttctctctcgcctactcggctgcaatggcgcgcttccagctcgcggccctggccatggcaatgctcttcgccgccgcggcggcgcaggccccggccgccaccccgacgccggctcccaaggcgtctcctcccccgccggcgacgccgcctccgacgcccgcgaccccgccgcccgccccggcgccggtgtcgccgcccngccagcctccggccacgcctcccccggccccggcgcccgctcccaaggccccccgcccccgcgcccgaaggcccccccccnggtgccccaagccgaggcccccgaccccccaaaataacctccccgccaaatgccacgggagggccccggccccaaaggccttcggccaaaggggccccttgcccccaaagcccgcccccgcctttttccccggccgcccccaaagggtattcccccccctctccccccgtggcccccccccccccccccccttttttttttaaagaaggggaaatctcccccgcccccggggggaaaataaaattggtaccccgggttggccccgcgaaaacccctccctattttttccctgacccccctttttt

SEQ ID NO: 69953 - protein, 63 aa, Zea mays
  misc_feature: Ceres CLONE 1548852
MPREGPGPKGLRPKGPLAPKARPRLFPRPPPKGIPPPLPPWPPPPPPLFFLKKGKSPPPPGGK

SEQ ID NO: 69954 - DNA, 701 bp, Zea mays
  misc_feature: Ceres CLONE 1548853
  misc_feature: Encodes the peptide sequence at SEQ ID NO. 69955
tccccgcggtggcggccgctctagaactagtggatcccccgggctgcaggaattcgtctcacccctagaaaaaaccggcgcatagcattctcttcccttccctgagcaaagagaagtagccacaagcatgtctggcatcatcgacaagatccaggagacgctccacatcgggggcgaccacaaggaggagcacgagcacaagaagggcgaggagcaccacaagaagggcgaggagcaccacaagaaggacgacggggagcacaaggagggcatcgtggagaagatcaaggacaagatcaccggcgagcacggcgacaagtccggcgaccacaaggacaaagaccataaggagtttatcacccccccccggagggagggggggggggtcccccattcgccctatagtgagtcgtattacgcgcgctcactggccgccgttttacaacgtcgtgactgggaaaaccctggcgtaacccaacttaatcgccttggcagaaatcccccctttccccagctgggcgtaatacccgaaaagccccccaccgaatcgcccttccccaaaagttgccccaaccctgaaatggccaatggaaaatatgtaaccccttaataatttctgttaaaacttccccgttaaattttcttggaacaatccacccccattttttttagacccaaacgggcggaaatccgggtaaaag

SEQ ID NO: 69955 - protein, 160 aa, Zea mays
  misc_feature: Ceres CLONE 1548853
  misc_feature: SWISSPROT Homolog: EC 3.2.1.23 Beta-galactosidase
MSGIIDKIQETLHIGGDHKEEHEHKKGEEHHKKGEEHHKKDDGEHKEGIVEKIKDKITGEHGDKSGDHKDKDHKEFITPPRREGGGVPHSPYSESYYARSLAAVLQRRDWENPGVTQLNRLGRNPPFPQLGVIPEKPPTESPFPKSCPNPEMANGKYVTP

SEQ ID NO: 69956 - DNA, 651 bp, Zea mays
  misc_feature: Ceres CLONE 1548858
  misc_feature (516)..(516): n is a, c, t, g, unknown, or other
  misc_feature (544)..(544): n is a, c, t, g, unknown, or other
  misc_feature (622)..(622): n is a, c, t, g, unknown, or other
cgcggtggcggccgctctagaactagtggatcccccgggctgcaggaattcgtctcacccctagaaaatatggcactgtgagatttgtaatcggaaacctggccgtggttttgaaacaacggttgaggtgctaccacgactatgccaaattaaatatgccagtggtaccctggaagaacttttgtacattgacatgccacatgagtcccagaatacgtcaggccagattattttggactacacgaaagcaatccaagaaagtgtttttgagcaattgcgtgtcgtacgagagggacatctacggatagttttcaatccagaccttaagatcgcatcttgggagttctgtgctaggcgtcatgaagaacttattccacggagatctataataccacaggttagtaatcttggcgcagttgtacaaaagtatcaggctgccgcacagaactcaacgagtttgtctcctcaggacatgcagaataattgtaactcgtttgttgcatgtgcccgacattnggcgaaagcactggaggttcctttagtnaatgatttaggatacacaaaacgatatgttcgctgctttcagattgccgaggtcgtaaactgtatgaaggatttattngatcacagcaggcagactggatctggacc

SEQ ID NO: 69957 - DNA, 673 bp, Zea mays
  misc_feature: Ceres CLONE 1548861
  misc_feature: Encodes the peptide sequence at SEQ ID NO. 69958
tggagctccccgcggtggcggccgctctagaactagtggatcccccgggctgcaggaattcgtctcacccctagaaaaaaccggcgcatagcgttctcttcccttccctgagcaaagagagatccccactagcatgtctggcatcatcgacgatatccaggagacgctccacatcgggggcgaccacgaggaggagcgcgagcacaagaagggcgaggagcaccacaagaagggcgaggagccccgcaagaacgactacggggatcacaaggagggcatcgtggagaagatctgggacaagatcaccggcgagcacagcgacaagtcccgcgaccacaaggacaaagaccgtctggagaagaacaacccttacaaaaacgagacgctcgaggtacccagttcgccctatagtgagtcgtattacgcgcgctcactggccgtcgttttacaacgtcatgactggaataaccctggcgtatcccaacttaatcgccttgcagcacatccccctttcgccagctggcgcaatagcgaagaggcccgcaccgatcgcccttcccaacacgtgcgcagcctgaatggcgaatggaattgtaaccgttactatcttgtaaaattcgcgttccatttttgtaaaatcaactacattttttaaccggctaggccgaaatcc

SEQ ID NO: 69958 - protein, 173 aa, Zea mays
  misc_feature: Ceres CLONE 1548861
  misc_feature: SWISSPROT Homolog: EC 3.2.1.23 Beta-galactosidase
MSGIIDDIQETLHIGGDHEEEREHKKGEEHHKKGEEPRKNDYGDHKEGIVEKIWDKITGEHSDKSRDHKDKDRLEKNNPYKNETLEVPSSPYSESYYARSLAVVLQRHDWNNPGVSQLNRLAAHPPFASWRNSEEARTDRPSQHVRSLNGEWNCNRYYLVKFAFHFCKINYIF

SEQ ID NO: 69959 - DNA, 659 bp, Zea mays
  misc_feature: Ceres CLONE 1548862
  misc_feature: Encodes the peptide sequence at SEQ ID NO. 69960
ggagctccccgcggtggcggccgctctagaactagtggatcccccgggctgcaggaattcgtctcacccctagaaaaaggttagcttttactcatctttttctcttggcttctactcctcgcccacgcctcctccctcctccctccctcccgtcgtcgcttcgcttcccttcccttcccttgcgaatcatctgaccaccgaagcgcagagccgccccccggaggaaacaaaacctagcgcaggcgccgatcaccgccgccccacatggcgtccccggcacggccagccgccacatccgtctccggcgccttcggcctctcgcccgaccccaaacgctgctccttcgaccaggcgctccggcacaaggagaacagactgttgatgtcatttgttaattaccacgatcaagaaaaggtctctaaagaaatcgtaacagatgctatagaaagctgcatgaagaaacaggcagataacttgttgaattcgctggaagttatcagtggtaggctgtcgcaattggagctgtattgctataagctggaaaggtccattggagaattacgaagtgacgtgatggattatcataacgaagcaaatctcaacttccagtgccttgacaagcaagtgaaagaggttcagaaatctgtgcaggtcgttca

SEQ ID NO: 69960 - protein, 131 aa, Zea mays
  misc_feature: Ceres CLONE 1548862
MASPARPAATSVSGAFGLSPDPKRCSFDQALRHKENRLLMSFVNYHDQEKVSKEIVTDAIESCMKKQADNLLNSLEVISGRLSQLELYCYKLERSIGELRSDVMDYHNEANLNFQCLDKQVKEVQKSVQVV

SEQ ID NO: 69961 - DNA, 826 bp, Zea mays
  misc_feature: Ceres CLONE 1548865
  misc_feature: Encodes the peptide sequence at SEQ ID NO. 69962
gtcgtttaccttacccctttttacttccctattttttccctcccttttaattaaccatcagaaactccccgcggtggcggccgcttttcaatagtggatcccccgggctgcaagaattcgtctcacccctagaaaaagttaagtccatgcttggtccataccttgttttcctctcgtccactgtcaatgggtatgaaggtacaagtcgattattgtctcggaagcttctcgagctattagaatcccaaagccattcatctgttttgtctaatggatttacttccagtagggtctctaagaaaattgtccttgaacgcctctattggatcagacttttggtgatcttgttgagacctgttcttaatgatcgctctttctttggatcctttgcagttcctttccaaagttgaacggtgtttttttttttataaaaatgtatactctgtattatgttagggtatggaccaaaccccctctaattatccccatccgaaatgaaattacctatcactttattaagaacgcggacgattatgttgcatttctctaccatcagaacctttgccgtaatccgttattcacattagaggtatttcacgtcacatatcggtgaccgtacggatttttaattactttccggcacaactagggacagtaaaaaccttagagttattggacgcctttttttccgtattcaatatgactggttaattcgccgataattttttccgacatatttgctatatcttttcgtcatacaaaaataattctcttgtttactacccggatatagtaaagtaaatctcgtaggcgctcgttattatat

SEQ ID NO: 69962 - protein, 87 aa, Zea mays
  misc_feature: Ceres CLONE 1548865
MLGPYLVFLSSTVNGYEGTSRLLSRKLLELLESQSHSSVLSNGFTSSRVSKKIVLERLYWIRLLVILLRPVLNDRSFFGSFAVPFQS

SEQ ID NO: 69963 - DNA, 550 bp, Zea mays
  misc_feature: Ceres CLONE 1548866
  misc_feature (270)..(270): n is a, c, t, g, unknown, or other
tccccgcggtggcggccgctctagaactagtggatcccccgggctgcaggaattcgtctcacccctagaaaaacccttcttctctcttggtagttttcgcccctcgcgttgcgtgtatagactgtgaaaaagaggagtggggaaggggaaaaagaagaaagaaagagagagagagagagagagagagagcgttcaccgagaaatggccgtcgcctccggcgaacgcccggcgtacgggcagtagcacgctgggactggtggttggtttangccggtggtgtgttggtgcggttggctctgggttggttacttgtgcgagcgagattttgtggatgtaggcagtcgctgcgcctcatccctcatgcgatcgatgccgttccagctcaagaaccgtcaccaacaccacggccccctcatggaaagggagcccgcccccgccccccaaaaaccaacagcctgggcccaaccccgagggggtccaggctcccgaaggctgctcggggggtggtctttctcgaaaaaattccccccccaattggaaaggacaagg

SEQ ID NO: 69964 - DNA, 669 bp, Zea mays
  misc_feature: Ceres CLONE 1548870
  misc_feature: Encodes the peptide sequence at SEQ ID NO. 69965
ctggagctcaccgcggtggcggccgctctagaactagtggatcccccgggctgcaggaattcgtctcacccctagaaaaagatatgatatccgtccattccaatccccctcttccgctccgcctccctctagctcctctccctctcgcagccatcctcgtccccccaagaatccggacgtcgtttgtcccctccttttctgggcgtttacatctttaagctcaaagagaaaggattatgaaaatggcgcacttgatcactaattgcagctttcagacattctcgagttctcctaattactgccgcaatattgggcaactacagaactcaaaatcttcaaatctgtccctcaaatcttgttccaggagacaaaagaagtcatatgttacctgtgctagcgctgcccccacaggacagacacaaacacctcttactggtagccagcaagcttatgagcattcatcctccaaacctaaaaaggtaaatggttattggtggagatggatactgttgggtgggcaacagcacttcatcttctcaaacaagggttatgaagttgccgattgttgaataatcttggccgcccggggcttttgaaaacccacctcggtctttgattccccttacccccctaaccccccatcccaaatctgggcccttaaatgggaaa

SEQ ID NO: 69965 - protein, 108 aa, Zea mays
  misc_feature: Ceres CLONE 1548870
MAHLITNCSFQTFSSSPNYCRNIGQLQNSKSSNLSLKSCSRRQKKSYVTCASAAPTGQTQTPLTGSQQAYEHSSSKPKKVNGYWWRWILLGGQQHFIFSNKGYEVADC

SEQ ID NO: 69966 - DNA, 657 bp, Zea mays
  misc_feature: Ceres CLONE 1548874
  misc_feature: Encodes the peptide sequence at SEQ ID NO. 69967
ctcaccgcggtggcggccgctctagactagtggatcccccgggctgcaggaattcgtctcaccccctagaaaaatcgccatcctcatttcgtcctgttatctcgtagctccacagtccacacccaccatcccgttctccctctcttctcctctccaggtccctgccacccacacaaggcttggactcttgggccggccgggggggaaagaaacaagacaaaacgcagccgccggcatgatggcgatctgcagcgcgcacaccaccaccatctccctgcgctccccatgcacgacgaccgtctcgaacgcggcagctggcttggtgcagaagcaagtcatcttcttgaccagcatcaacaggaggagcggcagcagaaggcgtggaggaggggtgagcaggaccttactccaggtctcgtgctccgccgacggcaacaagccagtggtgatcggcctggcggcggactccgggtgcggcaagagcaccttcatgcgccggctcaccagcgtcttcggcggcgccgcggagccgcccaggggcgggaacccggactccaacacgctcatcagcgacaccacgaccgtgatatgcctcgacgactaccactccctggacaggaccggcaggaaggagaagggcgtcaccgcgctcgaccg

SEQ ID NO: 69967 - protein, 139 aa, Zea mays
  misc_feature: Ceres CLONE 1548874
  misc_feature: SWISSPROT Homolog: EC 2.7.1.19 Phosphoribulokinase
MAICSAHTTTISLRSPCTTTVSNAAAGLVQKQVIFLTSINRRSGSRRRGGGVSRTLLQVSCSADGNKPVVIGLAADSGCGKSTFMRRLTSVFGGAAEPPRGGNPDSNTLISDTTTVICLDDYHSLDRTGRKEKGVTALD

SEQ ID NO: 69968 - DNA, 618 bp, Zea mays
  misc_feature: Ceres CLONE 1548876
  misc_feature (300)..(300): n is a, c, t, g, unknown, or other
  misc_feature (347)..(347): n is a, c, t, g, unknown, or other
agctccccgcggtggcggccgctctagaactagtggatcccccgggctgcaggaattcgtctcacccctagaaaaagtcacggtggttttgcccggcgacgagatcgacagcctccgcgccgcgctcggtagcgcgctgcacgtcgcctgaaagctctagtacgtatcataatagtacgctgctgcctacgtgctcgttgcgtcgttcggtttcgcgatatcagagtaccacctcttgaagaaagtgtagtagcgtaatgaggcgtgactagtgatgtgatgtattgtactgtattgcangatgtttgcgctatactgtggtcgatttgcgatgtttgttctgtatncgatgatgtttccttaataagctgctcgaataggatcatgctcatgtaccatttatttacactgggagactagacaaaacaatcgttttgttagaaaaaaaaaaaaaaacgaaaccctcgagtacccatttccccttaaagggaatcgtattacccgcgcccctgggccgcctttttaaaaaggcgtgacggggaaaaacccggggtttacccaattaaacccctttggaaaaaatcccccttttcccccggtggggttaaaaacaaaaag

SEQ ID NO: 69969 - DNA, 662 bp, Zea mays
  misc_feature: Ceres CLONE 1548878
  misc_feature: Encodes the peptide sequence at SEQ ID NO. 69970
  misc_feature (531)..(531): n is a, c, t, g, unknown, or other
tccccgcggtggcggccgctctagaactagtggatcccccgggctgcaggaattcgtctcacccctagaaaaaggacagtcacttgcctgggaagccagatattattgcagcctcatacaccgcccttccctactgcttcctgagatttgagagctcgggcgccagatctgaaacctcttgtgttgtgcctttggtagttcggtgtagcattgagctagcagaggtgctgttctagttccaggatgagcaaggaggatgtcctcaaggtgcagacattgatgctgagagtgaacatacactgtgacgggtgcgagaagaaggtcaagaagaccctccacaagatcgacggtgtctaccagagcagcatcgacgcggaacagggcaaggtgacggtgtccggtttgctggatccggataccatcatcaggaaggctcacagggcggcaagcggctcagctgtggggtcccagcccggcatcactcagaacgcctaccatggcggcggcaagccccttccaaagacgctggcngccgcaaaagcctttccaagactcgggagggggaaggggcattcccaaggatgcgggcgccgcaaaggccaaaaggccgttcccggtggccgccttcacaaggccccttgcggtgggcgtggccaaagccc

SEQ ID NO: 69970 - protein, 139 aa, Zea mays
  misc_feature: Ceres CLONE 1548878
  misc_feature (13)..(77): Pfam Name: HMA Pfam Description: Heavy-metal-associated domain
MSKEDVLKVQTLMLRVNIHCDGCEKKVKKTLHKIDGVYQSSIDAEQGKVTVSGLLDPDTIIRKAHRAASGSAVGSQPGITQNAYHGGGKPLPKTLAAAKAFPRLGRGKGHSQGCGRRKGQKAVPGGRLHKAPCGGRGQS

SEQ ID NO: 69971 - DNA, 674 bp, Zea mays
  misc_feature: Ceres CLONE 1548879
  misc_feature: Encodes the peptide sequence at SEQ ID NO. 69972
  misc_feature (582)..(582): n is a, c, t, g, unknown, or other
ctccccgcggtggcggccgctctagactagtggatcccccgggctgcaggaattcgtctcacccctagaaaaaaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctgaggacgtcttccagacggtttccaagtcggggaagaggacctcgtactgggagggcgaagccacggccccggacgctgcggcggctccagaagccgaagcagctcccagcaccgcggcagaagcgcctcctgctgctgctccggcggcgccagagatcaccccagacaaagctgaacgcctgatcgtcacgctattattcactccacatgtggagctgcggnctgcgaactcctaaccttaaatctagaaatagcttgggggaatgagtttgccattgcatcctggttctgccgggtctaagcaggtgactatt

SEQ ID NO: 69972 - protein, 130 aa, Zea mays
  misc_feature: Ceres CLONE 1548879
  misc_feature (7)..(68): Pfam Name: HMA Pfam Description: Heavy-metal-associated domain
  misc_feature: SWISSPROT Homolog: EC 3.6.3.4 Copper-exporting ATPase
  misc_feature (127)..(127): Xaa is any aa, unknown, or other
MAAVETVVLKVAMSCEGCAGAVRRVLSKMEGVETFDIDLKEQKVTVKGNVKPEDVFQTVSKSGKRTSYWEGEATAPDAAAAPEAEAAPSTAAEAPPAAAPAAPEITPDKAERLIVTLLFTPHVELRXANS

SEQ ID NO: 69973 - DNA, 699 bp, Zea mays
  misc_feature: Ceres CLONE 1548885
tcaccgcggtggcggccgctctagaactagtggatcccccgggctgcaggaattcgtctcacccctagaaaaactcctaagcgccgtcgcgatctgctgcggtggccgctgccggcgccgcccatccccaccgcacaccaccgcctccactacgccaccgactccgcctctcgctcccccctcgccgcgccgcccgaacgccacgatgcgtcacctcctcctctcccgctcctccggccgcgggtggtggcagcggcatccccaacggccactaccaccaccgcgccctcctccgcgccctctcctcctcccctccccggtcttctccgacgcagagctccggaagtacgcggggtaacggggggcttcttttctgctgctggggccgtgaccaccccctcggtaccatccccccccgaagggccgcataagaaaggcgggccctttccgggtacccgccggtgccggaaggcctccccgctgtttgccaatgggaagggatcgcaaaagggtaaattcccctttcctggctcctaccgggtattatctccgtgcctcgaagggctctttcccctctcggggcaaagggattatccaaggacttgggggctcccggggcgcgggcgtgctcccacaaggggaacccgtgtcctgccgcattggggggggggaaaccctccacgctcgtgaaaagggggg

SEQ ID NO: 69974 - DNA, 686 bp, Zea mays
  misc_feature: Ceres CLONE 1548906
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (374)..(374): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (532)..(532): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (540)..(540): n is a, c, t, g, unknown, or other
  misc_feature (541)..(541): n is a, c, t, g, unknown, or other
  misc_feature (543)..(543): n is a, c, t, g, unknown, or other
  misc_feature (544)..(544): n is a, c, t, g, unknown, or other
  misc_feature (552)..(552): n is a, c, t, g, unknown, or other
  misc_feature (561)..(561): n is a, c, t, g, unknown, or other
  misc_feature (572)..(572): n is a, c, t, g, unknown, or other
  misc_feature (578)..(578): n is a, c, t, g, unknown, or other
  misc_feature (579)..(579): n is a, c, t, g, unknown, or other
  misc_feature (581)..(581): n is a, c, t, g, unknown, or other
  misc_feature (582)..(582): n is a, c, t, g, unknown, or other
  misc_feature (591)..(591): n is a, c, t, g, unknown, or other
  misc_feature (592)..(592): n is a, c, t, g, unknown, or other
  misc_feature (594)..(594): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (617)..(617): n is a, c, t, g, unknown, or other
  misc_feature (618)..(618): n is a, c, t, g, unknown, or other
  misc_feature (632)..(632): n is a, c, t, g, unknown, or other
  misc_feature (633)..(633): n is a, c, t, g, unknown, or other
  misc_feature (643)..(643): n is a, c, t, g, unknown, or other
  misc_feature (644)..(644): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (683)..(683): n is a, c, t, g, unknown, or other
tggagctccccgcggtggcggccgctctagaactagtggatcccccgggctgcaggaattcgtctcacccctagaaaaagacctggccctggctggctccgcctcctccgttccgtctcatcgctccttcctcgtcagttgttgccaccacccctccctcccatcctctccgcgtcgcccccatcccatcttggcctggacacctgggctgcctcgctccgtttccgcgctcgcggacgcgccgagtcgccggccgaaccagtcgcccgcccgcccgccctccctccctcccgccgctaccagcgtcgatctgcgaccgaagagcgattcaaggcaggtgaggggggggggggggggggggnnnnnnnnnnnnnnnnnnnnnnnnnnnnnnnnnnnnnnnnnnnnnnnnnnnnnnnnnnnngnnnnnnnnnnnnnnnnnnnnnnnnnnnnnnngnnnngnnnnnnnnngnnnnnnnnnnnnnnnnnnnnnnnnnnnngnnnnnnnnnnnnnnnnnnttnnngggnnnngggnggnnnggnngnngggggggnggggggttnggggggggggngggggnngnngggtggggnngngggggggggtgggnnnnggtggnngtggttggttgttnntggtggtttnntgtttgttggtnnngtggggtttggggtgttttttggtnttt

SEQ ID NO: 69975 - DNA, 649 bp, Zea mays
  misc_feature: Ceres CLONE 1548907
  misc_feature: Translation starting site: 187
  misc_feature: SWISSPROT Homolog: EC 4.1.1.35 UDP-glucuronate decarboxylase
  misc_feature: SWISSPROT Homolog: EC 5.1.3.2 UDP-glucose 4-epimerase
  misc_feature (476)..(476): n is a, c, t, g, unknown, or other
ggagctccccgcggtggcggccgctctagaactagtggatcccccgggctgcaggaattcgtctcacccctagaaaaagtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccacttcnttgtggaggttgaccagatctatcaccttgcttgccctgcttcaccaatcttctacaagcacaatcctgttaagaccatcaagacaaatgttattggtaccctgaacatgctgggacttgcaaagagagttggagctaggattttgttgacatcaacatctgaagtttatggg

SEQ ID NO: 69976 - DNA, 636 bp, Zea mays
  misc_feature: Ceres CLONE 1548912
  misc_feature: Encodes the peptide sequence at SEQ ID NO. 69977
  misc_feature (574)..(574): n is a, c, t, g, unknown, or other
  misc_feature (575)..(575): n is a, c, t, g, unknown, or other
  misc_feature (580)..(580): n is a, c, t, g, unknown, or other
agctccccgcggtggcggccgctctagaactagtggatcccccgggctgcaggaattcgtctcacccctagaaaaaagcatctcaagtcttcacactcctcgccatcacataaaaccagtgcaagcagaagcagcgcaatggcgagcagcaccatggccctctcctccacggccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctgggggtcatccactcccgctgggccatgctgggcgcgttgggctgcgtgttcccggagctgctcgcccgcaacggcgtcaagttcggcgaagccgtgtgggtcaaggccgggtcgcagatcttcagcgagggtgggctggactacnntcgcnacccgagcctgatccacgcgcagagcatccctcgcatcttgccttggccagtcgtg

SEQ ID NO: 69977 - protein, 166 aa, Zea mays
  misc_feature: Ceres CLONE 1548912
  misc_feature (64)..(165): Pfam Name: Chloroa_b-bind Pfam Description: Chlorophyll A-B binding protein
  misc_feature (146)..(146): Xaa is any aa, unknown, or other
  misc_feature (148)..(148): Xaa is any aa, unknown, or other
MASSTMALSSTAFAGKAVNVPSSLFGEARVTMRKTAAKAKPAASSGSPWYGPDRVLYLGPLSGAPPSYLTGEFPGDYGWDTAGLSADPETFAKNRELGVIHSRWAMLGALGCVFPELLARNGVKFGEAVWVKAGSQIFSEGGLDYXRXPSLIHAQSIPRILPWPVV

SEQ ID NO: 69978 - DNA, 596 bp, Zea mays
  misc_feature: Ceres CLONE 1548915
  misc_feature: Encodes the peptide sequence at SEQ ID NO. 69979
  misc_feature (596)..(596): n is a, c, t, g, unknown, or other
acccgcggtggcggccgctctagaactagtggatcccccgggctgcaggaattcgtctcacccctagaaaaaaaaaaaaaaacaagaaaaaagggctcatcaaacgtgactgcccacacttcagtcttgtccggttgtcccatcacagctaaagcaaaaccaccacccatcaagctgatcctgatcatcactcttttcccgacacaaagagggcaccaagaatcccctccatcgacgacgaaggcgatggcgccgctgccgcaagccgtccacctcctcctcgccttctccctcgcgcttggctgcctggcgggcggcgccaccgcaacagtggtgacgacttgcagggcggcagcggacagcgacacgcgcgtggactacgcgttctgcgtcgccaagctgggcatgcaccgcgagagccccgacgccaacacctggggcctcgccaaggtggccgcgctgacgggcgtcaacaacgccgacaacgccgtgtacgacatcaaggccctgctcgccaacaagaggcccgacagcccgacgcgcgcggcgctggagaagtgcgggaggctgtaccgctccgtcgtggtcacattcgn

SEQ ID NO: 69979 - protein, 116 aa, Zea mays
  misc_feature: Ceres CLONE 1548915
MAPLPQAVHLLLAFSLALGCLAGGATATVVTTCRAAADSDTRVDYAFCVAKLGMHRESPDANTWGLAKVAALTGVNNADNAVYDIKALLANKRPDSPTRAALEKCGRLYRSVVVTF

SEQ ID NO: 69980 - DNA, 651 bp, Zea mays
  misc_feature: Ceres CLONE 1548916
  misc_feature: SWISSPROT Homolog: EC 1.11.1.11 L-ascorbate peroxidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttccaagctggtactccaccgcggtggcggccgctctagaactagtggatcccccgggctgcaggaattcgtctcacccctagaaaaaaaaaaagacgcaggcaccccagcagctcttgcggtcgtccctcagccgcgtcgcaccgcatcgcattctacgattcgaagctctctgctcgcaggggacatggcgaagaactacccaccgtgagcgccgagtacagcgaggcccgtcaagaagggcagcgcaagctccgcgccctcatcgcccaggaagagctggccacccttcaatgctcgccctcgggtgggactcccccggggaccttccaactgttcttcaaagaaacggggggcccctcccgaaaaattaaaaggccccgggggaaaatggttacaggggcccaaaccggggggttggaaaaacccgggggggggggtttccaagcccccctaaagggagaatttcccccacccccctccttttttggggaattttttttcacattttgtccgaaagagtt

SEQ ID NO: 69981 - DNA, 691 bp, Zea mays
  misc_feature: Ceres CLONE 1548922
  misc_feature (455)..(455): n is a, c, t, g, unknown, or other
tacccgcggtggcggccgctctagaactagtggatcccccgggctgcaggaattcgtctcacccctagaaaaacccccccccccccccccggccatgcgatctgcttaacagagcttctggtcacggttctgttatactacgcgttaacagtgtatgtataaatgtcatcttcctgtaaatctccgtggtgtgaggtgctggcgtgctgctgattccgaagagagtgatgctcctgttatgtgctactagctagctagtgctgttgctgtatgagtacagtgtagtctactactattaagggttgtcgtttggactgttagtctatagagacagaaaaatgtagaagtacgtattaaagccaaaaaaaaaaaaaaaaaccaggacagagagagagagcacgcgggcgcggccccgccgagccgaagcgcctgcctgcaaggctcccctccctccntttcggcttcccccttaaaatgggccccgcccaatttgttgttgggccgccccccccgggttaaaaccccggaagaagggcccgggggtggggggggccccaaaagaaatggggggttcgggggtttaaacggccccggcctttttttttccccccgcgggcctctctttttaaaccccttccaaaatttttaccgccccccttctcttttttgggaaagaaattttttcaggggg

SEQ ID NO: 69982 - DNA, 673 bp, Zea mays
  misc_feature: Ceres CLONE 1548926
  misc_feature: Translation starting site: 120
  misc_feature: Pfam Name: SNF2_N Pfam Description: SNF2 family N-terminal domain
tggagctccccgcggtggcggccgctctagaactagtggatcccccgggctgcaggaattcgtctcacccctagaaaaaatcgcaaaagtctcctccctcccacagccacagtccccccatggctgcgactgcaacctcctacgagcgccgcctgctcgcggcagccgaccttgtcctctccgccgacgcccaggacaaaggaatccgcctcccggacctcggcgtcacggccgacctcaagccgcaccagctccatggcgtcgcctggctcatccgccgctatcgcctcggcgtcaacgtcgtactcgtggtcttatgtcctctaagcgtcacagatgggtggctgtcagaattcagtaaattctgtccttccttcagggtgatgcagtatgtaggtggtaagcttcaccgccgtgaccttcggaggaccatctatgaagatgtacagaaagcttcacatcatctcgatcctttgaattaccatttgatgtgctcatgacaacgtatgacatagccttgatgggatcagatttcctttcccaaatcccctggcactatgcagttattgatgaaggctcaacgtccttaaaatcccatccagtgtactgtataatgtcccttgaacaacgtttcatcctggccaagaactcttactactaacaggccaccctt

SEQ ID NO: 69983 - DNA, 670 bp, Zea mays
  misc_feature: Ceres CLONE 1548928
  misc_feature: Encodes the peptide sequence at SEQ ID NO. 69984
  misc_feature (36)..(36): n is a, c, t, g, unknown, or other
  misc_feature (398)..(398): n is a, c, t, g, unknown, or other
tccccgcggtggcggccgctctagaactagtggatntcttgggctgcaggaattcgtctcactcctagaaaaatcgactagggtttcgcggaccgagagggaagcggggagaggagagggcgggtagggtttccgcgggcgggccccgcatggcctcggcggcagcggcggcggtggcgccggccgcggaggagaagaagggcgcgggcgggccggtcacgggggacatggtcagcgcgggcttcgcggagctggagcggcagcagcggctgctcgccacctgcacgcgcctctaccagcacctgtccgaccacatcggctcgctcgagcgcgggctcgccgcgcgctccgacgcgctccgcgtccgccggaggggattcgacgcgcgcacccaccgngcgctccactcgctccaccgccgggaggcctccatcgacgcctccgtctcgcgcgcgctcgaccacctccactccatcttcggcaaggggtcaccgcccggccccggatcggaccccgccccccggccccggcccggcccaaaggcccggcgccccccctggggcgcccgaagggaccccccccccgttccccggggtttctgggggggccccccccccaggagggccccaacccccctcccggcgggaaatccccccccgcctccccccct

SEQ ID NO: 69984 - protein, 173 aa, Zea mays
  misc_feature: Ceres CLONE 1548928
MASAAAAAVAPAAEEKKGAGGPVTGDMVSAGFAELERQQRLLATCTRLYQHLSDHIGSLERGLAARSDALRVRRRGFDARTHRALHSLHRREASIDASVSRALDHLHSIFGKGSPPGPGSDPAPRPRPGPKARRPPWGARRDPPPVPRGFWGGPPPRRAPTPLPAGNPPPPPP

SEQ ID NO: 69985 - DNA, 630 bp, Zea mays
  misc_feature: Ceres CLONE 1548938
  misc_feature: Encodes the peptide sequence at SEQ ID NO. 69986
  misc_feature (28)..(28): n is a, c, t, g, unknown, or other
  misc_feature (35)..(35): n is a, c, t, g, unknown, or other
  misc_feature (53)..(53): n is a, c, t, g, unknown, or other
  misc_feature (364)..(364): n is a, c, t, g, unknown, or other
ccgctctagaactagtggatctcttggnctgcagnattcgtctcacccctagnaaaatcccctcttccctctctagccttccacccttcatccaccagccgctcctcgagcacccccgtcccgcgccgcctccggctccggcgagatgtcacgcttcggtcgatccggcccgccgccgccgatccgcgacacgtactcactcctcgtcctcaacatcaccttccgcacaactgctgatgacctcttccctctcttcgacaagtacggcgagattgtcgacatctacatcccaagggaccgccggactggtgactcgcgcggattcgcgttcgtgaggtacaagtacgaggacgaggcgcggaangcagttgaaaggctcgatgccacactggtagacgggagggagatcatggtgcagtttgccaagtacggccccaatgctgaacggattaataaagggagaatagtggagcccgttccaagaccaggggggcgttccaggagtcccaggtccaagacggaggtacccgggatgattaatcgagatgaaccttgatagagatttttagaagggccaagtcttaccccggattagaaatagataccccccgtgaacaggatccgggattt

SEQ ID NO: 69986 - protein, 136 aa, Zea mays
  misc_feature: Ceres CLONE 1548938
  misc_feature (19)..(90): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (73)..(73): Xaa is any aa, unknown, or other
MSRFGRSGPPPPIRDTYSLLVLNITFRTTADDLFPLFDKYGEIVDIYIPRDRRTGDSRGFAFVRYKYEDEARXAVERLDATLVDGREIMVQFAKYGPNAERINKGRIVEPVPRPGGRSRSPRSKTEVPGMINRDEP

SEQ ID NO: 69987 - DNA, 726 bp, Zea mays
  misc_feature: Ceres CLONE 1548939
  misc_feature: Encodes the peptide sequence at SEQ ID NO. 69988
gtggcggccgctctagaactagtggatttcttcggctgcaggaatttcgtctcaccctagaaaaaactctctcccttcctctctctccagcgcacaaggatcttttcttcgggcagggacggccaaggaagcgcccgcggagagagatgatgctggcgatcctagcgaggcggcgtgccccggaggccgtgctgcggctgccgcaggcggcggctggggcggccgtgtccgcctggagggcgtacccggcggccggcgaggagattttatttcctggggggggggggccggccccgagggtacttttccggcaatcaaggacgccccactggggcctccatttttttttcccccccccacgggggcaaacgaacagggggccccctcctctctctttcttatcccttcccggccacgggtcctccaccactcctcccgccgttggggcgggggcgcaaccatctcccttttcgccccttctgtgggttcttattttcccccctctccgttgtcccgttccctcccccccctcccgctgcccttctcgtcgttcccgacggttgggggtgggccttgccctcgcccgcccgcctctggttttttctgttgtctttctgcctttcccctctttccgcgccccgtgtctcagctattgcctcttgcccgcctggccctgcctccgttttccgccttcctcccctcctccccccgccgctgccgccctcc

SEQ ID NO: 69988 - protein, 193 aa, Zea mays
  misc_feature: Ceres CLONE 1548939
MMLAILARRRAPEAVLRLPQAAAGAAVSAWRAYPAAGEEILFPGGGGPAPRVLFRQSRTPHWGLHFFFPPPRGQTNRGPPPLSFLSLPGHGSSTTPPAVGAGAQPSPFSPLLWVLIFPPLRCPVPSPPSRCPSRRSRRLGVGLALARPPLVFSVVFLPFPSFRAPCLSYCLLPAWPCLRFPPSSPPPPAAAAL

SEQ ID NO: 69989 - DNA, 690 bp, Zea mays
  misc_feature: Ceres CLONE 1548949
  misc_feature: Translation starting site: 203
  misc_feature (402)..(402): n is a, c, t, g, unknown, or other
  misc_feature (403)..(403): n is a, c, t, g, unknown, or other
tccccgcggtggcggccgctctagactagtggatctcttgggctgcaggaattcgtctcacccctagaaaaaagctgacaaccagacgcgccagggtttcaggcttccacgaatctccccgccgccctcaattcccctcggcgccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctgatcatgcctccacgtgatcaggttgctcgagtggctaatatgttaggtgatgaataggggggggcgggcgacatcaagagtaaagttaatcnnccaccctctgttggctgccatcacctcagctcagcagaggttgaagctctacaacaaagtgcctcctaacggattggttctgtacactggaactattgttactgaaaacggaaaggaaaagaaagttactattggatttggaccctttcaagccctatcaaggtatcccctctaccctttggaacaacaagttcccaccctggaggttttaaaaggagcttccttggaaacctgaaggaaaaggtttggggttcattttttatggaaaggggaaaggggaacccttt

SEQ ID NO: 69990 - DNA, 731 bp, Zea mays
  misc_feature: Ceres CLONE 1548951
  misc_feature: Encodes the peptide sequence at SEQ ID NO. 69991
  misc_feature (317)..(317): n is a, c, t, g, unknown, or other
  misc_feature (320)..(320): n is a, c, t, g, unknown, or other
  misc_feature (408)..(408): n is a, c, t, g, unknown, or other
  misc_feature (421)..(421): n is a, c, t, g, unknown, or other
tccccgcggtggcggccgctctagactagtggatcccccgggctgcaggaattcgtctcacccctagaaaaaataaaatcctcctctcccttatctcttctgcacctgaggccatttcccagcctgaacagtcccgagaaccaaatgaaaatcccatcgcccagagtctcgaatccgaccttgttcattcgtctcgcttcctacttggtcagtcgagatctcccggctccgacggcggcaccagggcaccacaacatacccggccatgacccttttcttcacggggagggggggggtccggaccgataatgaagaanaanaagcccaaccgttcaacgcccccatgtcattttttttcgcccccccgccggggggggggggggggaggtttgtagttcccctaatttngccccccccccanttaagacttttcgtccggcattccgacgaggggttttcgctccgggattcgccctctaaatctaaaagccgcggcggaaaagctgcgccctcgggggggtggcgcgaccgggtggttttggggctattgtcggttgtatggagttttagtcggaaaagcagtgtggggcaccgggctgaaggcgcgaaaagtcggacccctttccatcgtggcgtccggtgctctgcggtgcgcgcgggcagccttctggtggtgtccgtactccggatgcgcgaccgtctgcgcctctgcgcgtgatctccttttcggc

SEQ ID NO: 69991 - protein, 150 aa, Zea mays
  misc_feature: Ceres CLONE 1548951
  misc_feature (18)..(18): Xaa is any aa, unknown, or other
  misc_feature (19)..(19): Xaa is any aa, unknown, or other
  misc_feature (48)..(48): Xaa is any aa, unknown, or other
  misc_feature (52)..(52): Xaa is any aa, unknown, or other
MTLFFTGRGGVRTDNEEXXAQPFNAPMSFFFAPPPGGGGGRFVVPLIXPPPXLRLFVRHSDEGFSLRDSPSKSKSRGGKAAPSGGWRDRVVLGLLSVVWSFSRKSSVGHRAEGAKSRTPFHRGVRCSAVRAGSLLVVSVLRMRDRLRLCA

SEQ ID NO: 69992 - DNA, 730 bp, Zea mays
  misc_feature: Ceres CLONE 1548952
  misc_feature: Encodes the peptide sequence at SEQ ID NO. 69993
  misc_feature (73)..(73): n is a, c, t, g, unknown, or other
  misc_feature (304)..(304): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
ggagctcaccgcggtggcggccgctctagactagtggagtccctgggctgcaggaattcgtctcacccctagnaaaatccatctgctctgctccggtccgttccgctccttcctccccctatctagctagccttcccgttcctgcatcgcggcggagatgggcgcctccaccacgccgctcgcgtcggcggcggcgctgcttctgctgctgctcgcgccgctcgccgcggcggcggacagcatgtcgatcgtctcctaccgcgagcggagcgaggatgaggccccgcggatgtgcgccgagtgnattgcggcccatggccggaccttcacccccgccggcaaggaggacttttttctccccccccccggggggcagcgggggggacctccaacccccaaaatgggccccccccccnnnggggggcccctcctttccgccctcggggtgtgagcgggggtgggccaaccccccccagcggcggatgagccgggccccccttaccctccgggcgccgggggcggtggcctccccgagggcggggcgtgccccccgtgcccccgggcccgttgtgtggcgcactttgcggcggcctttggcggggattcgtgccatctggccgcggcccccgggcggttgccccccccttatttgcctgggtcccccgggccctcttcccccgcgtccgtcgggcgcctcctccccgcgcggccgccggcgttgtggtggggg

SEQ ID NO: 69993 - protein, 97 aa, Zea mays
  misc_feature: Ceres CLONE 1548952
  misc_feature (49)..(49): Xaa is any aa, unknown, or other
  misc_feature (87)..(87): Xaa is any aa, unknown, or other
MGASTTPLASAAALLLLLLAPLAAAADSMSIVSYRERSEDEAPRMCAEXIAAHGRTFTPAGKEDFFLPPPGGQRGGPPTPKMGPPPXGGPLLSALGV

SEQ ID NO: 69994 - DNA, 648 bp, Zea mays
  misc_feature: Ceres CLONE 1548953
  misc_feature: Encodes the peptide sequence at SEQ ID NO. 69995
  misc_feature (352)..(352): n is a, c, t, g, unknown, or other
ctccaccgcggtggcggccgctctagaactagtggatcccccgggctgcaggaattcgtctcacccctagaaaaatcccacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggcgtagatttccggcggccatggggggcgccgtgatggtcgccatcgcggcctctatncgcaacttgctgcagggctgggacaatgcgacaattgctggagccgtcccccacataaagaaggaattcaacctgcagagcgagcctctgatcgagggcctcatcgtcgccatgttcctcaatggggcaaccgtcatcacgacgttctcgggggaaccgcccaactgctttggaagaagcccatggctggtcccctcggtggcccctaattcttcagggggctgggaagcccctggccccaagagggaacctctggcccccccaaaggtcattgaggggttccggaaccgttgggc

SEQ ID NO: 69995 - protein, 111 aa, Zea mays
  misc_feature: Ceres CLONE 1548953
  misc_feature (13)..(13): Xaa is any aa, unknown, or other
MGGAVMVAIAASXRNLLQGWDNATIAGAVPHIKKEFNLQSEPLIEGLIVAMFLNGATVITTFSGEPPNCFGRSPWLVPSVAPNSSGGWEAPGPKREPLAPPKVIEGFRNRW

SEQ ID NO: 69996 - DNA, 729 bp, Zea mays
  misc_feature: Ceres CLONE 1548957
  misc_feature: Encodes the peptide sequence at SEQ ID NO. 69997
  misc_feature (268)..(268): n is a, c, t, g, unknown, or other
  misc_feature (271)..(271): n is a, c, t, g, unknown, or other
  misc_feature (280)..(280): n is a, c, t, g, unknown, or other
tccccgcggtggcggccgctctagaactagtggatcccccgggctgcaggaattcgtctcacccctagaaaaaaggaggactctccgaggtccgagcggggtgggcaggtgtccgaaacggatgtaccaaaccccgccggtgcatccgagagatccgacgtcgccgcgatccatggtcgtctcgacgggggcggagcggtgtctcttcctcgccctcgccgtcctcgccgcctgccacggctcggcgccggaaggggccgtggggttnggntgggtgggngtagggggagctaaggcggcctactgggacgcggccgtggacctcgacgcgtccaacttcaccgccttcctccatacttcggcggagtcctcccccggtccgcaatttcttcgcccttttggtgccctgcgctgggtaaactcccaccccccctttgacaggggttccacaacttttcaatgggccaagaatgttgccctccctgggcccggttgggatggcccccaagttggttggcgcccccaacggcgcaccctggaacccttttcaccacatttctttgggtgaccctttatcccctcccctgctggcggcgctccccccaaccaaacttcccatttaccccccaaccggaaaccccaaagcctgaataatgcgttcactttgccactcttcttcctctgctccccctaaaccctcctaacctgggttttcctcaacgtgtgttg

SEQ ID NO: 69997 - protein, 131 aa, Zea mays
  misc_feature: Ceres CLONE 1548957
  misc_feature (32)..(32): Xaa is any aa, unknown, or other
MVVSTGAERCLFLALAVLAACHGSAPEGAVGXGWVGVGGAKAAYWDAAVDLDASNFTAFLHTSAESSPGPQFLRPFGALRWVNSHPPFDRGSTTFQWAKNVALPGPGWDGPQVGWRPQRRTLEPFSPHFFG

SEQ ID NO: 69998 - DNA, 505 bp, Zea mays
  misc_feature: Ceres CLONE 1548962
  misc_feature (196)..(196): n is a, c, t, g, unknown, or other
  misc_feature (198)..(198): n is a, c, t, g, unknown, or other
  misc_feature (199)..(199): n is a, c, t, g, unknown, or other
aagctggagctcaccgcggtggcggccgctctagaactagtggatcccccgggctgcaggaattcgtctcacccctagaaaaacagcgcccgcgcagggctcgcttgcaagcgcaaagcagccacagcaccccctgcactgcagactgcacgcatgtcgctctcggacgctctccggcgcgctgcggtgtctcggncnntctcgctcggcgcggggcgccccagccccccgaatcgcggggccccttccaccttcccccttgggaacgttaaggtgggcggccccccgtgccccaatccccccaaattttttgggggccttaattttcccccgggggtttctttcttccccgggggtgtttcttctcttttttttttacccccccggggaagaaaacaatttgtgtagccccccccccccaaaaccccttatgatttttctggggggggggcccaaaacctggggggggttctccccgagaaaaaaaaacccccccgcccgcttc

SEQ ID NO: 69999 - DNA, 717 bp, Zea mays
  misc_feature: Ceres CLONE 1548967
  misc_feature: Encodes the peptide sequence at SEQ ID NO. 70000
  misc_feature (26)..(26): n is a, c, t, g, unknown, or other
  misc_feature (171)..(171): n is a, c, t, g, unknown, or other
  misc_feature (216)..(216): n is a, c, t, g, unknown, or other
  misc_feature (385)..(385): n is a, c, t, g, unknown, or other
  misc_feature (386)..(386): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (392)..(392): n is a, c, t, g, unknown, or other
  misc_feature (399)..(399): n is a, c, t, g, unknown, or other
  misc_feature (400)..(400): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (414)..(414): n is a, c, t, g, unknown, or other
tggcggccgctctagactagtggatntcttcggctgcaggaatacgtctcaccctagggagccggagtctggccccacctccatccagatccacccgtcactccgtcagccccgccgcgcgcaccatggatcccccgccgcggcggctagccgccccgctcctcctcctgntcctcgcagcggcctcccccgccgcgcgcgcgtggaaaaaagacnagttccccaactgcaaccagacgcccttctgcaagcgcgctcgatttttcccccccgaagggggggggaggagccgtttctccttttttttttagatagattcccccgtccccccccgaaagtttttttttttcccccccccccccgggggaaaaagaaaaagggggtnntnnntnttttttnntnnnnnnnnnnttntggtggtgggggccagagaaaagacccccccccgccccccggtgtgggggggggggtgggggagtcttccatccgtttccctttcgcagtattgtaccgctcggggtgtccaaatgtcctccctattttttttctcgctgccggcggagactgtgcgggggctttgcgttggttctctattggttgctcacggaaggcacgggatggccccgcgtgtagtgttctggttccccccttgtccctctcgccgggtctgttagggcgggggaaccccttgtgctgtgcttccgaggtagtttcgcg

SEQ ID NO: 70000 - protein, 61 aa, Zea mays
  misc_feature: Ceres CLONE 1548967
  misc_feature (16)..(16): Xaa is any aa, unknown, or other
  misc_feature (31)..(31): Xaa is any aa, unknown, or other
MDPPPRRLAAPLLLLXLAAASPAARAWKKDXFPNCNQTPFCKRARFFPPEGGGRSRFSFFF

SEQ ID NO: 70001 - DNA, 406 bp, Zea mays
  misc_feature: Ceres CLONE 1548968
  misc_feature (324)..(324): n is a, c, t, g, unknown, or other
  misc_feature (331)..(331): n is a, c, t, g, unknown, or other
  misc_feature (378)..(378): n is a, c, t, g, unknown, or other
aagctggagctcaccgcggtggcggccgctctagaactagtgggaatcccccgggctgcaggaattcgtctcacccctagaaaaaacactcgcttgagcatcgtgtgctcttctcttcctcttccagttgggtattctttatctgaaagactgaaacatagtacagaggaggagaggagagcgagagctaagaagatgaaccggcaaggtcctgcttgtggccgtcctcttggtgggcgtggcctctcgatgctcggcagtagggcctgcagggcgatcacgttgctgaacagaaagttcggtggcggtggctatggaaggttngggcccncgcccttggttgtttaccccgggggagagggccctttcccccccggngtggggggaggccgccccggttttttga

SEQ ID NO: 70002 - DNA, 511 bp, Zea mays
  misc_feature: Ceres CLONE 1548971
  misc_feature: SWISSPROT Homolog: EC 2.3.1.41 Beta-ketoacyl-acyl-carrier-protein synthase I
  misc_feature (269)..(269): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (329)..(329): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (351)..(351): n is a, c, t, g, unknown, or other
  misc_feature (392)..(392): n is a, c, t, g, unknown, or other
  misc_feature (412)..(412): n is a, c, t, g, unknown, or other
  misc_feature (420)..(420): n is a, c, t, g, unknown, or other
ggagctcaccgcggtggcggccgctctagaactagtggatcccccgggctgcaggaattcgtctcacccctagaaaaacatatgctataacaaacaatgggttctgccctgcttggaatggatattggtttcatgggtccaaactactccatctcaactgcctgtgctacctcgaactactgtttctatgctgcagcaaaccatatccgtaagaggcgaagcggatataatgatagctgggaggcacttgaagctgcaattatccattngtgtnnngtgctttgtgcatgtgagcactgtcacagaagaatgatgaccctaaannnnangnnnnnntttcccnnnnggggncccccttttttgggggaaaaaacaaagggaaatccccttgnaaagtgggggtttttttttngtccccanttgggggtttaaagagaaccttgagattccttgttccttggaaaaaaccctaaaaccatgccaatttaaaaccttgatgccccccaataat

SEQ ID NO: 70003 - DNA, 687 bp, Zea mays
  misc_feature: Ceres CLONE 1548975
  misc_feature: Encodes the peptide sequence at SEQ ID NO. 70004
  misc_feature (35)..(35): n is a, c, t, g, unknown, or other
  misc_feature (42)..(42): n is a, c, t, g, unknown, or other
  misc_feature (68)..(68): n is a, c, t, g, unknown, or other
  misc_feature (303)..(303): n is a, c, t, g, unknown, or other
  misc_feature (573)..(573): n is a, c, t, g, unknown, or other
  misc_feature (606)..(606): n is a, c, t, g, unknown, or other
tcaccgcggtggcggccgctctagactagtggatntcttggnctgcaaggatttcgtctcaccctagngaaactgccgtctcttcctcctccctctgcacccccacgagctccatggccgccaccgccatgattgggattaccaacctacgttgccgccacgacccgctctcctcccttccccgggctacgtcgtcggccgcccggtcctgtacgctgcttcctcctcgatgccgccgccattcttcttgctgctccccttcctcctccgtctctccgcgccgggcccgggtccgaccaacancagcactgaagcgcatccctgcccccgacaccggcttcctgggtctcgctcaccctgaggggggggggggggggggatcttcgtcgggccaccttccccccccccctatcgtcccccagctcccccgctgggcacgggacccgccccccatgcttcccccggggggccgcgccccatttccgggggtgggggaaccgccccctggtcgctggggccatccggccccccatggacaagttccctccagggggccttttggcgcccgccccncccgagcggccccccaggggcctttttccgggnggtttccggggcgcctccccgggcggcccggagtccttccccgcctgctgggggccccgccctccccgcagggcccttctc

SEQ ID NO: 70004 - protein, 52 aa, Zea mays
  misc_feature: Ceres CLONE 1548975
MDKFPPGGLLAPAPPERPPRGLFPGGFRGASPGGPESFPACWGPRPPRRALL

SEQ ID NO: 70005 - DNA, 658 bp, Zea mays
  misc_feature: Ceres CLONE 1548980
  misc_feature: Encodes the peptide sequence at SEQ ID NO. 70006
  misc_feature (333)..(333): n is a, c, t, g, unknown, or other
ctccccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacggggccagccttcgcgaanttgtccaggagtgctacgaggtgtcggcccgactatgagggcaaaagagacacgacgaaactgggcaaactccgcgccaagctcacggggcttggcccccgccgaccgccatcttcgggccgaagctcatcctggaaatgctcaacctccccaacccgggccgaaggaggggcaaaacccccccacgcccccccaaaagaaaggtcaaaaaagggggggtccccccaacaaaggccccccccccccccgggagcccgaactccggggaaacccctccaggccccccttgtgcccaaggggcgggaaaaaccccccccagagggag

SEQ ID NO: 70006 - protein, 71 aa, Zea mays
  misc_feature: Ceres CLONE 1548980
  misc_feature: SWISSPROT Homolog: EC 4.1.1.31 Phosphoenolpyruvate carboxylase
  misc_feature (60)..(60): Xaa is any aa, unknown, or other
MASTKAPGPGEKHHSIDAQLRQLVPGKVSEDDKLIEYDALLVDRFLNILQDLHGASLREXVQECYEVSARL

SEQ ID NO: 70007 - DNA, 696 bp, Zea mays
  misc_feature: Ceres CLONE 1548982
  misc_feature: Encodes the peptide sequence at SEQ ID NO. 70008
  misc_feature (355)..(355): n is a, c, t, g, unknown, or other
  misc_feature (660)..(660): n is a, c, t, g, unknown, or other
gggagctccccgcggtggcggccgctctagaactagtggatcccccgggctgcaggaattcgtctcacccctagaaaaactggaagtagaagttttggggcacctcgttcaaatactggtgggcctattggtggccaccttgctcatcaacagaattcccagcaagctatgggtggcattgggtcaaattttaactacgctggcatggagaattcgagtagtcagccttctggtgtagcccaaatgtcccaatcgggattaatgacacaggacttcattgtagatgattttaagagccaaggatcacatgtgccatacaacattgcagaattttctacccaggcttctcaaggtnggttatggtgttgagtttactcaagcgccccaatctggatactctgggaattatatgaaccaaaacacacatcctggatactcccatattggtacaacaaatgacattgtatctcaggatcacatggcccatggatctcacggaatgtttacgcaagtggggtataatgatccgtcgcaagatgagtcatctcagattcattatggaatggctgctgctggtcccctacattcgcagagcatgatgaaccccttatactctcaatcctatgctcactacaacacccagccacattctcttcaccntccctcccagtgataattaaggcttgtgatatggtg

SEQ ID NO: 70008 - protein, 66 aa, Zea mays
  misc_feature: Ceres CLONE 1548982
  misc_feature (63)..(63): Xaa is any aa, unknown, or other
MGGIGSNFNYAGMENSSSQPSGVAQMSQSGLMTQDFIVDDFKSQGSHVPYNIAEFSTQASQGXLWC

SEQ ID NO: 70009 - DNA, 653 bp, Zea mays
  misc_feature: Ceres CLONE 1548985
  misc_feature: Encodes the peptide sequence at SEQ ID NO. 70010
  misc_feature (566)..(566): n is a, c, t, g, unknown, or other
  misc_feature (639)..(639): n is a, c, t, g, unknown, or other
  misc_feature (653)..(653): n is a, c, t, g, unknown, or other
ctccccgcggtggcggccgctctagaactagtggatcccccgggctgcaggaattcgtctcacccctagaaaaaatcaggcatccaagcttaaagcaagcagatctaagctccaggcagcgtcgcgacagagtgagtgagtagcacgacaacaacaatggcttccctgaaggccgcgaagcccagcggagttgcggcgcagggcaaggagccggcgcccaagctcagcgagacggcgacgaagccgtcagccgcgaagagcggcggcgttaagaaggctgagcagaagccccgggaaaccaaaaggaaggtgaagagcagcaaaccggcggcggcggccaaaaagtgacgtacagtacgtgtggagtgtaatggagcttccatgcatgcatgagtgaatccatgccatgttatgaatctagtccttcctttcttgtatcttccatgtgacgcggcgtgtgcgtcccctcatgtgtgatgatgccagatgaatactacaaataagacgttgttgtgactgtgtgccagaaaaaaaaaaaaaaaacgagacgctcgaggtaccaattncgcctatagtgagtcgtattacgcgcgctcactggccgtcgttttacaacgtcgtgactgggaaaaccctggncgtaccaaacttan

SEQ ID NO: 70010 - protein, 63 aa, Zea mays; identical to SEQ ID NO: 8705
  misc_feature: Ceres CLONE 1548985

SEQ ID NO: 70011 - DNA, 580 bp, Zea mays
  misc_feature: Ceres CLONE 1548991
  misc_feature (250)..(250): n is a, c, t, g, unknown, or other
  misc_feature (251)..(251): n is a, c, t, g, unknown, or other
  misc_feature (257)..(257): n is a, c, t, g, unknown, or other
  misc_feature (278)..(278): n is a, c, t, g, unknown, or other
  misc_feature (279)..(279): n is a, c, t, g, unknown, or other
  misc_feature (299)..(299): n is a, c, t, g, unknown, or other
agctccccgcggtggcggccgctctagaactagtggatcccccgggctgcaggaattcgtctcacccctagaaaaaaactcccatcccagatcaggattagccgaccacccgccgaaggccagagagaaatatctcatcttctctccaccggatcggttcaatcgagagcgagggagaaagggaggtggtgcgtcgaggggggccgagattttgccggtttggagcccaatagggtatgagctgcttcgnngcacgncgccgctccgaagtcgcccgnncgcaggacggcctcctcgtnctcgtcttctcctctcgattccatacgtaccagtagttttattttagtagtagtaattgagtagccatcccttgtaactgcgccggctttgccgggtccgggtccttttgggccttcctcgcccctcttccctaaaccctcccttattctttccctcccacggcaaaccgggggttgggattggattcccaaggcccccaaattggagggcttttggctcccacctatcaaaggggggggcacgcccccccccccccccctatttgcaccggcgggggggt

SEQ ID NO: 70012 - DNA, 666 bp, Zea mays
  misc_feature: Ceres CLONE 1548993
  misc_feature: Encodes the peptide sequence at SEQ ID NO. 70013
ctccccgcggtggcggccgctctagaactagtggatcccccgggctgcaggaattcgtctcacccctagaaaaactccactacacacaaacacacaatggcaccagaaaggatgctcctcggcgtctgtgccgtgctgatggtggtcggcgtcacgaacgcggcggagggccaggtggcgtcggtcgtcgtgggcctggcgaggtgcgccgacagcacgaggaagaacatgaaggctgaggccggtttcaagggtcttcaggtggcgatcaagtgcaagaacagcaacggcgagtacgagacaaaggccgtgagtgagatccaaagctccggagccttcagcgtcccactcgccgccgacctccacggcgccgactgccacgcgcagctccacagcgccgccaataacgcgccttgccctgtgcaggagccgtccaggatcgcgcccatgtcaggcggcaccttcgtcgccgtgcctggcagatgcactacccgtccgcggagtgcgcgtccgcgtttctctgctcccgatcaagagcacttgttagatcacttccacaggcacccctgccagtgcggagtaccacccggtgctgaccacagcagctgcggtgccgagtaccaccggtgctgagcctacagccgcggcggattaccacctcccagc

SEQ ID NO: 70013 - protein, 178 aa, Zea mays
  misc_feature: Ceres CLONE 1548993
  misc_feature (31)..(164): Pfam Name: DUF1210 Pfam Description: Protein of unknown function (DUF1210)
MAPERMLLGVCAVLMVVGVTNAAEGQVASVVVGLARCADSTRKNMKAEAGFKGLQVAIKCKNSNGEYETKAVSEIQSSGAFSVPLAADLHGADCHAQLHSAANNAPCPVQEPSRIAPMSGGTFVAVPGRCTTRPRSARPRFSAPDQEHLLDHFHRHPCQCGVPPGADHSSCGAEYHRC

SEQ ID NO: 70014 - DNA, 678 bp, Zea mays
  misc_feature: Ceres CLONE 1548995
  misc_feature: Encodes the peptide sequence at SEQ ID NO. 70015
  misc_feature (523)..(523): n is a, c, t, g, unknown, or other
  misc_feature (572)..(572): n is a, c, t, g, unknown, or other
  misc_feature (622)..(622): n is a, c, t, g, unknown, or other
ctccccgcggtggcggccgctctagaactagtggatcccccgggctgcaggaattcgtctcacccctagaaaaaggcctcgcaggcttcgcaaggcggccacacgccgatacctcctccttcacccgctccgtcgtcccccacagccggccacgccaccatgctgccaccggccgcgcgccttgcggcccgccgcctcctcggcctcgcctccgcatctgcgtcggaagccgccggccgccgggtagcttcctctccgatcgcttccgcaggctactccgccgccgcgtccaggggctccgtctccagcaccaggcccttctccacggctcttaactaccaccttgattccccggagaacaagccggacatgaaatgggagttctcacaggcgaatatgaagaaggtcaatgagattctgtctcactatccaagcaactacaagcaatctggtattattccgctgcttgatcttgcacagcagcagcatggtggatgggtgccagttgcagcaatggatgctnatgctaaaatcgtcgaagtgcaccaatcagggtttatgaaagtgcaccnttttataccatgtttaacaggactaaggttggtaaataccaccttctggntgtgtggaactacaccctggatgattccgtgtttcacgtgaatccaagaagacgtt

SEQ ID NO: 70015 - protein, 97 aa, Zea mays
  misc_feature: Ceres CLONE 1548995
  misc_feature: SWISSPROT Homolog: EC 1.6.99.5 NADH dehydrogenase (quinone)
  misc_feature (52)..(52): Xaa is any aa, unknown, or other
  misc_feature (68)..(68): Xaa is any aa, unknown, or other
  misc_feature (85)..(85): Xaa is any aa, unknown, or other
MKWEFSQANMKKVNEILSHYPSNYKQSGIIPLLDLAQQQHGGWVPVAAMDAXAKIVEVHQSGFMKVHXFIPCLTGLRLVNTTFWXCGTTPWMIPCFT

SEQ ID NO: 70016 - DNA, 571 bp, Zea mays
  misc_feature: Ceres CLONE 1548997
  misc_feature (306)..(306): n is a, c, t, g, unknown, or other
ggagctccccgcggtggcggccgctctagaactagtggatcccccgggctgcaggaattcgtctcacccctagaaaaaaccgcccccgatcaccattcctcctccggatttcgcagtcagcggtggtgaaggtagcgggcgcggaggaagatggggctcgcgttcgggaagctcttcagccggctcttcgccaagaaggagatgcggattcttatggtcggtctcgacccgcggtaaaccaccatctctacagctcagctcggcgagatcgtcacacatcccaccatcggttcaatgttgaactgntgagtacaagacatagcttcacgtctgggaatgtcggggtcaagacagatcaaactctcttggaggcatacttccaaacaaacagggtctatctttgttgggaaaccattgaccctgaccttgttgtaaaaccaaaaataactgcccaggtgcctaaccaggatgaactacgagagccgggctgttgtttttcccaaaaaaaaaatttcccaagcccaaagggcgccaaaaacccaaaacttggattaattccctggggagaaac

SEQ ID NO: 70017 - DNA, 680 bp, Zea mays
  misc_feature: Ceres CLONE 1548999
  misc_feature: Encodes the peptide sequence at SEQ ID NO. 70018
aagctggagctccccgcggtggcggccgctctagaactagtggatcccccgggctgcaggaattcgtctcacccctagaaaatctcgtgtgtctggaaaccctagccgccatatctcacgatccactcgagcaccaagccgagggaaggtgaggagcgatggcgcgcggcgtggtgtcggctaagggcggcgcggtcgcgggcaagaagaaggggtcggtttccttcacgatcgactgcaccaagccagtggaggacaagatcatggaggtcgcctcgctcgagaagttcctgcgagagcgcatcaaggtcgccggcggcaaggctggcaacctcggcgactccgtcaccatctctcgcgagaagaccaatgtcaccgtcacctctgacggacccttctcaagaggtacctgaagtacttgacccagcagtacttcgagatgcacaacgtgcgggattggctacgcgtagttgctgctaacaaggaaccgaaacgggctatgagctccgctacttcaacttggcttaaacgagggccaggaagacattcaaatgcactcccttaaatttagcatgactcgtgcattttgaacctgtccggagtttccaaagtccctgtatgtgggggagggaaattgaaaacctttttttggatcttcaaaagggttttggaaggaagga

SEQ ID NO: 70018 - protein, 84 aa, Zea mays
  misc_feature: Ceres CLONE 1548999
  misc_feature (16)..(84): Pfam Name: Ribosomal_L22e Pfam Description: Ribosomal L22e protein family
MARGVVSAKGGAVAGKKKGSVSFTIDCTKPVEDKIMEVASLEKFLRERIKVAGGKAGNLGDSVTISREKTNVTVTSDGPFSRGT

SEQ ID NO: 70019 - DNA, 742 bp, Zea mays
  misc_feature: Ceres CLONE 1549004
  misc_feature: Encodes the peptide sequence at SEQ ID NO. 70020
  misc_feature (389)..(389): n is a, c, t, g, unknown, or other
  misc_feature (404)..(404): n is a, c, t, g, unknown, or other
  misc_feature (412)..(412): n is a, c, t, g, unknown, or other
  misc_feature (454)..(454): n is a, c, t, g, unknown, or other
  misc_feature (470)..(470): n is a, c, t, g, unknown, or other
  misc_feature (701)..(701): n is a, c, t, g, unknown, or other
  misc_feature (723)..(723): n is a, c, t, g, unknown, or other
  misc_feature (724)..(724): n is a, c, t, g, unknown, or other
  misc_feature (727)..(727): n is a, c, t, g, unknown, or other
  misc_feature (728)..(728): n is a, c, t, g, unknown, or other
  misc_feature (729)..(729): n is a, c, t, g, unknown, or other
ggagctccccgcggtggcggccgctctagaactagtggatcccccgggctgcaggaattcgtctcacccctagaaaaattccccgtttgccttgtttaccattcctccccaaaacacatcctgcgatcctcgaagcctccgccgagcatcgatcatgtcggcctactgcggcaagtacgcggatgagctcatcaagaatgctgcctacatcggcacccctggcaagggtatccttgctgctgatgagtcaactggcaccattggcaagcgcctttccagcatcaatgtcgagaacgtggaggagaaccggcgggctctccgtgagctcctgttctgctgccctggtgccctcagtacatcagcggtgtgatccctctcgaggagacccntctacagaagaccanggatggcnagcctttttgtcgatgtccctcaggagggaggcgtcctcccntggcatcaggtcgacnagggcaccattttgaggttgttgggcaccgacaggaagaccaacacccagggcccagatgacctcgggcaagcgcttgcctaagtactacgaaggcccggtcccggctttgcccagtgggcggggcttttcccaaaattggccccaaaggagccggccaaattttccattgccccgaatagccccggttttgggtccataacccaatttttgcaaagaaaaaggtcggggnttggcgccccccattttgtttnntgnnnaacaccccccaaa

SEQ ID NO: 70020 - protein, 71 aa, Zea mays; identical to SEQ ID NO: 17972
  misc_feature: Ceres CLONE 1549004
  misc_feature: SWISSPROT Homolog: EC 4.1.2.13 Fructose-bisphosphate aldolase

SEQ ID NO: 70021 - DNA, 676 bp, Zea mays
  misc_feature: Ceres CLONE 1549005
  misc_feature: Encodes the peptide sequence at SEQ ID NO. 70022
tggagctccccgcggtggcggccgctctagaactagtggatcccccgggctgcaggaattcgtctcacccctagaaaaatgaaggtttggtgacgtcacgcatgtcaagcagcttgtatcttgtatttgaatacatggagcatgaccttgcaggccttgcagctaccccaggcttaaaattctcagaacctcaggtcaagtgttacatgcaacagctactctctggacttgaccattgtcataaccgtggtgttttgcatcgggatataaagggtgcaaatctcctacttgacaataatggcattcttaaaatagcagattttggtctagctacattctttaatcccaaccaaaaacaacatttgacaagtcgcgtagtaacattgtggtaccggcctcctgagcttttgttgggttctactaactatggtgctgctgttgatctatggagtgccggtttgcattctgctgagttgctgtcagggaagcctatcatgccaggacgaactgaggtggaacagttacacaagatttttaagctttgtgggtcaccatcagaggagttttgggctaatctgaagttatcccgagcctacctattcagcctcagcatccgtaccgccgatgtggaatgatgtaataaggacttccccaccactggcttaaacacttcgga

SEQ ID NO: 70022 - protein, 177 aa, Zea mays
  misc_feature: Ceres CLONE 1549005
  misc_feature (2)..(169): Pfam Name: Pkinase Pfam Description: Protein kinase domain
  misc_feature: SWISSPROT Homolog: EC 2.7.11.1 Non-specific serine/threonine protein kinase
MSSSLYLVFEYMEHDLAGLAATPGLKFSEPQVKCYMQQLLSGLDHCHNRGVLHRDIKGANLLLDNNGILKIADFGLATFFNPNQKQHLTSRVVTLWYRPPELLLGSTNYGAAVDLWSAGLHSAELLSGKPIMPGRTEVEQLHKIFKLCGSPSEEFWANLKLSRAYLFSLSIRTADVE

SEQ ID NO: 70023 - DNA, 663 bp, Zea mays
  misc_feature: Ceres CLONE 1549010
  misc_feature: Encodes the peptide sequence at SEQ ID NO. 70024
gcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctgggtgccccgcgccaagctgggcagcctcagccgcgacgagctgtggcccagggtgtggggggaggccacctacgacctcgcaccgtgctcgctttcctcgcggccctgcctttaccatcttccggctaataatggtccggcccgggcccgggtacctcaacgacttccatggctacaagcgggccaaaagctaagggggtccaggggggaattcatccccctggcccccaatccgggaaattcaacaagaaaacctggcgttcccttc

SEQ ID NO: 70024 - protein, 114 aa, Zea mays
  misc_feature: Ceres CLONE 1549010
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLGAPRQAGQPQPRRAVAQGVGGGHLRPRTVLAFLAALPLPSSG

SEQ ID NO: 70025 - DNA, 723 bp, Zea mays
  misc_feature: Ceres CLONE 1549017
  misc_feature: Encodes the peptide sequence at SEQ ID NO. 70026
  misc_feature (519)..(519): n is a, c, t, g, unknown, or other
ggagctcaccgcggtggcggccgctctagaactagtggatcccccgggctgcaggaattcgtctcacccctagaaaaaaaaagcgaaagccgaaatcccattccccttccccctcttcgtctccgtcggcggcgtcggaccgaacccgagcccggagccctaactaaccctaggaggcaggcggcggcggggatggtgtactacgcgctgttggtgggcgcggagctggatggcctcaccaacctgcagccccgccacggctgcgacgaccccaacttcccctactacctcaagctcaagtgcgagaactgcggggaggtcaccgccaagtccacctacgtcaccctcagcgagcaagtcgacctgcccaaaggacacggcgccgctcacctcgtccagaagtgcaagctttgtgggagagatggaaacattgtgatgattcctggtcaggggacaccacttactattgagcagagccagaaagaggagaagactttgttgatggtgtttgactgcagnagctatgaacctgttgagttttcctttggcactggctggaaggctgaatctgtgcatgggactccttttgaaattgactgcctcgaagggagattttccggattttgatgagaagggaaatgccccccttgactaggcgagttgggttcaactttaaaagtggtaaaaacttgaaagggggggaaacactaatttttcttaaat

SEQ ID NO: 70026 - protein, 144 aa, Zea mays
  misc_feature: Ceres CLONE 1549017
  misc_feature (1)..(145): Pfam Name: DUF866 Pfam Description: Eukaryotic protein of unknown function (DUF866)
  misc_feature (109)..(109): Xaa is any aa, unknown, or other
MVYYALLVGAELDGLTNLQPRHGCDDPNFPYYLKLKCENCGEVTAKSTYVTLSEQVDLPKGHGAAHLVQKCKLCGRDGNIVMIPGQGTPLTIEQSQKEEKTLLMVFDCXSYEPVEFSFGTGWKAESVHGTPFEIDCLEGRFSGF

SEQ ID NO: 70027 - DNA, 671 bp, Zea mays
  misc_feature: Ceres CLONE 1549019
  misc_feature: Encodes the peptide sequence at SEQ ID NO. 70028
  misc_feature (364)..(364): n is a, c, t, g, unknown, or other
  misc_feature (406)..(406): n is a, c, t, g, unknown, or other
  misc_feature (421)..(421): n is a, c, t, g, unknown, or other
  misc_feature (422)..(422): n is a, c, t, g, unknown, or other
  misc_feature (489)..(489): n is a, c, t, g, unknown, or other
ctccccgcggtggcggccgctctagaactagtggatcccccgggctgcaggaattcgtctcacccctagaaaaaagccgcccattgccggcattgctcgcagcgctagcttcttgcgctcatcagtcgtctccgaccaagatcagcaaggacggcatggctctcgaagcagcgtacgactacccctgcacgtcgccgtcgtccagtgcacgcccacacaagcagcagcagtcctcggcgtcctcctcctcctcgccatccggctagccgcggcggcgaggagctcgtccgcgacgtcccccaaatggaagcagcacaggctgccgccgacgcctccggggaagctccccatcatcgggcacctnccactcatcggctccccaccgcacgtctccttccgcgacctnccacgcaagtacggnncacacgggctgatgctggtgcaggtcggcgccgtgcccaccatcgtggtgtccacgccgcaagccgncaagggcgtgctccgaacgcacgaacacctgctggcttcccgcccgcggaaccccggtcgccaaattattccgttacaactcgaaggatggggccttccgcccctaaggggaataactggcgcacagggccgaaaaggtgggaaaaaaaccacctggttcagggccaaaaagtggtttttct

SEQ ID NO: 70028 - protein, 79 aa, Zea mays
  misc_feature: Ceres CLONE 1549019
  misc_feature: SWISSPROT Homolog: EC 1.14.13.68 4-hydroxyphenylacetaldehyde oxime monooxygenase
  misc_feature (19)..(19): Xaa is any aa, unknown, or other
MLVQVGAVPTIVVSTPQAXKGVLRTHEHLLASRPRNPGRQIIPLQLEGWGLPPLRGITGAQGRKGGKKTTWFRAKKWFF

SEQ ID NO: 70029 - DNA, 696 bp, Zea mays
  misc_feature: Ceres CLONE 1549021
  misc_feature: Encodes the peptide sequence at SEQ ID NO. 70030
aaagctggagctccccgcggtggcggccgctctagaactagtggatcccccgggctgcaggaattcgtctcacccctagaaaaaatcgctctctccggacgcggttgcttgcccgttcctctgatccgcattctagccccatccccgctaccagatccgactagctctctatccagcatcccgcgggaccgagcaccggggggctcgcgcgagagagaagatgaaggccaggacactccatcaacatcctcctatggacgctggccctggctgacctggagattctagtgggcgggacgattacgatcgtgctcccggcgtggacatggacagcctggataaagacgtaccacggagaagatctgacaacaagggcgtgggagtgctcggacgagctatctctcgctgctacgacaccactcacctcacttcttcaacgcgtcccgcttcgacgacctctacgacgagatcaacgaccccggcgagctcgccgacaggatcaggaacatacgacttcttcatcaacgccacgaccctcttccagcccccagggttctgcatcaccggcagcaagcacatacacatgatggagctctgcgacttcctcctgcacgtcgacaccaagacttcatgagaagtacggcgtggccaccagagggaacgacgcatgggagctgtgctacctccacgagatgc

SEQ ID NO: 70030 - protein, 102 aa, Zea mays
  misc_feature: Ceres CLONE 1549021
MDSLDKDVPRRRSDNKGVGVLGRAISRCYDTTHLTSSTRPASTTSTTRSTTPASSPTGSGTYDFFINATTLFQPPGFCITGSKHIHMMELCDFLLHVDTKTS

SEQ ID NO: 70031 - DNA, 719 bp, Zea mays
  misc_feature: Ceres CLONE 1549024
  misc_feature: Encodes the peptide sequence at SEQ ID NO. 70032
ctcaccgcggtggcggccgctctagaactagtggatcccccgggctgcaggaattcgtctcacccctagaaaaaaagctcttcctcggaccctttaatgcactacggaccaccaccaccaccccaccgcgcgcgcgtgtgctcgcctcacttcgcttggcccggctgtctccacgccacgctgcccacaatcccctttcccctccagtaggtagagtggcgagaaggatggtggccgtgtccacggcgacgatggcgagctcgctgctcctccggccgcgcgcgctcctgccaccccatccgattcctagctccagccgccggccattgccagctccgcgtgtacaactacaggggagcatccaggagaagccgggccttccggcgaaaagcgacggcgagcggaggcggccggctgggacgcggctctactcgctggcgccctaccctctgctgctggccgcgctgctgccgggagctgagccggtgacggccgtgttcgcgccgttcgtggagctggtgaagacgtgggacctccccggctggctcgtgcactggggccacccgggtaacatggctgtggtgctcttcgcaatgggtggttacgggacatacctgggcttcaggatcaaactatcagacgaccttgaagagaaggccaaggccaaagatctccacccgaaactccctcgcgggatgttctttttcttcgccctgggc

SEQ ID NO: 70032 - protein, 164 aa, Zea mays
  misc_feature: Ceres CLONE 1549024
MVAVSTATMASSLLLRPRALLPPHPIPSSSRRPLPAPRVQLQGSIQEKPGLPAKSDGERRRPAGTRLYSLAPYPLLLAALLPGAEPVTAVFAPFVELVKTWDLPGWLVHWGHPGNMAVVLFAMGGYGTYLGFRIKLSDDLEEKAKAKDLHPKLPRGMFFFFALG

SEQ ID NO: 70033 - DNA, 697 bp, Zea mays
  misc_feature: Ceres CLONE 1549025
  misc_feature: Encodes the peptide sequence at SEQ ID NO. 70034
ggcgggcgctctgcaactaatggatccgccgggctgcagggatgcatgtcatccctacaaaaactagaaagaggcgcgggcactcgccactctcacgtctcgcccatcccgccactgctgctctccagagtccacgcgacccaggctgcgcggtcgctcgctcctgttagtcccgagcgccgccagccatggcatcgaaaggaatcgccccaagagatgtatgtgttgttggcgttgcacgcacccctttgggtggtttccttggtgccttgtcttccttgcccgcaacagaagttggttctatagcaattgaagctgctctgaaaagagcaaatgtggatccggccctcgtgcaggaggactttttctgaaacgtcttgagtgctaatttgggacaagctcctgcaaggcaagccgctctgggtgcagggataccaaacactgttgtttgcaccactgttaacaaagtctgcgcatctggcatgaaagctactatgttcgccgcacactcaattcagctgggtatcaatgatatcgttgtggcaggtgccatggaaagcatgtccaatgccccaaagtagattgctgaacctaggaaagggtctcgttttggacatgacacacttgttgatgccatgcttaaggatagccttttggatgtatacaattactgtgccatgggaatgtgtgacgaact

SEQ ID NO: 70034 - protein, 60 aa, Zea mays
  misc_feature: Ceres CLONE 1549025
  misc_feature: SWISSPROT Homolog: EC 2.3.1.9 Acetyl-CoA C-acetyltransferase
MASKGIAPRDVCVVGVARTPLGGFLGALSSLPATEVGSIAIEAALKRANVDPALVQEDFF

SEQ ID NO: 70035 - DNA, 701 bp, Zea mays
  misc_feature: Ceres CLONE 1549027
  misc_feature: Encodes the peptide sequence at SEQ ID NO. 70036
  misc_feature (505)..(505): n is a, c, t, g, unknown, or other
  misc_feature (509)..(509): n is a, c, t, g, unknown, or other
  misc_feature (562)..(562): n is a, c, t, g, unknown, or other
  misc_feature (577)..(577): n is a, c, t, g, unknown, or other
  misc_feature (613)..(613): n is a, c, t, g, unknown, or other
aaagctggagctccccgcggtggcggccgctctagaactagtggatcccccgggctgcaggaattcgtctcacccctagaaaaaagcagcagtgctttgctcagtccactttgttgaggctgggttgagagtgtaggagtaaagcctcaagtctctttggtagacgatccaccacaccatccgaccctcaaccctttttcctcaacttgtcaaccgccgccccatctactcactccaccacggtcatcattaacatttcttctccattcttttcaggaccgtcgaggatcgatcaggcgggcagaagcggtcgtcgccggacaagacgcataggtccaccatggatggcgtctaccaccatcaccaccaccaagagtcgccgttgacgggcaacggcgtcgccaccgccggtgagaagctaggcgtggagcggttcgagctgccgctgatctacatctcgctgtcgcggaaggagaaggaagacgatttccttgcgatgaagggncacnagctgccccagcggcccaagaaaaaggctaagaaacgtgaccagaccctcccntttgtcctcccgggntatgtggttgtccgaattgacccaggggacggtacnaaggtgcggggagaaaaaaatgcctgaagaaaaacccaaaaagccttaaaagggatgggaaaccttggccggcaacccggaataaaaa

SEQ ID NO: 70036 - protein, 99 aa, Zea mays
  misc_feature: Ceres CLONE 1549027
  misc_feature (41)..(85): Pfam Name: DUF1639 Pfam Description: Protein of unknown function (DUF1639)
  misc_feature (57)..(57): Xaa is any aa, unknown, or other
MDGVYHHHHHQESPLTGNGVATAGEKLGVERFELPLIYISLSRKEKEDDFLAMKGHXLPQRPKKKAKKRDQTLPFVLPGYVVVRIDPGDGTKVRGEKNA

SEQ ID NO: 70037 - DNA, 712 bp, Zea mays
  misc_feature: Ceres CLONE 1549028
  misc_feature: Encodes the peptide sequence at SEQ ID NO. 70038
  misc_feature (689)..(689): n is a, c, t, g, unknown, or other
ggagctccccgcggtggcggccgctctagaactagtggatcccccgggctgcaggaattcgtctcacccctagaaaaaagccgcagcccgcagccgattctattcactcacggcgtcggcagcgccacctgatccgcggccgcagccccatcatcggcgatccgcagtcctaggcacgcgggtgcggagaggcggtcatgcttgatcccttccgggaccggagttcactggtgcctgtcgatttctcaagcttgtttctttcggggtaagcgagaggcataggccatcatcagacgagagggagaaccagcgaggactgccaagaagatgctgaagagactgctgacgaagactaagagcaagaagaagaaggaggctgcctcctctgccataccgacgttggatcggctccatgagactctagagatgctggagaagaaggagcgtttcctccagaagaaatgttccgcggaaatcgagaaggcgaaggattacacaaaagcgaagaacaagaacgccgcaatccagtgcctaaagaagaagaaactgtacgagacacagatcgagcagctatcgaatttccagctgcgagtccatgaccagatcataatgctcgaaagcgccaaggcgaccacggacactgtcgacgctctgcgctcggggtcatctgctgtcaaggcgatgcagcnatcagtcaacgtggacgactcga

SEQ ID NO: 70038 - protein, 128 aa, Zea mays
  misc_feature: Ceres CLONE 1549028
  misc_feature (23)..(128): Pfam Name: Snf7 Pfam Description: Snf7
  misc_feature (121)..(121): Xaa is any aa, unknown, or other
MLKRLLTKTKSKKKKEAASSAIPTLDRLHETLEMLEKKERFLQKKCSAEIEKAKDYTKAKNKNAAIQCLKKKKLYETQIEQLSNFQLRVHDQIIMLESAKATTDTVDALRSGSSAVKAMQXSVNVDDS

SEQ ID NO: 70039 - DNA, 647 bp, Zea mays
  misc_feature: Ceres CLONE 1549033
  misc_feature: Encodes the peptide sequence at SEQ ID NO. 70040
ctccccgcggtggcggccgctctagaactagtggatcccccgggctgcaggaattcgtctcacccctagaaaaactataaaggctggttactatgacatagggattggtgctggtttggaatccatgtccataaattccattgctagggaaggacaagttaacccaaaaataagcgcattccagaaagcacaggattgtcttctgcccatgggaattacttctgaaaatgttgcccatcgatatggtgtaactagacaagagcaagatcaggccgcctctgagtctcataggagagctgctgcagccatggcctctagaaaactcaaggatgagatcgtccccgtgccaacaaagatcgttgatcctaaaactggagaggagaaggaagttgtgatatcagttgatgatgggattaggccagggaccacaacatctggattggcgaaactcaaaccagttttagaaaagcatgggactacaactgcaggcaattccagtcaagtgagtgatggtgctggagctgttcttctcatgaaaaagatctgtgggctctaaaggaaggggctgccaattcttgggggttttcaaggtggccccgggggctgggcaacccttctaaaatgaaaaaaaaacccgcgggggaaaa

SEQ ID NO: 70040 - protein, 143 aa, Zea mays
  misc_feature: Ceres CLONE 1549033
  misc_feature (1)..(140): Pfam Name: Thiolase_N Pfam Description: Thiolase, N-terminal domain
  misc_feature: SWISSPROT Homolog: EC 2.3.1.16 Acetyl-CoA C-acyltransferase
MSINSIAREGQVNPKISAFQKAQDCLLPMGITSENVAHRYGVTRQEQDQAASESHRRAAAAMASRKLKDEIVPVPTKIVDPKTGEEKEVVISVDDGIRPGTTTSGLAKLKPVLEKHGTTTAGNSSQVSDGAGAVLLMKKICGL

SEQ ID NO: 70041 - DNA, 697 bp, Zea mays
  misc_feature: Ceres CLONE 1549036
  misc_feature: Encodes the peptide sequence at SEQ ID NO. 70042
ctggagctccccgcggtggcggccgctctagaactagtggatcccccgggctgcaggaattcgtctcacccctagaaaaatgaagaactaaccttagacagaggcaagtgagcgagggcatgatgcttgcatgcgtgtaccgtagacgtaccgtattcctacgtactgcaggttgcaccagtatttgtgaagggagctgtgcgtgggagccagagattgtaccgctagtgtatttttgtatgcacgccgtggagctgatcaatgaaatatgctgtaaataaaaaaaagctgactagctgagcgagcaatccatcccttcgcccgccgcaccatggaagccctcgcctcggcgcctcgggcgctcttcccgcgcgcgtgcccagtcgcgacgccggccggcccggcccggcgccgcaccgccgctcctcacatctgcagggcctccgcggcggctgtgggaggagacgccgccgccgccggccgctcccaagaagatcctcaagaagaagcccgtctactcgatgaagaaagggcagattgtcgagacgctcgaggtacccaattcgccctatagtgagtcgtattacgcgcgctcactggccgtcgttttacaacgtcgtgactgggaaaaccctggcgttacccaacttaatcgccttgcagcacatccccctttcgccagctggcgtaatagcgt

SEQ ID NO: 70042 - protein, 58 aa, Zea mays
  misc_feature: Ceres CLONE 1549036
  misc_feature: SWISSPROT Homolog: EC 3.2.1.23 Beta-galactosidase
MKKGQIVETLEVPNSPYSESYYARSLAVVLQRRDWENPGVTQLNRLAAHPPFASWRNS

SEQ ID NO: 70043 - DNA, 669 bp, Zea mays
  misc_feature: Ceres CLONE 1549049
  misc_feature: Translation starting site: 177
  misc_feature (540)..(540): n is a, c, t, g, unknown, or other
aaagctggagctccccgcggtggcggccgctctagaactagtggatcccccgggctgcaggaattcgtctcacccctagaaaaagcactcatccattccatcatcccctttgcaagtatagtctctctgctaagcgaagcgaagcttcaagctagtctcggcggctctagaagacgatgggcaaggacgacgtgatcgagagcggcgctggcggcggcgagttcgctgccaaggactacacggaccctcccccggcgccgctgatcgacgcggcggagctggggtcctggtcgctgtaccgcgccgtgatcgccgagttcatcgccacgctgctgttcctgtacatcacggtggccaccgtgatcgggtacagcaccagacggacgcgtcggcgtcgggcgccgacgcggcgtgcggcggcgtgggcgtgctgggcatcgcctgggccttcggcggcatgatcttcgtcctcgtctactgcaccgcggcatctcgggggccacatcaacccccgcgtcacctcggcctcttcctgcgcgncagggtctcctggtgcgcgcgctgctctactcgtggcgcagtgcctcggcgccatctgcggcgtcgggctcgtcaaggcgttccagagcgctactccgacaggtacggcggcgggccccactcgctcgc

SEQ ID NO: 70044 - DNA, 745 bp, Zea mays
  misc_feature: Ceres CLONE 1549050
  misc_feature: Translation starting site: 83
  misc_feature (200)..(200): n is a, c, t, g, unknown, or other
  misc_feature (207)..(207): n is a, c, t, g, unknown, or other
  misc_feature (247)..(247): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (268)..(268): n is a, c, t, g, unknown, or other
  misc_feature (271)..(271): n is a, c, t, g, unknown, or other
  misc_feature (273)..(273): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (283)..(283): n is a, c, t, g, unknown, or other
  misc_feature (289)..(289): n is a, c, t, g, unknown, or other
  misc_feature (290)..(290): n is a, c, t, g, unknown, or other
  misc_feature (292)..(292): n is a, c, t, g, unknown, or other
  misc_feature (299)..(299): n is a, c, t, g, unknown, or other
  misc_feature (300)..(300): n is a, c, t, g, unknown, or other
  misc_feature (307)..(307): n is a, c, t, g, unknown, or other
  misc_feature (315)..(315): n is a, c, t, g, unknown, or other
  misc_feature (317)..(317): n is a, c, t, g, unknown, or other
  misc_feature (323)..(323): n is a, c, t, g, unknown, or other
  misc_feature (327)..(327): n is a, c, t, g, unknown, or other
  misc_feature (350)..(350): n is a, c, t, g, unknown, or other
  misc_feature (354)..(354): n is a, c, t, g, unknown, or other
  misc_feature (356)..(356): n is a, c, t, g, unknown, or other
  misc_feature (360)..(360): n is a, c, t, g, unknown, or other
  misc_feature (399)..(399): n is a, c, t, g, unknown, or other
  misc_feature (691)..(691): n is a, c, t, g, unknown, or other
tggcggccgctctagaactagtggatcccccgggctgcaggaattcgtctcacccctagaaaaaactacacacaaacacacaatggcaccagaaacgatgctcctcggcgtctgtgccgtgctgatggtggtcggcgtcacgaacgcggcggagggccaggtggcgtctgtcatcttgggccttgcgaggtgcgccaacngcacgangaacaacttgaaggttaaggcaggtttcaagggtcttcanttgnnnattnnntgtttgaanagntnnnnctagttngagacnnangccgtgnntgagatnaaaagttncngaaacnttcnccgttccccctcggcgacggagncgcnangggngcccggactgcccccccccttctctcctcccggccccanaaaataccaccaaattaaaattggggcaggaaaccccccccctttctccccccccttttaaaggggaaaaaatttagaaaaaaaatgtctttggcatggatgggcgttccccggaccccccccaaataaccacatattttttttttcccctgtttgccacaaattaaaaaaaagaaaatttgtttaaaatcccttataccacaaagagggccccccctgccccccgcccccgggaataacaccccgccgggtgggtggaaaccacccccaaaagagccccccgtgtggcctncgattatactccccgacggggtgcgcccaataaaccaccaatacaccagagaag

SEQ ID NO: 70045 - DNA, 723 bp, Zea mays
  misc_feature: Ceres CLONE 1549051
aagctggagctccccgcggtggcggccgctctagaactagtggatcccccgggctgcaggaattcgtctcacccctagaaaaaaaaaactccctcccctccatcacaattcggtttcttgggtggtttttttttcttgcttgctcggtttcttgtggggcgggccgcgaaccggcgaggcgggggcgcggggcaacgcaaagcagcgcagcgcagcgcagtgcagcaaaagcttcgatctttatccgccggattcctctcctcccctttcctctctctccgtctccccgcttgctttgtgcttcgttgttgagaggaggggaggagggagaggagacccacatccacttgcctttctcctctctcctctcgcagccccccttccaactcctcctggtccctggaaaaaaaggagaccttttggtgcaagattcgatctgctgtggctgcctcggccttgctgcgtgcgcggagatttggtttcttggctggcggctggcgcgcgcgggcagttggagctctttgattcaacaggttcagattgcagcggcgagcgactgctctgcggtcgaggctgctgctcgccgggtgattccgtgcccgctcttggtggcggcgggcggtgtcctcgtctgatccgtttcttcgggaggctttggttgatgtgctgggtttcctcggagctcagttccccaatttcgcattttgatgaggagctcttccc

SEQ ID NO: 70046 - DNA, 742 bp, Zea mays
  misc_feature: Ceres CLONE 1549063
  misc_feature: Encodes the peptide sequence at SEQ ID NO. 70047
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (742)..(742): n is a, c, t, g, unknown, or other
tttttttttnnnnnnnnnntttttagcgagtgtcgccgtttcctccccaactcatactgggactccccgcggtggcggccgctcttcaacagtggatcccccgggctgcaggatttcgtctcacccctagaaaaagtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaggcgaagctgatggtggcgatcaacggattcggccgcatcggccggaacttcctccggtgctggcacggccgcgaggactcgccgatcgacgtcgtcgtcgtgaacgacagcagaggcgtcatgaacgcgtcccaccttcctcagtacgaactcgttgcctcggaaactttcaagggcgtacgtcaagaatacgtggacgtacacttcccatcagctgtcctacgggcaaagcccattcacgggacgttctccctacaaggcaacaccgcctcaaagcctccccatggggggttagaacccccggggcgtttggtacataaaatn

SEQ ID NO: 70047 - protein, 187 aa, Zea mays
  misc_feature: Ceres CLONE 1549063
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAQLVAKATGENAVRAPAEAKLMVAINGFGRIGRNFLRCWHGREDSPIDVVVVNDSRGVMNASHLPQYELVASETFKGVRQEYVDVHFPSAVLRAKPIHGTFSLQGNTASKPPHGGLEPPGRLVHK

SEQ ID NO: 70048 - DNA, 643 bp, Zea mays
  misc_feature: Ceres CLONE 1549065
  misc_feature: Encodes the peptide sequence at SEQ ID NO. 70049
  misc_feature (465)..(465): n is a, c, t, g, unknown, or other
tggagctccccgcggtggcggccgctctagaactagtggatcccccgggctgcaggaattcgtctcacccctagaaaaaacgcgaccgccacctccccgaagctgccgcgaccgatcgagcgaagcgtcgctccccgcgccgccgccaaaaccctagcttctcctactccatggccactgtctcgctcaccccgcaggctgtcttctccacggagtccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgccccgccgctcgcccccacttaggcgggcggcggagatctgcgcgacgccgatgtccccccagttgcggcgtgccttggtgctaagctggcgggcaaagtttgggggtaaagttancctttataacattccccaacaaagcacaggagtccaagttcgttgtggaactacccctacatgttgactggaaaagccgtcttcccaatccattggggctagttccctgtgggaaaattgcgaatttattgaaaaaccaattcgcctacgagaatatttcaactaagggacccaaaaa

SEQ ID NO: 70049 - protein, 87 aa, Zea mays
  misc_feature: Ceres CLONE 1549065
  misc_feature: SWISSPROT Homolog: EC 2.5.1.48 Cystathionine gamma-synthase
MATVSLTPQAVFSTESGGALASATILRFPPNFVRQLSTKARRNCSNIGVAQIVAAAWSDCPAARPHLGGRRRSARRRCPPSCGVPWC

SEQ ID NO: 70050 - DNA, 671 bp, Zea mays
  misc_feature: Ceres CLONE 1549070
  misc_feature (331)..(331): n is a, c, t, g, unknown, or other
  misc_feature (431)..(431): n is a, c, t, g, unknown, or other
  misc_feature (541)..(541): n is a, c, t, g, unknown, or other
ctccccgcggtggcggccgctctagaactagtggatcccccgggctgcaggaattcgtctcacccctagaaaaaggctttcagccgctctcctagtctcctactctcctctcagccgtcgccgtcgctctccacaccgctctcctctctcctccgagccgcagctcttctctctccctctcccctgcgtgccgccactgcgggcaccctgcacgccgccgctgcgtggccctacacgccaccgctacgggtgccctacgcgccgccgtcactgctccagctctcctctgtttcccagccaatgccgccgctctaactccccaaggcatcgnccccgacgacggctcaacgaagccccgtcgacgcctcgcggacgccctgcgccgcagcgggcgctttacgctccatggcaagggcgcgtagatgcctcanggtccacaggcgccctagcgcctaagcgacgctaaggcggcgcttcagataagcatgcttttgaaatagatgtgaaggattaaagctcatgtgaaaaagatctagactancattggtatcaagcgggtggcttcttatttctcatacgctcaaccatgctcctgcatgctaaaggattcagttagggaaaatgccttcaggtgcctagaactaacttgggggcggatcctacccaccccc

SEQ ID NO: 70051 - DNA, 667 bp, Zea mays
  misc_feature: Ceres CLONE 1549072
  misc_feature: Encodes the peptide sequence at SEQ ID NO. 70052
ctccccgcggtggcggccgctctagaactagtggatcccccgggctgcaggaattcgtctcacccctagaaaatcccagtatcgcctttgcccgcacacacggctcccattccatttccgctgcctgcctctgacgcgcacccacaccacctcgcctccctcagccctccgcagctcggcctctgcttgcgttgcgttgcgtgtgtatgtagtggccgcaacacaaaaatcaagagacgtgtatgtatatgcgacccccaacagccaacgaccggcctccaagcggtgggggtggaggagcagcagctggtgcaggtgcagcagcaggggacgacgacttcgccttctactgctcctacctcaggacgccgacgctgccgcccgctcagcgacgtcgacgctcgccctcgccgtcgacgacccctaccccaaccccagcggcccagggatgactaacgggccggccccggaaccaccccggggcaaaggaccccggaccccccgggaagggggaggaggaagccaaaaaggacggcaagaaagggtcccttaccaagctgctcccctcctggggggccttgagggggaggagaaccccaacaccggggggccccgaaaccctccaagggggaattgggcctttcaagtccaaaccccaaaccccccc

SEQ ID NO: 70052 - protein, 69 aa, Zea mays
  misc_feature: Ceres CLONE 1549072
MYMRPPTANDRPPSGGGGGAAAGAGAAAGDDDFAFYCSYLRTPTLPPAQRRRRSPSPSTTPTPTPAAQG

SEQ ID NO: 70053 - DNA, 689 bp, Zea mays
  misc_feature: Ceres CLONE 1549073
  misc_feature: Encodes the peptide sequence at SEQ ID NO. 70054
gcggtggcggccgctctagaactagtggatcccccgggctgcaggaattcgtctcacccctagaaaaaccttctcccctttcctcagaccccaggccccagcccggcaagcagacagtgggcgaccgtgcgtcgcgccaccaccgccaagccgccgagcagcaaccggcgacgccgaccctgccgaagccccagccccagatccagccgccgcctccgcctccgccgacgcagacgcagcagtaccagcaggcgccgccgcagtcgcagcagaagccgaagccggcggcggacgtgggggcggtggggcgcgtgctggagcggcccatgtgagacgtgcgcgcgacctacactatcggccgcgagctcgggcggggccagttcggggtcacctacctcatcacgcactcggagaccgggcagagactcgtctgcaagtccatcgccgcgctggaagctcgtccaccgcaaccacattgaggacgtgccgccgggaggggcagaatatggcaccacctcccgggccccccgcaaatcggtggaactcccggggagcatacgagggaagggaactcgggccaacctggttttggaaccccccccaaggccggggaagttttttaaggggcattttgcccagggggcccataccccgggggggggcccccccctcgtttttgcccaaaaata

SEQ ID NO: 70054 - protein, 109 aa, Zea mays
  misc_feature: Ceres CLONE 1549073
GGGRSRTSGSPGLQEFVSPLEKPSPLSSDPRPQPGKQTVGDRASRHHRQAAEQQPATPTLPKPQPQIQPPPPPPPTQTQQYQQAPPQSQQKPKPAADVGAVGRVLERPM

SEQ ID NO: 70055 - DNA, 639 bp, Zea mays
  misc_feature: Ceres CLONE 1549081
  misc_feature: Encodes the peptide sequence at SEQ ID NO. 70056
ctggagctccccgcggtggcggccgctctagaactagtggatcccccgggctgcaggaattcgtctcacccctagaaaaaaactgcttccgtcatctccaccatccccacgttctcctccctccgcctctcgctctgcgcacatccccatgcccacgccgagcgcttgcgcctcaccgcccccgtcgcagccgcggccgtggcggcgtcgacgacctcccccgactttcccgccgtgggcgccgtcctggggaagcccacagtgctcgtgggtagtggtcgagaagatcggagccgcggggttcaagctgaaggaggtggtgcgatgtccatctcctaggtcgtcgtcctcacgctcctggagttctggtcagtgagatgttcatcttcgtgctcagcctcgtcctcgagttgtcgcgcaagcagcgagagcagcgtgggtctcatcatcaggatcacaccaacatggtaagcctgtcattggtcatgactgccatccgcgacgagccggatctcaaagaggcggtaatactcaggcccttgggccacacctcacacctctgattgaggtgttcccgaaaccatcgacttgaacattttttcagatccagcaaaaagcagatccaaaacggatcaagaa

SEQ ID NO: 70056 - protein, 61 aa, Zea mays
  misc_feature: Ceres CLONE 1549081
MFIFVLSLVLELSRKQREQRGSHHQDHTNMVSLSLVMTAIRDEPDLKEAVILRPLGHTSHL

SEQ ID NO: 70057 - DNA, 650 bp, Zea mays
  misc_feature: Ceres CLONE 1549082
  misc_feature: Translation starting site: 145
tggagctccccgcggtggcggccgctctagaactagtggatcccccgggctgcaggaattcgtctcacccctagaaaaaagtccccagtcccccactgggagcggcagccagcacgaggaaggagcagcgcgagggcaggcgccatgggggtccgctcggcggccacgaagctgcacatcccaccatccgccgcccgccgccccacgttcctgccattcgtggccgtcctcctcctctgctctgcctcctatctcatcggcgtctggcagcacggcggcttcgccactccatccgacaaacccgccgccgtctccaccgctacggccgtcgcctgcaccaacatcgccgccgccccgaagaggaggacccggtccggcgccagctccccgtccctcgacttctccgcgcgccacgcggccgcggcggacgacgcgctcgacgctagcaccgccaccgccgcctcctcggccgcgccgcggaggtcgtcgtacccggcgtgccccgccaggtactccgagtacacgccgtgcgaggacgtggagctgtcgctgcgtgtcccgcgggaccgctggtgtaccgcgagcggcactgcccggcgtctgaacgggagcggctgccgtgccttgtgcccccacccgcccgggacccc

SEQ ID NO: 70058 - DNA, 643 bp, Zea mays
  misc_feature: Ceres CLONE 1549092
  misc_feature: Encodes the peptide sequence at SEQ ID NO. 70059
  misc_feature (643)..(643): n is a, c, t, g, unknown, or other
gagctccccgcggtggcggccgctctagaactagtggatcccccgggctgcaggaattcgtctcacccctagaaaaaagcaaaagctgctcatcaccgatggccacgggtaacacaagcaagcaagcaagtcactgagtagctagcagtatataccaccataaaaacaacatacacacacgtgcgctaataagctaagcttaaggtagctcctctctatctccggttagctcggacggacgacgttgccatggctgctcaactgcatcacgcactatacgagctgctgcacgaagcagcagcagcgcaacgagcgctgctgctcacgatccccttctccctgctgctcctggcgctcctgctccgctacctcgcggcgtcggcgtcggagtcggcgtcggcgacaaacaacgacggagcggcggcggtggcggccagcgaccccgacaagctcttgagcctgctgccgtcaccgcccatgaagctccccatcatcgggcacctgcacctgatgggggacatcccctacgtgtcactcgccgcgctcgccaccaggtacggaccggacctgatgctgctccgactcggcgccgtgtcgaccgtggtggtctcgtcgacgcgcgtcgccgaggacgtgctacgan

SEQ ID NO: 70059 - protein, 131 aa, Zea mays
  misc_feature: Ceres CLONE 1549092
  misc_feature: SWISSPROT Homolog: EC 1.14.13.68 4-hydroxyphenylacetaldehyde oxime monooxygenase
MAAQLHHALYELLHEAAAAQRALLLTIPFSLLLLALLLRYLAASASESASATNNDGAAAVAASDPDKLLSLLPSPPMKLPIIGHLHLMGDIPYVSLAALATRYGPDLMLLRLGAVSTVVVSSTRVAEDVLR

SEQ ID NO: 70060 - DNA, 701 bp, Zea mays
  misc_feature: Ceres CLONE 1549095
  misc_feature: Encodes the peptide sequence at SEQ ID NO. 70061
ctggagctccccgcggtggcggccgctctagaactagtggatcccccgggctgcaggaattcgtctcacccctagaaaaacgagttgagcacttacccttctcctacccgtcacctcctttttgcccgcagccgccaccgcgtgcccaagcagtctagcgcccccgtccccgatcgacaccatggtgtcggaagccagcaagaagaatgacgcccagaagaaggccgctgccgccacaaagaggggatgcaaggcctctgtggcatgcctagtcgtacttcatctgcggccgcggccgcctatgtggtggcgaacagcgtcgtggtgcttaagctatcagaccgctcctgcacaggggtcctcgcatatctcaccatttcgcgggatatccagacagagtctctatcgtatacattcaggggaacgaccttattgtggattcgcattcggagctgaactacagaaggcaataggtttctgctggccatgaaggggctggggactatctactcctcgcacaacagtaggttgcctgaaaaacttcccatcccctgaacacaatggaaatttacccttctttgccccgaaaatttgacacattgttaaagggccctgcccttccaagacaaattgtttaacttttgtgagaaaaaaagaatttgaactttgccaaaagaaaacccctaaaattttggggcggc

SEQ ID NO: 70061 - protein, 69 aa, Zea mays
  misc_feature: Ceres CLONE 1549095
MQGLCGMPSRTSSAAAAAYVVANSVVVLKLSDRSCTGVLAYLTISRDIQTESLSYTFRGTTLLWIRIRS

SEQ ID NO: 70062 - DNA, 652 bp, Zea mays
  misc_feature: Ceres CLONE 1549101
  misc_feature: Translation starting site: 170
  misc_feature: SWISSPROT Homolog: EC 2.7.11.1 Non-specific serine/threonine protein kinase
tccccgcggtggcggccgctctagaactagtggatcccccgggctgcaggaattcgtctcacccctagaaaaagtttttcacccggccgcctcgggggctcagggctcaggcaggccgataccctccccaatccccaccggcaccgaggcgctggccgacgaggccagcatgaagccgcgggcgttcctggagcgcctggcccgccccttctcctcctcccgccgctcctcctccgaccagtcccgccgcgacagggaggaggaggcggacctcgaggcgatcgcggcgcgggagcagcgcgcgttcaggtacgagaccctggcggcggcgacgcggagcttctccgagaagaaccggctcgggcaggggcgggttcggccccgtgtaccggggccgcctggaggacggccgcgacgtcgccgtcaagcgcctgggcgccggctcgcggcagggcgcccgggagttccgcaacgaggccacgctgctgtcccgcgtgcagcaccgcaacgtggtcaacctcatcggctactgcgcccgcggggcggaggacaagctgctggtgtacgagtacgtgcccaacgagagcctcgacaagatcctcttctactcctcctcctccgcccgctgtgagtcctcttctttccttccttc

SEQ ID NO: 70063 - DNA, 676 bp, Zea mays
  misc_feature: Ceres CLONE 1549112
ggagctccccgcggtggcggccgctctagaactagtggatcccccgggctgcaggaattcgtctcacccctagttacaagaagaagggcggcgatgcccatgtttgtcgggagtgggactccgacgaaagctcaagcgactcctccgacgacgaggacgccgccaacatcgccgtcaccaaaggccttctcttccccaacggcggccacaagtgtctcatggccaaggacggcgaaaagaaggtaaaatcaaggtcctccactaaatatgaaacatctagtgatgaggatgatgataaaaatgaagaggataacttgcgcattctttttgctgaccttaacatggaacaaaaggaaaaattaaatgaactaattagtgccatccatgaaaaggatgatctcttggactcccaagaggacttcctaatctgggaaaataagaaacatgtctaaggttaaaaatgcttatgctctagaagtagaaaaatgcacaaattatctagtgagctaagcatgtgccatgacactattaccaacctgagaagtgaatatgctaaattaattgctaacgtagattctcatgttctgcgttgatcctagaaacgataatgcttgatttacttgcgaggactgcatggagttaaatgttttccattgccagcccttaaaaatgagaa

SEQ ID NO: 70064 - DNA, 569 bp, Zea mays
  misc_feature: Ceres CLONE 1549115
  misc_feature: Encodes the peptide sequence at SEQ ID NO. 70065
  misc_feature (237)..(237): n is a, c, t, g, unknown, or other
  misc_feature (240)..(240): n is a, c, t, g, unknown, or other
  misc_feature (279)..(279): n is a, c, t, g, unknown, or other
  misc_feature (283)..(283): n is a, c, t, g, unknown, or other
  misc_feature (293)..(293): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (309)..(309): n is a, c, t, g, unknown, or other
  misc_feature (310)..(310): n is a, c, t, g, unknown, or other
  misc_feature (382)..(382): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (417)..(417): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
ggccgctctagaactagtggatcccccgggctgcaggaattcgtctcacccctagaaaaaacgagaccgtccaccgcgacgcgctctcttgcccgtgcccccgtcctccccttccccctccacctccgcggcgcccgcggtaacctcgccacgccacatcgcgtgcgagcaccaaccgtcgccggccctctaattaaagctgctgcgcggcgcgatccggtgtccaccgctgccccnccngaaagaggaggagaggaagaagggggccggggggtggancccngggggatgcnnnnaggaaaccccccnncgccgggcccccccgggggcggccggggggggggcccccgtccccgcccccccgggggggggggggcccccnggggggccccnnncccgggccccggcccccccccngcccccgggggggccggggggccccccggcgggggggccccccccccccccgnnnngccgccccccccccggggggccccggggaagacccccccccccgcgaaggcaaaagccccccccaccaaagaagcgggcccaaaaaaacccccccc

SEQ ID NO: 70065 - protein, 189 aa, Zea mays
  misc_feature: Ceres CLONE 1549115
  misc_feature (93)..(93): Xaa is any aa, unknown, or other
  misc_feature (95)..(95): Xaa is any aa, unknown, or other
  misc_feature (98)..(98): Xaa is any aa, unknown, or other
  misc_feature (99)..(99): Xaa is any aa, unknown, or other
  misc_feature (104)..(104): Xaa is any aa, unknown, or other
  misc_feature (128)..(128): Xaa is any aa, unknown, or other
  misc_feature (132)..(132): Xaa is any aa, unknown, or other
  misc_feature (157)..(157): Xaa is any aa, unknown, or other
  misc_feature (158)..(158): Xaa is any aa, unknown, or other
GRSRTSGSPGLQEFVSPLEKTRPSTATRSLARAPVLPFPLHLRGARGNLATPHRVRAPTVAGPLIKAAARRDPVSTAAPPERGGEEEGGRGVXPXGMXXGNPPXPGPPGGGRGGGPRPRPPGGGGAPXGAPXPGPGPPPAPGGAGGPPGGGAPPPPXXPPPPRGAPGKTPPPAKAKAPPTKEAGPKKPP

SEQ ID NO: 70066 - DNA, 677 bp, Zea mays
  misc_feature: Ceres CLONE 1549121
  misc_feature: Encodes the peptide sequence at SEQ ID NO. 70067
ctccccgcggtggcggccgctctagaactagtggatcccccgggctgcaggaattcgtctcacccctagaaaaaaaaccagaagcagtcgtcaaagggccaaagtcccctgctccccgcccggagcccgcggcccgccgctcaaacccctaaaccctagccgcaccagcgccctattccctccttcggcggctccggcagcgagcggtcactaacaaccagcatcgtacggcgaagaagcgccgtttacacccatctggcggagatgccgctggggcagcgtccggaggacaagagtgacgcccgctactgcggggtggaggtgctccacttccctgccggcgaggacctccccgccgttctcaacaactcgctcgactgcagcttcgacttcatcctcgtccctctggttgacccctactactggtcgggaacccggctacgtttctgacattgtcgggcgtcggaacctcatccttggccccgccacagtgaacaaacacttcggctggaaaaacaacgaagtaattgatttaggactcggagggagaggggttcccgctttgaatccgaattcacccctgaagcgggaaattggccggggccttcctcccgtacaggttgaaaggaatgggttttctttcttggcccccgaaaaaaatattttggggggcattt

SEQ ID NO: 70067 - protein, 61 aa, Zea mays
  misc_feature: Ceres CLONE 1549121
  misc_feature: SWISSPROT Homolog: EC 2.1.1.125 Histone-arginine N-methyltransferase
MPLGQRPEDKSDARYCGVEVLHFPAGEDLPAVLNNSLDCSFDFILVPLVDPYYWSGTRLRF

SEQ ID NO: 70068 - DNA, 686 bp, Zea mays
  misc_feature: Ceres CLONE 1549124
  misc_feature (250)..(250): n is a, c, t, g, unknown, or other
ggggaattcgtctcacccctagaaaaagtctggtcggcgtggatcggatcttcggtggtgtttctcgtcttcacggcgattagtggcggcgagccgaccacgtccccgcagcaggcagtcagcggcggcttgacgcggtcggacgggtacctctagttggcatccgcgagtgggcgcggggcgccgcaagtctcaccgtccgctggtgtagaggccccgagtctcggctctatggagtgtaaggcgaccnactccaattaaggagggccacgggtccaccaaggcactttgtcaattgacaaggtctcgccctctccagttgttggaggcggtcttccaatttttcttgtgtttttcccccccccccggggggagcggggcgcctgctgggccggaaaatctaaatcttgcgcctcccactgtcggggtgccccctttctagcccggcaaatcagggaggccgggttttgcccacgaaccgatggggcgggcgctcttcccgcccctgcggtcgcgctggggccggcctcccatcaccaaaggccggcgggctgactggtacgcctttcccggaccacgctccctcccgcccctcggcggggggtctgctgcgatgcggatttcgacttcgatctccccccgctggcaggacgtgccccaggcgggagcggggcgggggcggcccc

SEQ ID NO: 70069 - DNA, 718 bp, Zea mays
  misc_feature: Ceres CLONE 1549127
  misc_feature: Encodes the peptide sequence at SEQ ID NO. 70070
tggagctccccgcggtggcggccgctctagaactagtggatcccccgggctgcaggaattcgtctcacccctagaaaaaggagacagcaactccactcctgagtcctcacctcgtgctgcccgcgccatttccacctcccactgtcctttcgtccagtccccagccctgcagcccaaccgtggaggttctggaaggcggtgtatcccttctagaaccttctcgagatgcagagcgccgcggctttccggccgtgccccactcggctgctggtgagcaacccttgtcgccccctcctctcggcccgcaccgcttcgtgtctccgaccgctggcgccgtctctaccacaagcagcgccttgggccctcgcggactggggctcgggctgctgccagcctctcccgatccggatggcaagtgccgccagcgacaggtgtcatgcagcgcggcctgtgatgctgtggcggcccctaatgcggaagaatgaggcgggctcatgaagacgctgtggctcggctcgctcttcggcctcaggtacctgttaaacatctacttcaacatctataacaagcaggtactcaaggttttcccatacgctataaacatcacagaacgtcaatttgctgtcggaactgtagcagctctgttcatgtggatcactggcatcatgaagagggcaaagatctctggaccacagcttgtagccatcctagctctggg

SEQ ID NO: 70070 - protein, 74 aa, Zea mays
  misc_feature: Ceres CLONE 1549127
MKTLWLGSLFGLRYLLNIYFNIYNKQVLKVFPYAINITERQFAVGTVAALFMWITGIMKRAKISGPQLVAILAL

SEQ ID NO: 70071 - DNA, 781 bp, Zea mays
  misc_feature: Ceres CLONE 1549130-R
  misc_feature (433)..(433): n is a, c, t, g, unknown, or other
attggggtactcgagcgtctcgtttttttttttttttttataacatttgaaggataaacaatttattatttatccctgtacaaacgataatatctgtttcatgaaaggaatagaacaaacagctccaagttcaaatcatcaacactcacgccacgctggggcactggccaccaaatgcgaaacctgttccacgtactggagtgcagaaacggacccagatctcacaaagacgcaaactgcacgggcgacagccgacacccttgcgttgtgtaaaaacccagaccaactgcgcacatcaggaacatcctaatatggcactgttgttgaaaaaaaaactaaactgacctgacgatctatactgctgaagtactgcacatgtttcttcatgtagtaccatcaatcgactttaccaccctgcacaatgctccatggncaacagctctttcatatccagaaagacgaagaatgctagcgagaccacgggacaaacttgcatccccactaactgaaaatgcaagcacagatatacggctccaaaattcagaagcatttcatgtgaactatgccgaacaaaatcctcatactcctcccctggaaacccacatccgctgaaaagtcctgaagggaggccaaaatggaaccccccatccccaaaccttggacttccctcttccggagaaaaaaaccaccttttacctttatggttgttgtggggcaaaaggccataaaatccccctttgggccatgggggggcccccattttccggggagaacattttgg

SEQ ID NO: 70072 - DNA, 678 bp, Zea mays
  misc_feature: Ceres CLONE 1549133
ctccccgcggtggcggccgctctagaactagtggatcccccgggctgcaggaattcgtctcacccctagaaaaaagtttggctttcttctgtttcgcctcgtgctcgcctttgttgatcttttcgtttttcgcgttcccctcgccttcctcttcctcccccagacctattggtcgccgcacccgtcgccccggcctcctttgtccagagacgagggggtccgcgccgttggtacgcctcaccgcaaacgcatcggatcaccgcctgctgccaccgaccatccgccctccctcgatcgctctccccggatcgttggtacctccgcgcgcggctccgagctcatcttcctccatcggctggcatcggcagcggcggcttgttcacagccaaccttcaaaagggtaatcagtctgcagagttttgggaactgtgttgggggggacctgggggaagagacggcttactgcagacgctaatcttacggttgtcgagtgatggagcaaggcctccacttccgtgacttcatcggcgccgaagggtggccatgatggtggtcctgcactcttgagggaaattgggtgacatgaccatctaccggaagctaggcgagggcgcgaccgtgaccgtcgacgaccttgacctattgcagagcatggtgcatggggggtccatcgccatg

SEQ ID NO: 70073 - DNA, 744 bp, Zea mays
  misc_feature: Ceres CLONE 1549134
  misc_feature: Encodes the peptide sequence at SEQ ID NO. 70074
tccccgcggtggcggccgctctagaactagtggatcccccgggctgcaggaattcgtctcacccctagaaaaaaacacagtacgtccaagcctctgctcagctatggagtcccgtagctctccgctctgctggtgctcgccatgctcgcgctctcctcgtccccgctcgctctcccgtgggagaaggctgaacctgagtgccactcgtgcgagtccagctcaccaccctcgaccgggggcgtccccctgcctcccgtcagcaataccgatcggtcaccgctaccacctgtgagcataccgtctgtccccctgccccctgtcagcatacctccagtgcccctgccgtcggtgaccctacctcccattcctatcggtgggggaagacatagcccgacccccccccttctacagaaggcgtgcacttttccttcgtatcccccgaagttggacctcacaccgacggcgataattggaaaaattgcccccattgaatcgcttcaactgcgaatcctgcgggttacttcctccagtaactaggtgaacttcaggtgacccaaaccctccggtgcctttccgcagcgccaatggtaaacggacagggaaactcgcatgcggccaggccttttgccccgactaatcagggtaaaggtgcttctgagacttccaattgacattccttttgggagaataatgtggctggcaagactggtggtttgtaacgtatgcttctgggttcctatatgg

SEQ ID NO: 70074 - protein, 131 aa, Zea mays
  misc_feature: Ceres CLONE 1549134
MLALSSSPLALPWEKAEPECHSCESSSPPSTGGVPLPPVSNTDRSPLPPVSIPSVPLPPVSIPPVPLPSVTLPPIPIGGGRHSPTPPLLQKACTFPSYPPKLDLTPTAIIGKIAPIESLQLRILRVTSSSN

SEQ ID NO: 70075 - DNA, 783 bp, Zea mays
  misc_feature: Ceres CLONE 1549138
ggagctccccgcggtggcggccgctctagaactagtggatcccccgggctgcaggaattcgtctcacccctagaaaaaaattttggtttaaaaccagaaagccgagcgcgcgtgcagtcacccatccgtccatccgtccgtccgtcgtccgccgtccaccgccagcgcgcgctcgccaccgcacccagctagcagcacaagaaaagtctggtggcgtcggcggcggcggcggctgccggcttgccacagtccaatccttggaccggccaataagcagttgaaggcgcgagcgagcgagctagcgggcccttcgtctctacgagcctacgacgcgcgatcgagccgggcattgctgacctctagttaagtggggcgaggggggtggtcattcccgcagggaaacccccccctgggccccggcaatctgaccgtcccagggtatctggggggggttgttccgtaccccacccctttaattgttgaatcctgaaaggatacatgaaggtgcaaaagaaaaaaatttttagttgtcccaggaaagaaaacgattttgccacattttgccttttggagggaacctcccaagttttgggttgtgaatttttctccccttggaggaaaaacccggggggggggggcgctttgttcgacaagtgttccccctcttaagaaaaaaaagggccccatggtggggggtgccccccccgggggggaaattccatgaggggtgtaatattttcccggttatctctccccgcgggaggacgcgcgtttcttcggggg

SEQ ID NO: 70076 - DNA, 855 bp, Zea mays
  misc_feature: Ceres CLONE 1549142
  misc_feature (10)..(10): n is a, c, t, g, unknown, or other
  misc_feature (19)..(19): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (39)..(39): n is a, c, t, g, unknown, or other
  misc_feature (40)..(40): n is a, c, t, g, unknown, or other
  misc_feature (42)..(42): n is a, c, t, g, unknown, or other
  misc_feature (43)..(43): n is a, c, t, g, unknown, or other
ttttctttanaaaccaacncccccaaccacnnnntcccnnannttcctttttactccccgcggtggcggccgctctagaactagtggatcccccgggctgcaggaattcgtctcacccctagaaaaactatagctccctgctttattcagacttcatagcccttcctcttgtgtccgtgcaaattggtgatacttgaacatggatctcctccgcattagtgagcccgatgtataatcctcccagtgggcaggacatgtcctactacgatcatgtgcagaagcgccattaggagaagggctgcctatatgcatgcctgttcactgagtgctgctgcttctggtgcttccaggacctgtgagtgctgccttgaggccatctgtttcctggtgtaaaacctgctttttttggccccccccctccggagggggggggggggtggccctttgtgggaaaccccacccccccccatatagggcttttccttttttttctccccccccttataaaatgaatctacttctcctttttagaagttgaccctttttgacttctctgcctaaacctattctagtgtgcgtttttgtaatctcaatatcgattccgtttggacgccccaacccacccctcatatcgtctccttctcacgtctcttttttcagaaccgctcatggtattttccctttggtttaaggcttctttctgcctgatgtggaactatcccttgatgtcttgcgcgctcttctgagtagacctagtgtgtgtattcacttaatagtttcattgtggtgtctctcgaatcactgcgcgccgatcgcgcctttcgtcttctaccattaattcgctctctccccccc

SEQ ID NO: 70077 - DNA, 727 bp, Zea mays
  misc_feature: Ceres CLONE 1549143
  misc_feature: Encodes the peptide sequence at SEQ ID NO. 70078
ctccccgcggtggcggccgctctagaactagtggatcccccgggctgcaggaattcgtctcacccctagaaaaaacttgctcctttctctgccgcccgccgctgccgagtgccgggtcttcgctttctttctcctcttcgggcacttcgctgcttgcctgctctgctcgcgacctgcttctcagacccgccctcctcgccggccgcccggcgatgcctcctggccagaggaggaggcggcggcggcggagatagttagctcttcagattgagtgactggtggtcgccggcggcggagacgcggagtatggaggcgccggggacgagctcgggcggcgccggaggcgagggggccgggggcaccaaggtcaacgaggagctgtggtacgcgtgcgcgggaccgctcgtggcgctgcccgcggcggggagcctcgttgtctacttcccgcagggacacagcgagcaagtagcagcatctatgcgaaaggatgcagatgccaaaattccgagctatccaaatctctcatctaagctaatatgcatactccggagtgtcactatgcgttgctgatcctgacacagatgaggtttccgcctcgatgacccttcagcccgttagcattggggaccctttgggaaaaggaaacttgctgggcaccaaacttgccctggaccaaacccgacccggaccgggttctttggtaaaacccgcccgccagggaaccagg

SEQ ID NO: 70078 - protein, 87 aa, Zea mays
  misc_feature: Ceres CLONE 1549143
  misc_feature: The sequence is a functional homolog of SEQ ID NO 202 in the 10/225,066 US patent application
  misc_feature: The sequence is a functional homolog of SEQ ID NO 2342 in the 10/374,780 US patent application
  misc_feature: The sequence is a functional homolog of SEQ ID NO 286 in the 10/412,699 US patent application
  misc_feature: The sequence is a functional homolog of SEQ ID NO 1002 in the 10/666,642 US patent application
  misc_feature: The sequence is a functional homolog of SEQ ID NO 1622 in the 10/374,780 US patent application
  misc_feature: The sequence is a functional homolog of SEQ ID NO 1655 in the 10/412,699 US patent application
MEAPGTSSGGAGGEGAGGTKVNEELWYACAGPLVALPAAGSLVVYFPQGHSEQVAASMRKDADAKIPSYPNLSSKLICILRSVTMRC

SEQ ID NO: 70079 - DNA, 723 bp, Zea mays
  misc_feature: Ceres CLONE 1549146
  misc_feature: Encodes the peptide sequence at SEQ ID NO. 70080
ctccccgcggtggcggccgctctagaactagtggatcccccgggctgcaggaattcgtctcacccctagaaaaagccccctcctcctccggccatgaccgatcccacccggtcggtcccattcttctactactcgatactccacggatacacccacgcacatgcactcccaccccctcatcacttgcattagagcaccacgtcatccagctatctgaccaccagtgctactaagctagccaccgcctcctataggagaataggctataggcctatagctaccatagccgccagctgccacagctgtacctcacctagctagtaggagagtaggaggtcgactggttgtaggctgctgtgccattgcgacggcgcgcgggcggagggccggggatcgacagcgccactctgacacagacagagaggttactactctgcttgtacgtgcactacaaataaagtacagatggtgacggccaaggacgccgcggcggctgcggcagccgccatggacgctagcaagtacgtgcggtacaatccggaccaagtggaggcgctggagcggctctactacgagtgcccgaagcccgagctcgctgcgccgacagcagctggtccgcgactgacccgttcctcgcagaggacgagcccaagcagagtcaggtctggtttcccgaccccgcagcgccggggaagagcatcggagaggaatctcccgggctgc

SEQ ID NO: 70080 - protein, 86 aa, Zea mays
  misc_feature: Ceres CLONE 1549146
MVTAKDAAAAAAAAMDASKYVRYNPDQVEALERLYYECPKPELAAPTAAGPRLTRSSQRTSPSRVRSGFPTPQRRGRASERNLPGC

SEQ ID NO: 70081 - DNA, 720 bp, Zea mays
  misc_feature: Ceres CLONE 1549147
  misc_feature: Encodes the peptide sequence at SEQ ID NO. 70082
  misc_feature (704)..(704): n is a, c, t, g, unknown, or other
ctccccgcggtggcggccgctctagaactagtggatcccccgggctgcaggaattcgtctcacccctagaaaaacatttcattagaagctgagaaaacaagcatatctgaacagttatcagctctatcttctatggaagaacatcatgaagaaaatgtaagattagatagccacggcaatcggatacttactgtagatggggacaatgcaccttcagaaaacttggagtttgaagttgttgaactacgccggttaaacaaagagctacagtttcagaaacgaaatcttgcaattaaactctcttcagctgaatccaaattggctggccttgagaagaatgaagagagtgatatagttgccaaagttcaagctgaggcatcgttgttgaggcatacaaatgcaaacctcagcaagcaagttgagggattgcaaatgagccgactaacagaggttgaggagcttgcttatctacggtggatcaattcttgtctacgccatgagctttgtaactcagatcaagcagctagagcaacgacggatatagattacaatggtggcatggcttttaatgaggatgataatagcgaaggtgatgcaaaaacttccgaggacagttctgatataaaattcagcattgcagaacgcatcaagcagtggtcccagaaatgatagagctgccaagcatcgaaaaagggatcccttcntgatagggcatggatt

SEQ ID NO: 70082 - protein, 178 aa, Zea mays
  misc_feature: Ceres CLONE 1549147
MEEHHEENVRLDSHGNRILTVDGDNAPSENLEFEVVELRRLNKELQFQKRNLAIKLSSAESKLAGLEKNEESDIVAKVQAEASLLRHTNANLSKQVEGLQMSRLTEVEELAYLRWINSCLRHELCNSDQAARATTDIDYNGGMAFNEDDNSEGDAKTSEDSSDIKFSIAERIKQWSQK

SEQ ID NO: 70083 - DNA, 690 bp, Zea mays
  misc_feature: Ceres CLONE 1549153
  misc_feature (401)..(401): n is a, c, t, g, unknown, or other
ctcaccgcggtggcggccgctctagaactagtggatcccccgggctgcaggaattcgtctcacccctagaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacattgccatggctgctcaactgcatcacgcactatacgagctgctgcacgaagcagcagcagcgcaacgagctctgctgctcgcgatccccttctccctgctgctcctgccgctcctgcgtcgctacctcgcagcgtcagcgtcggcgtcngccacgagaaggacggagcggcgccggccagcgacgcgacaagctcttgagcctgctgctgtcgcgcccatgaagctcccatcatcgggcacctgcacctgatgggggacataccctacgtgtccctgacgcgctcgccaccagtacggtcccggactgatgctgctcgccctcggcgcatgccaaccgtgtggtctggtccccaaccgtcccgaagccggggtccgacccagaacaatggttccctaccccggggttcccggtggcgaacatctcttgtagggccccc

SEQ ID NO: 70084 - DNA, 722 bp, Zea mays
  misc_feature: Ceres CLONE 1549156
  misc_feature (231)..(231): n is a, c, t, g, unknown, or other
  misc_feature (236)..(236): n is a, c, t, g, unknown, or other
  misc_feature (238)..(238): n is a, c, t, g, unknown, or other
  misc_feature (239)..(239): n is a, c, t, g, unknown, or other
  misc_feature (245)..(245): n is a, c, t, g, unknown, or other
  misc_feature (248)..(248): n is a, c, t, g, unknown, or other
  misc_feature (258)..(258): n is a, c, t, g, unknown, or other
  misc_feature (271)..(271): n is a, c, t, g, unknown, or other
  misc_feature (287)..(287): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (403)..(403): n is a, c, t, g, unknown, or other
  misc_feature (405)..(405): n is a, c, t, g, unknown, or other
  misc_feature (408)..(408): n is a, c, t, g, unknown, or other
  misc_feature (412)..(412): n is a, c, t, g, unknown, or other
  misc_feature (414)..(414): n is a, c, t, g, unknown, or other
  misc_feature (416)..(416): n is a, c, t, g, unknown, or other
  misc_feature (421)..(421): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (427)..(427): n is a, c, t, g, unknown, or other
  misc_feature (428)..(428): n is a, c, t, g, unknown, or other
  misc_feature (436)..(436): n is a, c, t, g, unknown, or other
  misc_feature (437)..(437): n is a, c, t, g, unknown, or other
  misc_feature (452)..(452): n is a, c, t, g, unknown, or other
  misc_feature (453)..(453): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (466)..(466): n is a, c, t, g, unknown, or other
  misc_feature (485)..(485): n is a, c, t, g, unknown, or other
  misc_feature (486)..(486): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (499)..(499): n is a, c, t, g, unknown, or other
  misc_feature (514)..(514): n is a, c, t, g, unknown, or other
  misc_feature (517)..(517): n is a, c, t, g, unknown, or other
  misc_feature (518)..(518): n is a, c, t, g, unknown, or other
  misc_feature (531)..(531): n is a, c, t, g, unknown, or other
  misc_feature (536)..(536): n is a, c, t, g, unknown, or other
  misc_feature (541)..(541): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (557)..(557): n is a, c, t, g, unknown, or other
  misc_feature (558)..(558): n is a, c, t, g, unknown, or other
  misc_feature (575)..(575): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (609)..(609): n is a, c, t, g, unknown, or other
  misc_feature (612)..(612): n is a, c, t, g, unknown, or other
  misc_feature (615)..(615): n is a, c, t, g, unknown, or other
  misc_feature (616)..(616): n is a, c, t, g, unknown, or other
  misc_feature (619)..(619): n is a, c, t, g, unknown, or other
  misc_feature (620)..(620): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (643)..(643): n is a, c, t, g, unknown, or other
  misc_feature (648)..(648): n is a, c, t, g, unknown, or other
  misc_feature (650)..(650): n is a, c, t, g, unknown, or other
  misc_feature (656)..(656): n is a, c, t, g, unknown, or other
  misc_feature (657)..(657): n is a, c, t, g, unknown, or other
  misc_feature (664)..(664): n is a, c, t, g, unknown, or other
  misc_feature (665)..(665): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (690)..(690): n is a, c, t, g, unknown, or other
  misc_feature (691)..(691): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (716)..(716): n is a, c, t, g, unknown, or other
  misc_feature (718)..(718): n is a, c, t, g, unknown, or other
ggagctccccgcggtggcggccgctctagaactagtggatcccccgggctgcaggaattcgtctcacccctagaaaaaaaggcctcaacacacacacacactctctcgcttgacctacccccctccgccccccgccgggcctgcagggtgttcgacgcttcgcccgcccgcccgagcgccgccacggcatggcttcctccatctccgccgccgctaaggcctccgcggccntttgncnnccaaanagnaaagggaagncttgggggcccgncgccggcgccgcaccngcgcggggctcgagccgtcggaccaagcccgtgcccgcggtgggggccccctttccggttttccccgggggaaaaacccccggggggggggggggtttttttttttgttnnnncgngnggnccgngngnccggntnnntnncgggccgnngcggggccgcgcgcnncgcgcgtcnnntncggcccgcggccgccgcgnnggnnnntggttgntgttggtggccgggnttnnggccggccggcgngggtngcggncgcgccgnnncgcggnncgcgctccgccgcgggntnnncccgccgggggggcggnnnccgcggtgcgncgncgnntgnncgcgnnnnnnnngaggggnnntngagtngngggaanncaagaannaagccnnnnagaaaagaggagaggnnccgcggnnncccgagagagggaatntnagaa

SEQ ID NO: 70085 - DNA, 692 bp, Zea mays
  misc_feature: Ceres CLONE 1549157
  misc_feature: Encodes the peptide sequence at SEQ ID NO. 70086
agctccccgcggtggcggccgctctagaactagtggatcccccgggctgcaggaattcgtctcacccctagaaaaagtccctccgctccagccgccgccgccgcctccgccctccgaatcccaatggcgtccgcggccgctcctccaacctccctctccctcgcggcccgcgcggccaccagggcagccgccgccgccgccgccccgctgcgcaggggaggcctcgccacggcgtgccagccggcatggtctctggctttcgcggcgggcgacgcgcggctcgcggtccacgttgcgtcgcgatgccggcaggcgttctccgggcgtggcacgcgggccatggccaccatggcgaagaagagcgtaggggaactcacggaggccgacctcgaggggaagcgcgtcttcgtgcgcgccgacctcaacgtgccgctcgacgagaaccagaacatcaccgacgacacccgcatccgggcccgccatcccaccatccagtacatcctcagcaagggcgccaaggtcatcctctcaagccacttgggtcgcccctagggttttacacccagtttagctaacctccccctgaagaacgttgtctgaacttctggccattcagtgcaaaaagcgaccatgttattggccccaaatttaaaagctggtggcgccctgcccaacgggggggtttgctgctt

SEQ ID NO: 70086 - protein, 142 aa, Zea mays
  misc_feature: Ceres CLONE 1549157
  misc_feature: SWISSPROT Homolog: EC 2.7.2.3 Phosphoglycerate kinase
MASAAAPPTSLSLAARAATRAAAAAAAPLRRGGLATACQPAWSLAFAAGDARLAVHVASRCRQAFSGRGTRAMATMAKKSVGELTEADLEGKRVFVRADLNVPLDENQNITDDTRIRARHPTIQYILSKGAKVILSSHLGRP

SEQ ID NO: 70087 - DNA, 782 bp, Zea mays
  misc_feature: Ceres CLONE 1549158
tcttcactagtggatcccccgggctgcaggttttcgtctcacccctagaaaaaactcgtgcggatgagcacgaccaacttggccggagggtgaatggtgatacggtgaaggcgaacgccgatccaaaccgaacggcgaaggcgaagaggaccaaccaaggcatagcctacgggatctccctctcattccagacgagtccgcgtcgcccggcccaattcgagtgcgacgccggcatatagggtttcaacagcgccggctatggaccaaccccaagtgagccccgatcgcttggtgctccatttatggcgctgggggctgggacctccggcctccaccgatattgcctcaattttgccggcatccagtttggttcagggattggtgcccccccccccctctaattaatcggggaaatataagtacggggccgtccctcaaagaggctcccaccccttcgaggggcgccaatttcccgttgttccccggcgaggatatcagtggcctttgtctctattccacccctggtgaaagaggaaagattgaatttcggatattgggggggactcacaatttttctgttggtcacaagaagtgggcctgggcgggggatcaccttcccagatattttgataattgaggatatcgcgagcctgaagggggttgacagtattttcatgaggaggtagaatggtcgctgattgatctcatttgtggaaatcacattacactcgtcgcgctgcacattcttaaagaactagtgggttgggcattttgtgctattg

SEQ ID NO: 70088 - DNA, 668 bp, Zea mays
  misc_feature: Ceres CLONE 1549160
  misc_feature: Encodes the peptide sequence at SEQ ID NO. 70089
ctccccgcggtggcggccgctctagaactagtggatcccccgggctgcaggaattcgtctcacccctagaaaaaatctagctctcccgtttctgctcgcaagtcacacacacagctccggtagatccggccctcgcctctggctccatgaagagattagcttcagacggcagggatcgatactagcaagcaagcaagcatggcgcacgacttgtgcgaggacttggagctcgtcgccgacgacggcggcggcttcgatgactactactgggacgacgacttccatttccacgacgacggcttctccgcctcccctacgacccccggcagcggtggtgcgccccgccagcagcagcagatgggtgatatttcagcctcggactacaaagaaggcgaagacatgcaggggataccctgggaaagactcaactacaccagggaccagtatcgtcggatgaggctcaaagagtacaagagctaccagaacctcacgaggtcgcacagcgggctacaacaacaggaatgcaaacaggtgggagaggaaggacacattctacgagttccatctgaacacgagagccgtcaaagtcacgatagtgcatttccagctgaagaacctcctgtggcctacttcgaagcacgacctgtacctggtgcagacctactccg

SEQ ID NO: 70089 - protein, 156 aa, Zea mays
  misc_feature: Ceres CLONE 1549160
MAHDLCEDLELVADDGGGFDDYYWDDDFHFHDDGFSASPTTPGSGGAPRQQQQMGDISASDYKEGEDMQGIPWERLNYTRDQYRRMRLKEYKSYQNLTRSHSGLQQQECKQVGEEGHILRVPSEHESRQSHDSAFPAEEPPVAYFEARPVPGADLL

SEQ ID NO: 70090 - DNA, 729 bp, Zea mays
  misc_feature: Ceres CLONE 1549162
  misc_feature: Encodes the peptide sequence at SEQ ID NO. 70091
tggagctcaccgcggtggcggccgctctagaactagtggatcccccgggctgcaggaattcgtctcacccctagaaaaattcctgcctcgcctcagcgccattatagcgcgcgcgccaaggtcgaggtgaggttttcgagatgcaggttaccgagaagatcctctaggcggcggcgggatggcacggacagctttctctttcgatgttgtccctcccaagaccgaggagggggtccagaacctgtctcgagctcatggacctcatggtggtgcactgtccctccttctgcgacatcacctggggcgccaggcgatccaccgctgaccttaccctctatatcgcctaccgtatgcataacatggtgtgtgtggaaaccatgatgcgcctgacatgtacgaacatgccactacagaacactgaccatgccttggataccatcaacccaatgcgattcatagtgttttgtgcctcagacgggatcctacacatgggcaagacaattttgtgcagattgaacgcggattggcttctgctcttcatctcgtagcacatattggagactagttcggttgatggttttcggatagctgtttcttgttcacgcagatgcaccactctgattgcaattcaaagcgaaggcaggtgcctacattgccaacctgatacgcaatgctccttgggaaacctgcaaaaaggaaaggcttgaaagcgggtggttgaaccctttt

SEQ ID NO: 70091 - protein, 97 aa, Zea mays
  misc_feature: Ceres CLONE 1549162
  misc_feature: SWISSPROT Homolog: EC 1.5.1.20 Methylenetetrahydrofolate reductase (NAD(P)H)
MDLMVVHCPSFCDITWGARRSTADLTLYIAYRMHNMVCVETMMRLTCTNMPLQNTDHALDTINPMRFIVFCASDGILHMGKTILCRLNADWLLLFIS

SEQ ID NO: 70092 - DNA, 715 bp, Zea mays
  misc_feature: Ceres CLONE 1549167
  misc_feature: Encodes the peptide sequence at SEQ ID NO. 70093
acccgcggtggcggccgctctagaactagtggatcccccgggctgcaggaattcgtctcacccctagaaaaagcgcgtgttcgcggcatggccacgcttccaatggcgctctcccccgccgccatttcccccttcaccaccctccccctctactattcttcgcgtcctcaccgccgcctcctcgcccgcttcttctccgtcgcttcggcaccgggcggagcgaaagggcaccgaccggcggcctccgccgttgaggtgggcggcgtcaagatcgcgcgcgaggatgttgtgaaggaggatgatccgacaaacaacgtgcccgacaatatcttttcgaagatcggcctgcagctgcacaggagggataaccatcgccttgggattttgaagaacacaacccatgattactctgacaagaacttcactgggcagtttgacaagtttgatgaccttttgcctcttgtttctgtcaagcaagattttgatgatgccttggtccccttctgaacatgtaagctggagttacaacgacccatattatgttgatggtcaaacagtcttaaggggggataccaagtggctctcaaagctgaagctgctaagggctgggaaattaaccccttttctgggaacgggaaaagtgttaccccaagggaattcccttggttcaaactcaaaataccggtgtctccaaagaaaaggagggggtcccggt

SEQ ID NO: 70093 - protein, 139 aa, Zea mays
  misc_feature: Ceres CLONE 1549167
  misc_feature: SWISSPROT Homolog: EC 6.1.1.20 Phenylalanine--tRNA ligase
MATLPMALSPAAISPFTTLPLYYSSRPHRRLLARFFSVASAPGGAKGHRPAASAVEVGGVKIAREDVVKEDDPTNNVPDNIFSKIGLQLHRRDNHRLGILKNTTHDYSDKNFTGQFDKFDDLLPLVSVKQDFDDALVPF

SEQ ID NO: 70094 - DNA, 577 bp, Zea mays
  misc_feature: Ceres CLONE 1549169
  misc_feature: Encodes the peptide sequence at SEQ ID NO. 70095
ttgagctcctcgaggaggcttgcagctctagaactagtggatcccccgggctgcaggaattcgtctcacccctagaaaaaccgactcgtcgtcgtcggtcctctccccacattccttagctctgccctccgcccctcccaaatccattcactaccgccggcgccggatccaataggaggaggaggaagatgactgtgggcatgatcaacgcaaacccggtggtgcacgagcggccggagcgcgcctcgcacccccacgccgccgatgtgctcgaccctctcgatgtctttgatacggtgcgggacatcaaggacccggagcacccgtactccctggagcagctcagcgtgctgtcggaggagtccgtctccttgacgaaacgctcgaacgcctcccaaataaaccttcctccaatgggcaggcttcatatggccccctcatggggccgggcccgactaaatttagcaaatttcccccccttttagggtgaacaaaaatgggccccggaaccctgggtaatgaaaacccttaaaaacatttttacccaacagggagggggggccccccccttggaaaa

SEQ ID NO: 70095 - protein, 98 aa, Zea mays
  misc_feature: Ceres CLONE 1549169
MTVGMINANPVVHERPERASHPHAADVLDPLDVFDTVRDIKDPEHPYSLEQLSVLSEESVSLTKRSNASQINLPPMGRLHMAPSWGRARLNLANFPPF

SEQ ID NO: 70096 - DNA, 693 bp, Zea mays
  misc_feature: Ceres CLONE 1549170
  misc_feature: Encodes the peptide sequence at SEQ ID NO. 70097
  misc_feature (693)..(693): n is a, c, t, g, unknown, or other
ggagctcaccgcggtggcggccgctctagactagtggatcccccgggctgcaggaattcgtctcacccctcgaaagatgtcgcctccccccagcatcggagaacggagggacacagggagctccggtcgcctagaacgggatctctgaatagatcgatccgtccgtcgttgagcggacactgcaatggaagccctcgcctcgcgtggccgccgcaccgaaagcccccttctcgtttttctccttatttcgacccttttttgaatgacatggggcgcagatccgtgttcctgctaggaccagacttgagatctgagaccggaggtcccaattatgtcaatctcgtgcccgtatatgtggcagctggaggagatccggcaagagagagccgccgagaggatgcagcgcgccctcccgatcgcggcgtctcacgtcgactctcacgggaaccaaagagccggagctgagcttcttgctcgagttcgagaacttgaacatgggaacacggacttggtgagggaaaacaaaatgctctagtccgagattgatgactggggagtagacatagatgcccttgcaatctgttagcatgatcgcgagcgcagtgtaactccctctttgaagaagacttgaatgacattgctctggagacagagctgctgtagttgctaaggaggatgctctagctcaactan

SEQ ID NO: 70097 - protein, 67 aa, Zea mays
  misc_feature: Ceres CLONE 1549170
MSISCPYMWQLEEIRQERAAERMQRALPIAASHVDSHGNQRAGAELLARVRELEHGNTDLVRENKML

SEQ ID NO: 70098 - DNA, 725 bp, Zea mays
  misc_feature: Ceres CLONE 1549171
  misc_feature: Encodes the peptide sequence at SEQ ID NO. 70099
ctcaccgcggtggcggccgctctagaactagtggatcccccgggctgcaggatttcgtctcacccctagaaaggtgcctgcgccatgggggcctgtttggagaacctatcaacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttggtttcctccaccgatctgcatctactcttgattgtggactttgtcgcatctgatatcaacttcataaatctttatccaagatggcgctgcaaaacattggtgcttcaaacagggatgatgccttctacaggtacatgatgcccagaatgattaccaagatagaaggccgtggttatggtatcaagacaaatgttgtgaacatggttgacatagcaaaagcacttgccaggccagctttccttaccaacaagtactttggatgtgagcttggtgcacagtccaaatttgagagaagacaggaattcctttgttaacggggctcatgattctgcaaagttg

SEQ ID NO: 70099 - protein, 77 aa, Zea mays
  misc_feature: Ceres CLONE 1549171
  misc_feature (1)..(78): Pfam Name: eIF-5_eIF-2B Pfam Description: Domain found in IF2B/IF5
MALQNIGASNRDDAFYRYMMPRMITKIEGRGYGIKTNVVNMVDIAKALARPAFLTNKYFGCELGAQSKFERRQEFLC

SEQ ID NO: 70100 - DNA, 715 bp, Zea mays
  misc_feature: Ceres CLONE 1549175
  misc_feature: Encodes the peptide sequence at SEQ ID NO. 70101
cgttcaccatggtgatagccgctcttgcaacagtggatcccccgggctgcaggatttcgtctcacccctagaaaaaaccgcctctccaaaaaaaagcctaaaccctcctcgacgtcaccagcgtccgcccctatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccgcctgcatccgcgcgccagccgcgcgcgctgcgcctcttccgacacgacggccacgaagcaccgccgcccagcggaggagaacatccgcgaggaggcggcgcggctccgaggcccggcccagggtttctctgcgtggtacgagcccttcccgccggcgcccggcggcgacccgaacgagcgctactcgctggacgaggtcgtctaccgctccagctcggggggcctcctcgacgtgcgccacgacatggaggcgctggcccgctacccggggtcctactggcgtgacctcttcgactcccgcgtcgggcgcaccggcctggccctacgggtcgggcgtctggtcccaagaaggagttcgtgctccccgaaatcgactccgaacacatcggctccctctttgagggcaactcccac

SEQ ID NO: 70101 - protein, 173 aa, Zea mays
  misc_feature: Ceres CLONE 1549175
  misc_feature: SWISSPROT Homolog: EC 4.2.3.1 Threonine synthase
MATFTAASSLSLLFSHPHSHSRQPSAQGPTASSHLRLHPRASRARCASSDTTATKHRRPAEENIREEAARLRGPAQGFSAWYEPFPPAPGGDPNERYSLDEVVYRSSSGGLLDVRHDMEALARYPGSYWRDLFDSRVGRTGLALRVGRLVPRRSSCSPKSTPNTSAPSLRATP

SEQ ID NO: 70102 - DNA, 726 bp, Zea mays
  misc_feature: Ceres CLONE 1549177
  misc_feature: Encodes the peptide sequence at SEQ ID NO. 70103
  misc_feature (348)..(348): n is a, c, t, g, unknown, or other
  misc_feature (404)..(404): n is a, c, t, g, unknown, or other
aacactggagctcaccgcggtggcggccgctctagaactagtggatcccccgggctgcaggaattcgtctcacccctagaaaaagcctaccccgtccctccccaagcgcgccgtctagggtttcacagccgtgccccgatccattcgagcgccccgcaccgccgccatggagtttgacgaatacgagtacttggagaaggcggtagagcccgctcccccacaggccaatggttccggctccggctccggcgagaaggaccgcggctcgcgccgccgcgagggcggcaaggaccgcatatcgaagcgctctcgctcgggggaggaccgcgaccgggacaggcaccgcancggccgggatctacgtcacccctacggggagggggggggggaggatatgatccccnaaatcccccccaagacagggacagggaagggacataacgggagaaggaaggggttacaggccccgtttgaaaaaaaaggaaattgaacggggaccccagagcctgagcctccttaaaccggcccttgccgaagaaaaagaaatggttagtgaccttgggccgggcccccacccccaacaacgaaattttttatgcaaccgggtgccggaattgtatcctaatacaccctcttcgaaagtttcttcaattggccctgctcacattttcggcgggggagtctgcgcgcctaactcgaaattgacccaaatgctctgtgtctttg

SEQ ID NO: 70103 - protein, 107 aa, Zea mays
  misc_feature: Ceres CLONE 1549177
  misc_feature (61)..(61): Xaa is any aa, unknown, or other
  misc_feature (80)..(80): Xaa is any aa, unknown, or other
MEFDEYEYLEKAVEPAPPQANGSGSGSGEKDRGSRRREGGKDRISKRSRSGEDRDRDRHRXGRDLRHPYGEGGGEDMIPXIPPKTGTGKGHNGRRKGLQAPFEKKGN

SEQ ID NO: 70104 - DNA, 668 bp, Zea mays
  misc_feature: Ceres CLONE 1549182
  misc_feature: Encodes the peptide sequence at SEQ ID NO. 70105
aaagctggagctccccgcggtggcggccgctctagaactagtggatcccccgggctgcaggaattcgtctcacccctagaaaaagccactgctaactagctaatctagcagtcagcataggagactggttggagagaagagaacctcagtgcgcgaaaaaagaactcaagcctcaaggagggtatacgccgccgcgccgagtcgtccacgtccgaggaggaacgcacgcgctcacgcggcgccgatggatggaagcggtgccggcaccggcagcgccacgctgctgcggaagcggccgctgtccgtgaacacagcgtcgtcgacggcggcggcgattgagctcgggagcaagcaggccgccggggttgtggcggccatcgaggaggagccggtgagcccgacggggcggctgttccgggagccgaacttccgctgccacatcgtgtccgtgttcggcctcggcgcgccggtggacctgccggcgctgcgggccggggtcgccgccacgctcgcgcgccaccctcgcttctgcagcgtccaggtggtaaatgagaaggacgcgagaccgaagtggatacggacagcggtaaacgtggacgaccacatcatcgtccccgagctaaaccccgccaccacgtcggccgacccggacaaggcgctgggaggac

SEQ ID NO: 70105 - protein, 141 aa, Zea mays
  misc_feature: Ceres CLONE 1549182
MDGSGAGTGSATLLRKRPLSVNTASSTAAAIELGSKQAAGVVAAIEEEPVSPTGRLFREPNFRCHIVSVFGLGAPVDLPALRAGVAATLARHPRFCSVQVVNEKDARPKWIRTAVNVDDHIIVPELNPATTSADPDKALGG

SEQ ID NO: 70106 - DNA, 624 bp, Zea mays
  misc_feature: Ceres CLONE 1549184
  misc_feature (48)..(48): n is a, c, t, g, unknown, or other
  misc_feature (102)..(102): n is a, c, t, g, unknown, or other
  misc_feature (226)..(226): n is a, c, t, g, unknown, or other
  misc_feature (231)..(231): n is a, c, t, g, unknown, or other
  misc_feature (233)..(233): n is a, c, t, g, unknown, or other
  misc_feature (239)..(239): n is a, c, t, g, unknown, or other
  misc_feature (241)..(241): n is a, c, t, g, unknown, or other
  misc_feature (243)..(243): n is a, c, t, g, unknown, or other
  misc_feature (244)..(244): n is a, c, t, g, unknown, or other
  misc_feature (246)..(246): n is a, c, t, g, unknown, or other
  misc_feature (248)..(248): n is a, c, t, g, unknown, or other
  misc_feature (249)..(249): n is a, c, t, g, unknown, or other
  misc_feature (255)..(255): n is a, c, t, g, unknown, or other
  misc_feature (259)..(259): n is a, c, t, g, unknown, or other
  misc_feature (260)..(260): n is a, c, t, g, unknown, or other
  misc_feature (313)..(313): n is a, c, t, g, unknown, or other
  misc_feature (338)..(338): n is a, c, t, g, unknown, or other
  misc_feature (361)..(361): n is a, c, t, g, unknown, or other
  misc_feature (362)..(362): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (476)..(476): n is a, c, t, g, unknown, or other
  misc_feature (482)..(482): n is a, c, t, g, unknown, or other
  misc_feature (497)..(497): n is a, c, t, g, unknown, or other
  misc_feature (499)..(499): n is a, c, t, g, unknown, or other
  misc_feature (500)..(500): n is a, c, t, g, unknown, or other
  misc_feature (502)..(502): n is a, c, t, g, unknown, or other
  misc_feature (506)..(506): n is a, c, t, g, unknown, or other
  misc_feature (508)..(508): n is a, c, t, g, unknown, or other
  misc_feature (509)..(509): n is a, c, t, g, unknown, or other
  misc_feature (512)..(512): n is a, c, t, g, unknown, or other
  misc_feature (516)..(516): n is a, c, t, g, unknown, or other
  misc_feature (519)..(519): n is a, c, t, g, unknown, or other
  misc_feature (526)..(526): n is a, c, t, g, unknown, or other
  misc_feature (538)..(538): n is a, c, t, g, unknown, or other
  misc_feature (559)..(559): n is a, c, t, g, unknown, or other
  misc_feature (563)..(563): n is a, c, t, g, unknown, or other
  misc_feature (574)..(574): n is a, c, t, g, unknown, or other
  misc_feature (589)..(589): n is a, c, t, g, unknown, or other
  misc_feature (590)..(590): n is a, c, t, g, unknown, or other
  misc_feature (593)..(593): n is a, c, t, g, unknown, or other
  misc_feature (622)..(622): n is a, c, t, g, unknown, or other
tggagctccaccgcggtggcggccgctctagaactagtggatcccccngggctgcaggaattcgtctcacccctagaaaaaaaaaaaaaaaaccctgcactngcgtgcgctccatgtgactctcacttatttctcctgtcagcgcagcagcagcagcagcagcctactactactactactgcttttaccggccggtggatcggatcaccaaaccggaacgacagcngatgngnatggcncngnngngnnaaccgnttgnngggcgggcggcgagccagtggcggccgtggcgctgtacgtggccctggttctnggcggatgtcgcgcggggctcagcnggggccgcggggtgtggcccgcnntgctcggcagccctgcccgggggcttcgtgcaaccacgcccgagggacatggcaccaaagtggaaatcgccgccaaaccttggggccccgnnnggcggggggggggnnnnggcncccccnccccccccccccccncnncnctcncnncgntccncgntccgttntcccctctcacnaacaaaaaaaaaaaacatccncctnccgcgcggggngggaaacccgacccnntcntctttctctttgcccccgccctccccgcncc

SEQ ID NO: 70107 - DNA, 606 bp, Zea mays
  misc_feature: Ceres CLONE 1549192
  misc_feature: SWISSPROT Homolog: EC 2.4.1.14 Sucrose-phosphate synthase
ggagctccccgcggtggcggccgctctagaactagtggatcccccgggctgcaggaattcgtctcacccctagaaaatgttcatttttctttatgaatttggtcaaaactagataagtttgacttacgacaaagctaaaaaagatttagcattttaggaatggagtgagttttattttatcaaaatttaatatcagtatcaggtcgtgtgtgttggtgactaccttttgttttatcttatgtgttatctggagaactttggtgtttgctagtataaattcatttttatctcaagaaatctaatgattgactcttgactttcacaactcatgtttatttgagtttcaattattttcagggagtttttatcaattgtgcattggttgaaccatttggactcaccttgattgaggctgctgcatatggtctacccatggttgccacccgaaatggtgggcctgtggacatacatcgggttcttgataatggaattcttgttgacccccacaatcaaaatgaaatagctgaagcactttataagcttgtgtcagataagcacttgtggtcacaatgtcgccagaatggtctgaaaaacatccataaattt

SEQ ID NO: 70108 - DNA, 852 bp, Zea mays
  misc_feature: Ceres CLONE 1549197-R
  misc_feature (1)..(1): n is a, c, t, g, unknown, or other
ncccaattgggtacctcgagcgtctcgtttttttttttttttttagctgttggtcaaagaaagctctgaaaaaaaggacaattatgctgctgatctggttgtgaggaccctgcatttaagcactctatcttggacgtaaaaccccggcatcaccatgatcttcacttgacaaggaccctgcacctgctgcctgtcatgtaggatgtcttccatgtacatctcatcaaatgcgcggccgtcttggacgcgcaggatcgtcagcggcgggccgaaggagaaggccagcagatggagcagccagacgcacttggtggcgacgaagaagctctgcagcagctgctcgggccacggccgggaccagccaagcgtcgccacgacgccgctcatcttccggtcgcagaaacggctgaagtcctcgctgtagtacttggtacccttccgcagaacctcgttccagctaaggttgcgcagcgccacgaaggcggcgaagctctgctggcggtcctccgctgggtcgaggcaccttggcgatccgttccgctggaacgcggggttctcgaagtcctggaacatggcctggttcatgatcgcctcgagatggtacagcgtggccttcgagcagtgcttgccagtgctgccgctgagcgcgagctggtacgggcgcaggagcaggttcagcctgtcggacaggccgtcacaggattcttcgttcccctgctggatcagcgccttgcagagctgcttcaccgagaagcgtgcctccgacgcgaactgcaaaaagcttctacccttacctcgtggctcaccggcgtcgggaactctcgtctttgcttgaacggatctcgtcaattt

SEQ ID NO: 70109 - DNA, 520 bp, Zea mays
  misc_feature: Ceres CLONE 1549201
  misc_feature (202)..(202): n is a, c, t, g, unknown, or other
  misc_feature (320)..(320): n is a, c, t, g, unknown, or other
  misc_feature (321)..(321): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
ggagctccccgcggtggcggccgctctagaactagtggatcccccggggctgcaggaattcgtctcacccctagaaaaacccgcgaagccgctcaaacacgaccacctatccgcgagaagcctcttcctccctcgctctccctcagcggcgcgactgccaatgagccgcgtggtcgaagcgcaacgccgacggaaagaaggnaggcacaacacccaggccccctggggccttcgccggttcggtggcccggggcaaagattggaaaaccccccggaatttccgaaaagggggggcctaccccaattttcacaaatttttnnaaannnncggggggggggggggggagcacacttttctcctggggcccccccccccccggggggcccctnnnnttcacttctttttttcccccaggggaaaaaaaagggaggccgggggggggtggtttttttttataaaaaggggcgccctttcgggagaaaaaaaacccccccaaaaaaaaaaagtccctccccccct

SEQ ID NO: 70110 - DNA, 659 bp, Zea mays
  misc_feature: Ceres CLONE 1549202
  misc_feature: Encodes the peptide sequence at SEQ ID NO. 70111
ctccccgcggtggcggccgctctagaactagtggatcccccgggctgcaggaattcgtctcacccctagaaaaaatcctccaccacaccacacgcgccgcaaagcagagcacgggggcctgagagcagagcgccatcagccatcctttgcctgcccaagcagcaagcagcagcagcaacggcggctggcccgatggctctgtctctctccggcacctccgcccgcttcgccctcgcgtcgctggtcccccgggccagggcctacgcggcgtcggcggcgtccggggccatgaggcgcgcggcggagggcgcggccgcgggcgaggccaaggaggccgggcgcgccgccgccgccgctgccgagggctcgtgggtgcccgaccccgtcacgggccactaccgccccgccaactgggccgccgccgtcgaccccgccgacctccgcgccgctcacctcgcccgcacctacgtccgggcctgagcggccccggctcccttcaccctgctccgcctcgtctcgtatgacatacgcgcaccgtacgtaccagggtgagacgaggtgaggggtcggggttcgtgtggcgaacggcgtgttgagccacgcgcgcgtgcgcccgcgctctgtgacgcccggaacgttcttgggagagcgcgagcgag

SEQ ID NO: 70111 - protein, 95 aa, Zea mays
  misc_feature: Ceres CLONE 1549202
  misc_feature (1)..(89): Pfam Name: LEA_3 Pfam Description: Late embryogenesis abundant protein
MALSLSGTSARFALASLVPRARAYAASAASGAMRRAAEGAAAGEAKEAGRAAAAAAEGSWVPDPVTGHYRPANWAAAVDPADLRAAHLARTYVRA

SEQ ID NO: 70112 - DNA, 532 bp, Zea mays
  misc_feature: Ceres CLONE 1549206
  misc_feature (202)..(202): n is a, c, t, g, unknown, or other
  misc_feature (209)..(209): n is a, c, t, g, unknown, or other
  misc_feature (216)..(216): n is a, c, t, g, unknown, or other
  misc_feature (230)..(230): n is a, c, t, g, unknown, or other
  misc_feature (317)..(317): n is a, c, t, g, unknown, or other
tggagctccccgcggtggcggccgctctagaactagtggatcccccgggctgcaggaattcgtctcacccctagaaaaaattgcattgtgcattgcattgcataaacctctcgtgggaagtgcaaacaccaaatccgcaatctatctatctatcagccattcaggcctgcaggctgcagctctctccactgcacactagagncgagctngccacangacaaggggacacnaatggccaccccatacccaagagaggcgagcatctcctggtcctccctaaatggtcgcaatggggctgccacgccgccaccgcccgncgggggaccgtccccttttacccgttcgggggaaatccccccccccccccccccccaagtgaaaaggggaacccctttttaccccgggaaagattcttccctgttgtaaaaaacctcccgggggaaaaaacccccggggggggtcttcttaaaaaaaaaaaaaaccccccccccccccccggagaaaaaataattttttttggggggggcggggg

SEQ ID NO: 70113 - DNA, 633 bp, Zea mays
  misc_feature: Ceres CLONE 1549210
  misc_feature: Translation starting site: 321
  misc_feature: SWISSPROT Homolog: EC 1.1.1.86 Ketol-acid reductoisomerase
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (420)..(420): n is a, c, t, g, unknown, or other
  misc_feature (421)..(421): n is a, c, t, g, unknown, or other
  misc_feature (430)..(430): n is a, c, t, g, unknown, or other
  misc_feature (445)..(445): n is a, c, t, g, unknown, or other
ggagctccccgcggtggcggccgctctagaactagtggatcccccgggctgcaggaattcgtctcacccctagaaaaactctctttccagccacctcactcttcactagcctctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccgccatgccgtcgctcgacttcgagacctccgtcttcaagaaggaaaaggtgtccctggccggccatgaggagtatattgtaggggtnnnggaaaagaaatctnnttcccgctngttacccggaggccnttcaagggaatcaaacagatcggtgtaatcggctggggctcgcagggtcctgcgcaagctcagaacttgagagactcacttgttgaggcaaagtcagatattgttgttaagattggtctccggaaaagttctaaatcttttgaagaagcccgagcagcaggatcaccgaagagagtgggacgctgggt

SEQ ID NO: 70114 - DNA, 861 bp, Zea mays
  misc_feature: Ceres CLONE 1549221-R
  misc_feature: Pfam Name: AIRC Pfam Description: AIR carboxylase
  misc_feature: SWISSPROT Homolog: EC 4.1.1.21 Phosphoribosylaminoimidazole carboxylase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
nnncaattgggtacctcgagcgtctcgtttttttttttttttttatttggaacggagggaatatgtaaaattacttgactcaaagcaccttgtgcggctgaaaaatccaggcatgttttttacgttactcgaaccgttttatttttcgtacgtacaacgtttactcccattcttttttccccctctaaacccaaaattcataccctatattagaagggaaaagggcatgttgagatgggttaagatagtacaattatcaaaaaagaattgtaaggaaaatcgaatgcagccgagcctattaaagtatcttcttgatgactccccatcttaaaccataatcgagtggacagtgagttatcgccgacccatacactcgtattcctcccaggccccagagccagggcttcaaaaggggtcaatccattcccttcagaaattcctccgggccttggtcctccagcctttctgccgtctccaaaaccatgtccctcagatcatcctggtacttagttaccctgtcctggagctcaggatctcttgcagccagaatcctagctgccagcaaacctgcattttctgcattcccgatagcaacagtcgcaacaggaataccttttggcatttgcacaatagataggaggggatcaaatcctgatagtgttgaagtcttaatggggactccgattacaggaagaggagtcaatgaaagccccattcctgggtaaatgagctgctccgcctgcaccggcaattatggacctcaaaaaccctgtcttttagcagactttcggataaacataacatccgctccgggggttacaaagggcacgaaaacaatagttatctccccaaggggatgtc

SEQ ID NO: 70115 - DNA, 660 bp, Zea mays
  misc_feature: Ceres CLONE 1549226
  misc_feature: Encodes the peptide sequence at SEQ ID NO. 70116
  misc_feature (627)..(627): n is a, c, t, g, unknown, or other
  misc_feature (650)..(650): n is a, c, t, g, unknown, or other
  misc_feature (651)..(651): n is a, c, t, g, unknown, or other
agctccccgcggtggcggccgctctagaactagtggatcccccgggctgcaggaattcgtctcacccctagaaaaagcctctcatccctcccgttgcggccgaccatcaccaacggaagtcggcagagtgagccaaggccctgtgtgtgtgtgtgtctgccacattacctacccagatcgaaatggcgcggtgcccagctgctcatgccgctctctgctcccttgctctgctcctcctgcttccagctgcgcgggcggcgacgttcaccatgaccaacaactgcggctacacggtgtggccggggctgctgtcgggcgccggcacggcgccgctgcccacgacggggttctcgctggcccacggcgcgtggggggcgggggacccccccccgggctgttcggccccttgtgggcccccaccctctgggcccgggacgcgcccccggaaggttccccgggccacgggggaattggcggtcgggaaccctccaaggcaaagggggggggccccccccccccccccccctgggggatttcccctcgggggaaacccggggccttgaattttttaaatcccccctgggggggggtaaaactcccgaaggcttttgttcccccgaaaggggngtgggggtgggggcaacacaaannaagacaagg

SEQ ID NO: 70116 - protein, 126 aa, Zea mays
  misc_feature: Ceres CLONE 1549226
MARCPAAHAALCSLALLLLLPAARAATFTMTNNCGYTVWPGLLSGAGTAPLPTTGFSLAHGAWGAGDPPPGCSAPCGPPPSGPGTRPRKVPRATGELAVGNPPRQRGGAPPPPPPGGFPLGGNPGP

SEQ ID NO: 70117 - DNA, 682 bp, Zea mays
  misc_feature: Ceres CLONE 1549227
  misc_feature: Encodes the peptide sequence at SEQ ID NO. 70118
  misc_feature (629)..(629): n is a, c, t, g, unknown, or other
ctccccgcggtggcggccgctctagaactagtggatcccccgggctgcaggaattcgtctcacccctagaaaaaaaaaaatggggtgtggaaattgaaaggaggcaaaggggctaccctagagatcctgctgcttgtggtggaggatggtcaggaggaaggatgcccgctcagtgaagatcaagaggagtaaggatgttgtcaagttcaaggtgcgctgctccaagtacttgtacacgctctgcgtcttcgatgctgagaaggcaaacaagttgaagcaatctcttcccccaggtttgaccgtcgaggaggtctgattggatacatggcaacgccgagttgaactacccaagcttctttatcagtagcagagcatgctactctatgtacttttggaacctaagctattagacctgtcagtgttggatgtctggatcttgcatttttggagaaataccaatttacctcgttcaaggatgcaaaaaaaaaaaaaaaatcctgtcgtgggatcccagccaccgccgctagaagaagagctcggcgattcccaggtcccgcgagaatatgccgaagcagatccctgagattaaggacttcctcctcaccgcgagaaggaaggatgcccgctcngtggagatcaagaggattagggatgttgtcaagttccaggggcgctgctccaa

SEQ ID NO: 70118 - protein, 56 aa, Zea mays
  misc_feature: Ceres CLONE 1549227
  misc_feature (1)..(56): Pfam Name: Ribosomal_L38e Pfam Description: Ribosomal L38e protein family
MVRRKDARSVKIKRSKDVVKFKVRCSKYLYTLCVFDAEKANKLKQSLPPGLTVEEV

SEQ ID NO: 70119 - DNA, 660 bp, Zea mays
  misc_feature: Ceres CLONE 1549231
  misc_feature: Encodes the peptide sequence at SEQ ID NO. 70120
  misc_feature (545)..(545): n is a, c, t, g, unknown, or other
ctccccgcggtggcggccgctctagaactagtggatcccccgggctgcaggaattcgtctcacccctagaaaaactccgcctctcttccccacgccgccacagcttcccgcactccaaggcgcagcaccaaccaaccgcacccccgcgggagctggcgtgagcaggtctgcgtgcgtgtcgctatcttccccccatggcgtgggtgatgcaccggtccagctcggacggcgggtcgagcagcgggtggtcggacgccgcggcggccgtggtggcggcggcggaggagcgggccgggtgggaggtgcggccgagcgggatggtcgtgcaggcgcgggacgacgcggcggggtccggcggcgccccgccgaggccgccgccgccgccggagatcaaggtgcgcgtcaagtacggcggcgcgcggcacgaggtgtccgtgtcccccattgccacgtttcggcagctgaagaagctgctggcgcccaagacggggctgcagccgggcggaccagcagctgagctaccggggcagggcgcggggcaaccnccaaataccctggacgcctgcgggggtcaagaacaagtccaaaggtggcgctccgcccaagaaccccccccggcgtcgaagcgccgttaatttgaagcgccaaaaggaaccccgg

SEQ ID NO: 70120 - protein, 146 aa, Zea mays
  misc_feature: Ceres CLONE 1549231
MAWVMHRSSSDGGSSSGWSDAAAAVVAAAEERAGWEVRPSGMVVQARDDAAGSGGAPPRPPPPPEIKVRVKYGGARHEVSVSPIATFRQLKKLLAPKTGLQPGGPAAELPGQGAGQPPNTLDACGGQEQVQRWRSAQEPPPASKRR

SEQ ID NO: 70121 - DNA, 651 bp, Zea mays
  misc_feature: Ceres CLONE 1549235
  misc_feature: Encodes the peptide sequence at SEQ ID NO. 70122
  misc_feature (464)..(464): n is a, c, t, g, unknown, or other
ggagctccccgcggtggcggccgctctagaactagtggatcccccgggctgcaggaattcgtctcacccctagaaaaaacttcgccgcccccctcccgcctcccgctgttctctgcctcccacccccacgccgccgtcccatcaccgccgctgggatgaagaaccctgacttcgccgcagacaaagcgctcgccaaggacttcctgtccaatttcaccggccctcacggcgagcccaagtacctgaacatcctgcaagatgtcgcgaacaggaagatacgcgcggtccagatcgagctggacgacctattccactataaggatgtcgacgaggagttcttgcagcgtgtcaccgagaacacgcggcgctacatcggcatcttcgcggaggccatggacgagatcatgccggagcccacagaagcgtacaacgtcgacgaagaccaagacatcctgatgacccancgtgtggaattaaggggcccaacgccgcgccgacggcaccgacccgctacagaaaatgcccacagagatcaaaccgttccttggaagtttacatcaaagcattctccaagggtgactccctccacatttcggcaagtgaaagcatccacattgggtcagcttgtgaaataatctgggattggtactc

SEQ ID NO: 70122 - protein, 159 aa, Zea mays
  misc_feature: Ceres CLONE 1549235
  misc_feature (103)..(103): Xaa is any aa, unknown, or other
MKNPDFAADKALAKDFLSNFTGPHGEPKYLNILQDVANRKIRAVQIELDDLFHYKDVDEEFLQRVTENTRRYIGIFAEAMDEIMPEPTEAYNVDEDQDILMTXRVELRGPTPRRRHRPATENAHRDQTVPWKFTSKHSPRVTPSTFRQVKASTLGQLVK

SEQ ID NO: 70123 - DNA, 683 bp, Zea mays
  misc_feature: Ceres CLONE 1549238
  misc_feature: Encodes the peptide sequence at SEQ ID NO. 70124
  misc_feature (503)..(503): n is a, c, t, g, unknown, or other
  misc_feature (506)..(506): n is a, c, t, g, unknown, or other
tccccgcggtggcggccgctctagaactagtggatcccccgggctgcaggaattcgtctcacccctagaaaaacccatcctctctaacccacggaagcaaggcaaaaaagctcgtgctggacgacatctcccctgtcgatccacgaccatgatgcagcagctccgtcacagccagccgagcccgtgcctctgcggcctgcgggcggcacggcctatgctcgcgctcggcgcagcagcatcccgttcgcggcccgccggaaaactgcaaccgagcgcctgcctcggcctcggccatgtagccccagccgcggcgagaggacagccccgtccccgtgccgttgccgactcggcgctgggagcatcgcctacgagcgtgcatgtcggaggcaagctgctgctgcagaacttcgccgccgacagccagcagcggctcaagctctccatccagcttgtcagcgccaccgtgggcgatccccacgggcgcggggtgaagggcgggagcntcngtgctgggacgccgtcgtgggcagccgggacagcggagctcgacgtgggactgatctgggaaaagggcgctgggcgcgcccggccccgttgggggggtgaaaaaaccactccgacttccccccggtgtacttgaagcttgctgaacggcccggccccgggggtttggggggggcccc

SEQ ID NO: 70124 - protein, 163 aa, Zea mays
  misc_feature: Ceres CLONE 1549238
  misc_feature (119)..(119): Xaa is any aa, unknown, or other
  misc_feature (120)..(120): Xaa is any aa, unknown, or other
MMQQLRHSQPSPCLCGLRAARPMLALGAAASRSRPAGKLQPSACLGLGHVAPAAARGQPRPRAVADSALGASPTSVHVGGKLLLQNFAADSQQRLKLSIQLVSATVGDPHGRGVKGGSXXAGTPSWAAGTAELDVGLIWEKGAGRARPRWGGEKTTPTSPRCT

SEQ ID NO: 70125 - DNA, 673 bp, Zea mays
  misc_feature: Ceres CLONE 1549239
  misc_feature: Encodes the peptide sequence at SEQ ID NO. 70126
ggagctccccgcggtggcggccgctctagaactagtggatcccccgggctgcaggaattcgtctcacccctagaaaaagtgtgaaccccgtcgcgccccacggatggtataagaataaaggcattccgcgtgcaggattcacccgttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatggcggcgtcagtttccagggacatctgcgttcagaagccgggctcaaaatgcaccagggacagggaagcgacctcctcgcccgccgatcggtcgcagcgccgaagcccccccacgccaaagccgcggcgtcatccgttccgactcggggcgggaaggggccagatttccccccccttagggccttctttaacccccgccaatacaaaaacaaaaaaaggggttcccccttcgaaagggcaaaaggagggccaaaaacccttgaagaaccttttggggcgaagaggcccaaacccgggggaagagggaaaaaacggggttc

SEQ ID NO: 70126 - protein, 107 aa, Zea mays
  misc_feature: Ceres CLONE 1549239
  misc_feature: SWISSPROT Homolog: EC 2.7.9.1 Pyruvate, phosphate dikinase
MAASVSRDICVQKPGSKCTRDREATSSPADRSQRRSPPTPKPRRHPFRLGAGRGQISPPLGPSLTPANTKTKKGVPPSKGQKEGQKPLKNLLGRRGPNPGEEGKNGV

SEQ ID NO: 70127 - DNA, 682 bp, Zea mays
  misc_feature: Ceres CLONE 1549240
  misc_feature: Encodes the peptide sequence at SEQ ID NO. 70128
ctccccgcggtggcggccgctctagaactagtggatcccccgggctgcaggaattcgtctcacccctagaaaaacccggcggccactcctctatcggtgacgcacgcacccccgacctctgatgtgatctctccccctggatctcgacctccgcctggctgctcggctctgcgtgggtcgccatggcgtcctcaacggggagcttggagcacggaaggttcactttcacgccgcctcccttcataacctcgttcacagagctgctctctggggcagctgcgaacatggtaggagccgcgcgcgccgatcatcaggagcggtcgccgagggggctgttccaccgcggctccacaaggggcgggggcgtaggggtgcccaaatcaaggcccgagcagccgcccagcctgccaatctcgccgccgccgatgtcggcctgcatctatttctccatcccgcccggtttcagccctcccgaattgatggactggccccacctggctcccctcttcctcgaatttcgtgagggtggccaaccaacgggcgccttcctcgggcagaggttccaactgtgaggggggccgccaacctgttcgcgtataaagcttcggcaaaactaaaacccgggctgggcgtccggaacccgccttaaaataacttttcctttccacggggcgccccgtgg

SEQ ID NO: 70128 - protein, 129 aa, Zea mays
  misc_feature: Ceres CLONE 1549240
MASSTGSLEHGRFTFTPPPFITSFTELLSGAAANMVGAARADHQERSPRGLFHRGSTRGGGVGVPKSRPEQPPSLPISPPPMSACIYFSIPPGFSPPELMDWPHLAPLFLEFREGGQPTGAFLGQRFQL

SEQ ID NO: 70129 - DNA, 670 bp, Zea mays
  misc_feature: Ceres CLONE 1549242
  misc_feature: Encodes the peptide sequence at SEQ ID NO. 70130
tggagctccccgcggtggcggccgctctagaactagtggatcccccgggctgcaggaattcgtctcacccctagaaaaaacccggctacatggcggccgcctccaccctcgcgttcgggcacccaaaaaccctagccgccgccggcgccaagcccctgcccgccgccacctccacgtccgtctccttcccggccacccaccagcccgcgtgcctgctctcctcgcccgcgcccgggtctctgcgccgccgggacgtcgccgccatggtctccgcgccgccggccgtcggcaccgccatgccgtcgctcgacttcgacacctccgtcttcaacaaggagaaggtctccctcgccggccacgacgagtacatcgtgcgcggcgggaggaacctgttcccgctgctttcggaggcgttcaagggggtcaagcagatcggagtcattggatggggctcgcagggtcctgcccaagcccagaacctgagagattcactggctgatgccaagtcagatatttgtgtgaaaaatggtccccggaaaggatccaaatcttttgaggaagcacgtgccgcttgattcacccgaagaaaggcgaaccttgggcgaaatttgggaaaccgtctcccggcagcaaatcttggggtgctgccgaataaccaaagcgtgcaagg

SEQ ID NO: 70130 - protein, 161 aa, Zea mays
  misc_feature: Ceres CLONE 1549242
  misc_feature: SWISSPROT Homolog: EC 1.1.1.86 Ketol-acid reductoisomerase
MAAASTLAFGHPKTLAAAGAKPLPAATSTSVSFPATHQPACLLSSPAPGSLRRRDVAAMVSAPPAVGTAMPSLDFDTSVFNKEKVSLAGHDEYIVRGGRNLFPLLSEAFKGVKQIGVIGWGSQGPAQAQNLRDSLADAKSDICVKNGPRKGSKSFEEARAA

SEQ ID NO: 70131 - DNA, 682 bp, Zea mays
  misc_feature: Ceres CLONE 1549246
  misc_feature: Encodes the peptide sequence at SEQ ID NO. 70132
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
agctccccgcggtggcggccgctctagaactagtggatcccccgggctgcaggaattcgtctcacccctagaaaaaactttggtggtggtgcggtggtaccgctactctgctccccgagttccatccttcctcacgaggagggcgggcgttgccgttgccgttgccgttgcctgcccgtgtgcttggcgattcgggggcttgggctcggatctgcgtgtgcctgcctccggacccgcccgaggctcggggcgcctgatttggggccgggtcaggcagatctggagggcacatgagaataaggcggcggcggtggagtagcgggagctatgcggtgcttctgcgaaggacttgagccggcctgggaaggtgatcctggaggaggttgcggcggctgcaacggcggagggaaggctggaggatgtcgtagcggtcgtggcgccgctcgcggctccgcctgcgccgacgtttagccccgctgcggcggagctcacgctgatcgccgcggcggtcgtgggagccatgggagggggtctccgtgcccccggtcaggacggcctccgcggcggacacaccctttnnnnccccccgaaagggaaagggggggacacccttctctggcccgggagcccgtgctcggtgggcagcgactgcagcagcgtggccagcgctgacttcgagggg

SEQ ID NO: 70132 - protein, 54 aa, Zea mays
  misc_feature: Ceres CLONE 1549246
  misc_feature (20)..(20): Xaa is any aa, unknown, or other
  misc_feature (21)..(21): Xaa is any aa, unknown, or other
MGGGLRAPGQDGLRGGHTLXXPPKGKGGDTLLWPGSPCSVGSDCSSVASADFEG

SEQ ID NO: 70133 - DNA, 691 bp, Zea mays
  misc_feature: Ceres CLONE 1549249
  misc_feature: Encodes the peptide sequence at SEQ ID NO. 70134
tccccgcggtggcggccgctctagaactagtggatcccccgggctgcaggaattcgtctcacccctagaaaaacagcccctcccaggctccgaatcggcggccacttctcattcctcacttccgtcctcgcgcaccaccccctccatccgttccggatggtgccttcgaaatcccgtccggcgccctagcgtagctcgggctcggccaggctccgggcccgccgcgccgttccgcagtccagctccacctccagatcttttcttgagtttaaggaagatgcttgcctttatttagaaggccctttttggtacgtcagcagtgttctttcctataggagtaaatgccattccgtaacatcgtgcgtgatgtaagggatgggttcgggagcttgcctaccacgggatgtgagggcaggtttctgagtcatcgcaaagggaaatctcatggtgctgtccatgaactgcacaacccagtgcttgggggtacagagtaagctggcttgggcttaccttggcctcctgatttaccttcgagaagtgaattcgagaagtttggaaaacccgttgagggatacatgggcccttcttaagaaaaacatgtaggttggcttggtggcaagctgttctggacaaaaaaattgggagaaaaagatttcgtaacaagagatattggttaagaagcccccaggag

SEQ ID NO: 70134 - protein, 50 aa, Zea mays
  misc_feature: Ceres CLONE 1549249
MPFRNIVRDVRDGFGSLPTTGCEGRFLSHRKGKSHGAVHELHNPVLGGTE

SEQ ID NO: 70135 - DNA, 2306 bp, Zea mays
  misc_feature: Ceres CLONE 1549251
  misc_feature: Encodes the peptide sequence at SEQ ID NO. 70136
agccactgtccatccacgcgaccacacccccgcaactgcagatccccaattcgtttatttcttcccaccgagccaagctgcgacgacggcggtcgcagcgtcgccttccctccctccgtaccgccgacgccgacgagcatattgggccgagcgcccgagcacctctcctgtcagcagcggtactcgccattccaagtacgaggtcgacgcgctgtggggcttgctgaaacaggtacacgttctgccacccgtctctcgctccttgctgaatgctgattgagacggtaacacaatcagcggttcagtttaggcgcggcgacgtgtgtgcttgctaacctgaaccaaaccttatgaattacaggggatatattatatcctgtgcaattactcatttgatgcaagcaagcgtgcaatcaaaccattcagaacatcccgtctagatccaaccctttcatatggaaggggttaaatgtaaaacaggtactaggtttcatgtggacgagattaaatctaaaatagcggttaccgtcggattttgattggatgcgctagatcgcttgattgcacgcctgcaccaacatgagtaattatagcactcaatttaaaaccaacagagatgagggtttgaaacaaagtgtcagtattacctgataaaggtatatgtcattggcatgcacattttctctagagaatttcttgcgtctcttccatttggcctgccttcgagtgattttagtgtagctatacagtctggccatatgtattatgcactagttaggtgagtttaagtcaactgcacaatctttcttttactcctaaaagccttgtaacaaggatgcactggtaagtgatattgttgtatagaacagaacataattgtcaggtatatgtaactcatatttgaagctacccaagatgacgagacttctttaattattttattattgtaggtggtttgaatgctttccacttgctaactatgttcagtttttttaaataacacgagaaacaaaaaatatggctccacatcttagcctgttgtcttatattgtttgagtatcaccattacatcgttcattaagttagtgtctgcgaagaggacaatgtttcttttgtactatgtttggttgagtatcttatgcagccatgctttaattttaataaaacttgcttagtggtgtgcagcgaaacttggccatctttagttcctttgcttgctccggctgttgcttatctagcctagccaagagaatgctttgattaactgtttcagttatgtgttctatgatttcaaaacaaaagaagcaaacaactagtggcccctaacatgtttgcatcagcctctcctcatgtgggctagttgttcctttcctagcgacataaggtctacccccaagtgaaatcagggtcttcaagatagcttactgagatgtggggttttgcatcaaacgcttgggcagctgggctggagaagaggagttttccaaaccgcacatcctcgagtgctgcttattctgacgacgaggcatcctcctgcacaagcagggaagaaggcctggagtgcccgatatgttgggagtctttcaacatagtggagaatgtgccttatgcgctatggtgcggacacaccatgtgcaagaactgcatcctagggcttcaatgggccgtcatcaaagtcccaactgtgccgatccagctaccgttcttcatctgctgtccctggtgcaacctcctgtcgccccgcgtactttacaaggggaacctcacgttcccacgaaagaactatttcctcctctggatggtcgaggggatgaacggcgagcgggccagatcacgcccagctattcgcagcgagcagcatactccgtggctctcaagcagcagcagcgtggcaaatggaaatgcaggctgttcaaatcccactcgacgccacctcccgccaccatcggttgacacttcacccaccaacgcaaatcatgccaaccacggggggtcccctctgctgaacgcagggagggtacaagcttcgctgcgcaagtccctgtcgttcctggtccacctgactgccaagtttcccctggtgttcgtcttcctcctcatagtgctgtatgcgatcccagccagcgcagcagtcctgttactgtatatccttatcactgtgctgtttgcgcttccctcgttcctgatactgtattttgcatatccgagcctggactggcttgttagagagatctttgcctgagattttttgttcgaaaaaaaaaaatctcaatgctgttgttggggtgtaaaaaaaaaaaaaaaaa

SEQ ID NO: 70136 - protein, 270 aa, Zea mays
  misc_feature: Ceres CLONE 1549251
MWGFASNAWAAGLEKRSFPNRTSSSAAYSDDEASSCTSREEGLECPICWESFNIVENVPYALWCGHTMCKNCILGLQWAVIKVPTVPIQLPFFICCPWCNLLSPRVLYKGNLTFPRKNYFLLWMVEGMNGERARSRPAIRSEQHTPWLSSSSSVANGNAGCSNPTRRHLPPPSVDTSPTNANHANHGGSPLLNAGRVQASLRKSLSFLVHLTAKFPLVFVFLLIVLYAIPASAAVLLLYILITVLFALPSFLILYFAYPSLDWLVREIFA

SEQ ID NO: 70137 - DNA, 679 bp, Zea mays
  misc_feature: Ceres CLONE 1549253
  misc_feature: Encodes the peptide sequence at SEQ ID NO. 70138
  misc_feature (502)..(502): n is a, c, t, g, unknown, or other
  misc_feature (567)..(567): n is a, c, t, g, unknown, or other
  misc_feature (632)..(632): n is a, c, t, g, unknown, or other
ctccccgcggtggcggccgctctagaactagtggatcccccgggctgcaggaattcgtctcacccctagaaaaaaccatcgcctccgctccgattcgccgaatcggcgctggcgggcgagacgtggatctcgacggaggagactccgaccatcgctccatggaggccgcggactctgaatccgtcatctccaccttcacctgtccgcactgtcagcgggaggttccatcttcaaacattgcattgcacagcgcgcactgcgctcggaaccttcagaagtgcgaacattgcggagatatggttgccaggaagcttatggatgaacactacgatgaaaaccatgctccgatgaattgctcactttgcaaacacacagtagaacgcgagctatgggatcttcatacaggcatacaatgcccacaaaggatgctcgcgtgccaatactgtcagtttgaactgcctgcagttgatctttttgaacatcaggatctgtgtggaaatcngacagaatattgtcaaagttgcagggagtatatcagactttcgtgaatggattggacatgaactnccagttccatacgatttttgaatgctgcatcagaacttttcagtgacaggactcgagcagcagcngagcagccggtacaaaagccagcccgacctggtaatgggttcctttc

SEQ ID NO: 70138 - protein, 129 aa, Zea mays
  misc_feature: Ceres CLONE 1549253
  misc_feature (115)..(115): Xaa is any aa, unknown, or other
MEAADSESVISTFTCPHCQREVPSSNIALHSAHCARNLQKCEHCGDMVARKLMDEHYDENHAPMNCSLCKHTVERELWDLHTGIQCPQRMLACQYCQFELPAVDLFEHQDLCGNXTEYCQSCREYIRLS

SEQ ID NO: 70139 - DNA, 670 bp, Zea mays
  misc_feature: Ceres CLONE 1549256
  misc_feature: Encodes the peptide sequence at SEQ ID NO. 70140
agctccccgcggtggcggccgctctagaactagtggatcccccgggctgcaggaattcgtctcacccctagaaaaaatggagaggccgcgttgctactctccgcttgccctgcacctcctcctctgcctcttctcgctccgcgcctgttccgccgcgtccatcacagccggcacccccgacgagtcggagctgtgggggtacgtcgaggtccggccaaaggcgcacctgttctggtggtactacaagagcccgcagaagacgtcgacgccgtccaagccatggcccacggtcctctggctgcagggcggcccgggcgcgtccggggtcgggctcggcaacttcctggagatggggccgctggacgtggacctgaagccgcgcaactcgacgtggctccacaaggccgacctcatccttggtgaaaaccccgtcggcaacaggtacagctacttggaagacaacaccctgttctgaacacggactggaaacaggcccgggacattacaacgggggtcagggccttggcaaaagagggcccccccctgggaagacaccccgttttccgggggcccaaaacccaagggggggaattaacccccccactttgggggggctcttttgcgggggccccccccccgggggaaaccaaaacccccccgggaggggggg

SEQ ID NO: 70140 - protein, 132 aa, Zea mays
  misc_feature: Ceres CLONE 1549256
  misc_feature: SWISSPROT Homolog: EC 3.4.16.5 Carboxypeptidase C
MERPRCYSPLALHLLLCLFSLRACSAASITAGTPDESELWGYVEVRPKAHLFWWYYKSPQKTSTPSKPWPTVLWLQGGPGASGVGLGNFLEMGPLDVDLKPRNSTWLHKADLILGENPVGNRYSYLEDNTLF

SEQ ID NO: 70141 - DNA, 651 bp, Zea mays
  misc_feature: Ceres CLONE 1549257
  misc_feature: Encodes the peptide sequence at SEQ ID NO. 70142
ggagctccccgcggtggcggccgctctagaactagtggatcccccgggctgcaggaattcgtctcacccctagaaaaagctttcccccttttttcctgcccactacaaatgcttgggcattagcgatcctcctcctcgttctccttccccttctccctcctctgggtctgggtgcgccctcccctgctccacttctccggcgctgacatgacgtccacggcgtactcgcggtcgtccaagctgccgggcggcgagcggcggctgcccccgcgcctcatgcgggggttcgcgtccaagatcgagcccaagaagctgggcgtcggcctcatcgccggctgctgcctcgcgctcctcacctacgtctccctcgccaagctcttcgcaatctactcccctgtcttcgctagctcggccaacacgtccgcgctgatgcagcagaacgcgccgccgacctcgtccaaaccgtccgtgccggagacggagaccatccccgcgcaggagacgctaggcggcggcggcgacagcgcggatcccgtccatctgcgtgaggggcgcgacggggctccaagagcccggcttgcccgaagctgccctcacgaagaaggaaatggggcggggggctcccaagaaccccggcttgccccccaggaa

SEQ ID NO: 70142 - protein, 148 aa, Zea mays
  misc_feature: Ceres CLONE 1549257
MTSTAYSRSSKLPGGERRLPPRLMRGFASKIEPKKLGVGLIAGCCLALLTYVSLAKLFAIYSPVFASSANTSALMQQNAPPTSSKPSVPETETIPAQETLGGGGDSADPVHLREGRDGAPRARLARSCPHEEGNGAGGSQEPRLAPQE

SEQ ID NO: 70143 - DNA, 1930 bp, Zea mays
  misc_feature: Ceres CLONE 1549260
  misc_feature: Encodes the peptide sequence at SEQ ID NO. 70144
aacctcaccttcaagcgtcaagtagcaaaactacagctttccttcacccccagcaagaaaaccgagcgatctagcagactaccacagaagatttcctactcggccgcacgtgcagaccctgatctgactgagagaggcaggcagcagctcgatcggcagtaaccgtgagcgagccatgggactggcctggatggtgacggcggccgtcgcggcggtgctggcgtcgtgggcgttcaacgcgctggttcacctcgtctggcgtccctacgccatcacccggaggctccgcgcgcatggcgtgcgcgggccgccctacacgttcttcaccgggagcctcggcgagatcaagcggctccgcgccaagggcgccaccgtcacgctggacgtcgacgaccacgacttcatccccatggtgcagccccatctgcgcaaatggatcgcgctctacgggcggacgttcgtgtactggaccggcgcgaggccgaacgtgtgcgtggcggacgtgaacgtggtcaggcaggtgctcttcgaccgcaccggcctctaccccaagaacctcatgaacccgcacatctcccgcctgctcggcaagggcctcgtcctcaccgacggcaacgactggaagcgccaccgcaaggtcgtgcacccggccttcaacatggacaagctcaagctgatgacggcgaccatgtccgactgcgctcgctcgatgatctccgagtgggacgcacagctgcagaaggaggagagcgggcgcgacggtcacggccacggccacgtggaggaagagctgagcagccgcttcgaggagctcaccgccgacgtcatctcgcacaccgcgttcgggagcagctacagcgaggggaagcgggtcttcctggcgcagagggagctgcagcacatcgccttctccaccattttcaacgtccagatcccagctctcaagtacctcccgaccgagaagaatctcaggacacggaagctggacaggcaggtgagggccatgctaatggacatcatcgaggcccgcctcgccagcaaggacaccgccggcggctacgggaacgacctgctcgggctcatgctggaggcgtgcgcgccgccaccggagcaccatggcgagatggcgccgaccacgctgagcatggacgagatcgtcgacgagtgcaagaccttcttcttcgccggtcacgacaccacgtcgcacctgctcacctgggcctccttcctgctgagcacgcacccggagtggcagcacaggctacgggacgaggtccggcgggagtgcggcgacgacgaggtccccaccggcgacgccctcaacaggctgaagcttgtcaacatgttcctcctggagaccctgaggctgtacggcccggtgtccctgatccagaggaaggcgggctcagatctcgacctcggcggcatccgggtacccgagggcgcgatcctgaccattccgatcgccacgatccaccgcgacaaggaggtctggggcgaggacgccggcgagttcaggccggagaggttcgagaacggggtgacgagggcggccaagcaccccaacgcgctgctgtccttctccagcgggccaaggtcgtgcatcggtcagaacttcgcaatgatcgaggcaaaggccgtggtcgccatgatcctgcagaggtttgcactcgagctgtccccgaaatacgtccacgcgcccatggacttgatcaccctgcgcccaaggcatgggctccccatgctcctcaagcgactgtaggtttcattcgatcatggtgcgcgtcagatagatgtgaaattaataggagttttgtatttgttgcttatatatttccgtttatttttgctacttatatgtacccacataatgtatgtcaataggacttttgtatttgttgcttatatatttccatttatttttgctact

SEQ ID NO: 70144 - protein, 528 aa, Zea mays
  misc_feature: Ceres CLONE 1549260
  misc_feature (42)..(523): Pfam Name: p450 Pfam Description: Cytochrome P450
  misc_feature: SWISSPROT Homolog: EC 1.3.3.9 Secologanin synthase
MGLAWMVTAAVAAVLASWAFNALVHLVWRPYAITRRLRAHGVRGPPYTFFTGSLGEIKRLRAKGATVTLDVDDHDFIPMVQPHLRKWIALYGRTFVYWTGARPNVCVADVNVVRQVLFDRTGLYPKNLMNPHISRLLGKGLVLTDGNDWKRHRKVVHPAFNMDKLKLMTATMSDCARSMISEWDAQLQKEESGRDGHGHGHVEEELSSRFEELTADVISHTAFGSSYSEGKRVFLAQRELQHIAFSTIFNVQIPALKYLPTEKNLRTRKLDRQVRAMLMDIIEARLASKDTAGGYGNDLLGLMLEACAPPPEHHGEMAPTTLSMDEIVDECKTFFFAGHDTTSHLLTWASFLLSTHPEWQHRLRDEVRRECGDDEVPTGDALNRLKLVNMFLLETLRLYGPVSLIQRKAGSDLDLGGIRVPEGAILTIPIATIHRDKEVWGEDAGEFRPERFENGVTRAAKHPNALLSFSSGPRSCIGQNFAMIEAKAVVAMILQRFALELSPKYVHAPMDLITLRPRHGLPMLLKRL

SEQ ID NO: 70145 - DNA, 650 bp, Zea mays
  misc_feature: Ceres CLONE 1549261
  misc_feature: Encodes the peptide sequence at SEQ ID NO. 70146
  misc_feature (446)..(446): n is a, c, t, g, unknown, or other
  misc_feature (650)..(650): n is a, c, t, g, unknown, or other
gcggtggcggccgctctagaactagtggatcccccgggctgcaggaattcgtctcacccctagaaaaaattattattttaccatcacctacccgctgccttcctccttcttttccctttcccatcgtcgaatcctcgccccttctcccgtcggctgttgcttttgcttcgaattcccgatttgcttgccggaaccctagcgacgccgtggtgacgcgacgccgacgcgtatggagatctccttcgaggcgtgggagggcgtgcagcggcatggtcaggacctcgcggaccgcctcgcgcagggtttcacgggcctgctccaggtgccgccgcagttcccgtggccgccgtcgccgcacaagcggatgcccttcgacatcgacctccccgtcgtccccttcggcgccggcggccccctcggcgtcccgggggagggacttccccttncccgccgcgggccgtctcctcggtcatcgacatcggcggcaagctggggccaggccggccctgagctcgggggcgtccggtgggcgggggcccttgcaacaaccccgtgcgggttttttgcccgtgcccgttccggaaacggaaaaaatccggggcccccaaagttaccggcgggccgttttcttaaagcgccccccgggattn

SEQ ID NO: 70146 - protein, 140 aa, Zea mays
  misc_feature: Ceres CLONE 1549261
  misc_feature (73)..(73): Xaa is any aa, unknown, or other
MEISFEAWEGVQRHGQDLADRLAQGFTGLLQVPPQFPWPPSPHKRMPFDIDLPVVPFGAGGPLGVPGEGLPLXRRGPSPRSSTSAASWGQAGPELGGVRWAGALATTPCGFFARARSGNGKNPGPPKLPAGRFLKAPPGI

SEQ ID NO: 70147 - DNA, 658 bp, Zea mays
  misc_feature: Ceres CLONE 1549263
  misc_feature: Encodes the peptide sequence at SEQ ID NO. 70148
  misc_feature (658)..(658): n is a, c, t, g, unknown, or other
ctccccgcggtggcggccgctctagaactagtggatcccccgggctgcaggaattcgtctcacccctagaaaaagaagagcgtgcagagcgagacgcgtcgcctcctcccttcccccaccccgccgccgccctcgcgtccgtccgtccgttattagggttcggtcgccgccatggcgatcctctcggcgctcgccaccgaggtgctcatccccgtcgccgccgtcatcggcatcgccttcgccgtcgtgcagtgggtggtcgtgtcgcgcgtgaagctctccccggccgcgtccggcggcagcggcggcaaggccggctacgccgactccctcatcgaggaggaggaggggctcaacgaccacaacgtcgtcgtcaagtgcgccgagatccagaacgccatctccgaaggagcaacatcgtttcttttcaccgagtaccaatatgttggtatcttcatggctatcttcgctgttgtgatcttcctcttccttggttcggttgagggattcagcacgaagagccagccctgcacatatagcaaggacaagtactgcaagcctgctctgttcactgcactctttagcactgtgtccttcttgcttggagcatcacctctctggtctctggtttccttggcatgaagattgcacatatgcn

SEQ ID NO: 70148 - protein, 156 aa, Zea mays
  misc_feature: Ceres CLONE 1549263
  misc_feature: SWISSPROT Homolog: EC 3.6.1.1 Inorganic diphosphatase
MAILSALATEVLIPVAAVIGIAFAVVQWVVVSRVKLSPAASGGSGGKAGYADSLIEEEEGLNDHNVVVKCAEIQNAISEGATSFLFTEYQYVGIFMAIFAVVIFLFLGSVEGFSTKSQPCTYSKDKYCKPALFTALFSTVSFLLGASPLWSLVSLA

SEQ ID NO: 70149 - DNA, 630 bp, Zea mays
  misc_feature: Ceres CLONE 1549264
  misc_feature: Encodes the peptide sequence at SEQ ID NO. 70150
agctccccgcggtggcggccgctctagaactagtggatcccccgggctgcaggaattcgtctcacccctagaaaaaacgctccggcagcgaagctcccccctccctgcctccttccccggcgccctgctcttcctccttccgctccggcgatgggcactggccgcggctgcggcgggggcgtgctccaccgcctcctcgccctctcgtcgctgctgctcctcgcttccggcgaggtcgtcttcgaggagcgcttcgaagatggttgggagactcggtgggtagaatccgactggaaaaggagtgaagggaaagcaggaaggttcaagcacacagcgggaagatactctgcagatcctgatgacaaaggaattcagacaacaatagatgccagacattttgctatctcagccaagttccggaatcagtacaagaacggacgcttgtggtcagtactccattaagttgagcaggatatgaatggtggcggtggctatattaggcttatgtccggttatgtcaccagaaaaaatttatggggaacctcctaccgcttgaggttggaccaaatttttggggacccaaacaaaaaaccccctcttaaccccctttccggggcaaaatttccccta

SEQ ID NO: 70150 - protein, 103 aa, Zea mays
  misc_feature: Ceres CLONE 1549264
MGTGRGCGGGVLHRLLALSSLLLLASGEVVFEERFEDGWETRWVESDWKRSEGKAGRFKHTAGRYSADPDDKGIQTTIDARHFAISAKFRNQYKNGRLWSVLH

SEQ ID NO: 70151 - DNA, 675 bp, Zea mays
  misc_feature: Ceres CLONE 1549269
  misc_feature: Encodes the peptide sequence at SEQ ID NO. 70152
tggagctcaccgcggtggcggccgctctagaactagtggatcccccgggctgcaggaattcgtctcacccctagaaaaaaaaaaaaaaaaaaaaaccctctccacttccgtttccggatcccgtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctggacatgaagggccgcgttctcgtctggcgcgactaccgcggggatgtctccccgctccaggccgagcgcttcttcaccaagctcctcgacaaggagggcgattcggaagtgcactcgcctgtggtctacgacgacgctggcgtcacttacatgttcatccagcacaacaatgttttcctcctcaccgccgctcgccaaaactgtaacgcggccagcatccctccttttcctccaccgttgtaatagaatgtgtttaagcccctaacttcaagggaacctggaaggaggaatcccctcagaagatgaacttccgt

SEQ ID NO: 70152 - protein, 91 aa, Zea mays
  misc_feature: Ceres CLONE 1549269
MAGAVSALFLLDMKGRVLVWRDYRGDVSPLQAERFFTKLLDKEGDSEVHSPVVYDDAGVTYMFIQHNNVFLLTAARQNCNAASIPPFPPPL

SEQ ID NO: 70153 - DNA, 649 bp, Zea mays
  misc_feature: Ceres CLONE 1549270
  misc_feature: Encodes the peptide sequence at SEQ ID NO. 70154
tccccgcggtggcggccgctctagaactagtggatcccccgggctgcaggaattcgtctcacccctagaaaaattcggtgagccgtgccacggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgacatgccccgatgagtaggagggcgcggcggccgccgcaaaacccggggcgcgagcccgggcggagcggccgtcggtgcagatcttggtggtagtagcaaatattcaaatgagaactttgaaggccgaagaggagaaaggttccatgtgaacggcacttgcacatgggtaagccgatcctaagggacgggggaaacccggcagatagcgcgatcacgcgcgtcacccgaaagggaatcgggttaagatttcccgagccgggacgtggcggcagacggcgactttaggaagtccggagacc

SEQ ID NO: 70154 - protein, 40 aa, Zea mays; identical to SEQ ID NO: 66130
  misc_feature: Ceres CLONE 1549270

SEQ ID NO: 70155 - DNA, 662 bp, Zea mays
  misc_feature: Ceres CLONE 1549271
  misc_feature: Encodes the peptide sequence at SEQ ID NO. 70156
  misc_feature (440)..(440): n is a, c, t, g, unknown, or other
  misc_feature (474)..(474): n is a, c, t, g, unknown, or other
  misc_feature (560)..(560): n is a, c, t, g, unknown, or other
  misc_feature (589)..(589): n is a, c, t, g, unknown, or other
  misc_feature (621)..(621): n is a, c, t, g, unknown, or other
ctcaccgcggtggcggccgctctagaactagtggatcccccgggctgcaggaattcgtctcacccctagaaaaaaccgccgccgcatccaccaccacctccgccgccgtgctcgccttcaggctcctccgccgcctgccgcgccgcctcagcgtgtcccgcgcgccgcccgcggcactcgcgtcgtcgtcgtcgtcgtcgtcgcgcagactaccgtccctcgcccgccacccgctcggtcaccgcacccggatggggcacacagccgccgctgcggccgcggccgccgaacccgctctcggactcaccaagcccaacgccgtcgagccgcctcaggtcaccttttccgcgaaagacatcgaattctccgaggggaagggcgatattctcgctgtcccccttcccgaaaaaagatctgccaaagaacccgactccaattcnaaaaatgcgtccttaaaaaacctggacgggccantttggggggcccccttgtcgagggtgcgcgggaagaaaaatttcccgggaaaacgggcaagggggggggccctccccccccggggngagggctttaaaagagggggggcctattnttcttttgtaaaaaaagccccccttttaaaancccccccttataaaaaaaaccccctagaaaaatttttctct

SEQ ID NO: 70156 - protein, 220 aa, Zea mays
  misc_feature: Ceres CLONE 1549271
  misc_feature (158)..(158): Xaa is any aa, unknown, or other
  misc_feature (196)..(196): Xaa is any aa, unknown, or other
  misc_feature (207)..(207): Xaa is any aa, unknown, or other
HRGGGRSRTSGSPGLQEFVSPLEKTAAASTTTSAAVLAFRLLRRLPRRLSVSRAPPAALASSSSSSSRRLPSLARHPLGHRTRMGHTAAAAAAAAEPALGLTKPNAVEPPQVTFSAKDIEFSEGKGDILAVPLPEKRSAKEPDSNSKNASLKNLDGPXWGAPLSRVRGKKNFPGKRARGGALPPRGEGFKRGGAYXSFVKKAPLLKXPPYKKNPLEKFFS

SEQ ID NO: 70157 - DNA, 719 bp, Zea mays
  misc_feature: Ceres CLONE 1549273
  misc_feature (181)..(181): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (606)..(606): n is a, c, t, g, unknown, or other
ggagctccccgcggtggcggccgctctagaactagtggatcccccgggctgcaggaattcgtcttcaacccctagaaaaaatgctacagtgttggtggcgttcgcagcagtcttgtccgatcatcaatggataccaccaacccagtagtagctgtgacttgcgacgagtgatggagcgtancgcggctggagtggacgtacgcccggcttctcgtcttcgtccggggggagccgagtccccctccctggttccctccttccttgcgggggaccctttaattttgaacttccggaaaggagaattggcagggcccgggaattcccggggttttttgggggaacctccccttttgggacccccttttaacccccccccaaaagggggggggggggggggggcccccggaatttttaaaacaaaaaccccggggttttaaaaaacgggggtttttctcccacaaatgggggggaaaaaaaaaaagccccccttttttttttgtgtaaaacacaaaaacannngaaaagaggccccccgggggggggcgggcttctcccccccacaaaaaaatttttctcttttcttttttagagaaggggggcgctttntccccccaaagaagaaaatttcggggaaaaaaaaccccgcgttttgtgggggagaaaaaaaaaagggggggggggtgtatccccccaacatcataaaaatctttctccgcgag

SEQ ID NO: 70158 - DNA, 698 bp, Zea mays
  misc_feature: Ceres CLONE 1549277
  misc_feature: Translation starting site: 148
atagctggagctccccgcggtggcggccgctctagaactagtggatcccccgggctgcaggaattcgtctcacccctagaaaaactttcggaggaggcggaccaggtcagcagcagcaggaaccctagcaccgccgcatccgcagccatgggcatcgacctcgtcgccggtgggaggaacaagaagaccaagcgcacagcgccgaagtccgacgatgtttatctcaagctccttgtcaagctctaccgtttcttggtcaggaggaccaagagcaacttcaatgctgtcattctcaagaggctcttcatgagcaaaaccaatcgcccaccaatctccatgcgccgccttgtcaagctcatggaaggaaaggagaagaacattgctgtgattgttggcacagtcacagatgacaagaggatcctagaggttccagcaatgaaggttactgccctgaggttcaccgagaccgcaagggccaggattgtcaatagcaggtggggagcgcctcacatttgacccgcttgctctccgtgctccacttggcgagaacacagtcctcttgaggggccccaagaatgcccgtgaggcggtgaggcacttcggcaaggctcctggagtgccgcacagccacaccaagccatatgtgcgctcccagggaaggaagttcgagaaggctcgtggcaggaggaacagccgcg

SEQ ID NO: 70159 - DNA, 687 bp, Zea mays
  misc_feature: Ceres CLONE 1549280
  misc_feature: Encodes the peptide sequence at SEQ ID NO. 70160
ctccccgcggtggcggccgctctagaactagtggatcccccgggctgcaggaattcgtctcacccctagaaaaactcacacaacacagccgactgaaaatgcatacgtcgtcggaagtggcagctccaatgacgtggctcgttctcacgctcctgctctcatcagcggccgccgccgtggagacggtgaaagtggtcaccaccccagtcttccctcagatccctcggctccaggcaagcaaagacttccaggtggtggtgcgcgtcgaggcgccaccggtggcgcagcagcaggcgcgcgtccccgtcgacctcgccgtggtgctcgatgtgggtgccggtggcggtggcagcaccggctcggcgaggctggatgcggtgaagaaggccgtcaagtttatcatcgggcagatccatgacaacgaccgtctcgccgtcgtcgggccgtcgcccaaccgccggctagtcatcgggtttccgagcactcacgaggctcgacagaacgcagaaaaatccgtcgacgacctggagccccgtggcgagttcgcgtccggcgccggcttggaggaggccgtcaagatccctcggggagttaccggcgacggcgagcgggagcagccgcgcgcgcttcgtcattctggtgaccggacacgcggtgacggaaggcagcggcggcagatttcggcag

SEQ ID NO: 70160 - protein, 186 aa, Zea mays
  misc_feature: Ceres CLONE 1549280
MTWLVLTLLLSSAAAAVETVKVVTTPVFPQIPRLQASKDFQVVVRVEAPPVAQQQARVPVDLAVVLDVGAGGGGSTGSARLDAVKKAVKFIIGQIHDNDRLAVVGPSPNRRLVIGFPSTHEARQNAEKSVDDLEPRGEFASGAGLEEAVKIPRGVTGDGEREQPRALRHSGDRTRGDGRQRRQISA

SEQ ID NO: 70161 - DNA, 675 bp, Zea mays
  misc_feature: Ceres CLONE 1549284
  misc_feature: Encodes the peptide sequence at SEQ ID NO. 70162
  misc_feature (203)..(203): n is a, c, t, g, unknown, or other
  misc_feature (531)..(531): n is a, c, t, g, unknown, or other
  misc_feature (537)..(537): n is a, c, t, g, unknown, or other
ctccccgcggtggcggccgctctagaactagtggatcccccgggctgcaggaattcgtctcacccctagaaaaacagctcactcgtgccgtgcactcgtcccgtccccctccaccctccaagacctcgcattgccaccgccgccgccgagccaggggagaggagagaggccagccgcgtcgcggcgggcggaggaggaggacnagcgggagagcggagcgagccggccgggcaggatgttcgggcgggatccctggggcgggccgctggagatctccaacgccgactcggcgacggacgacgaccgcagccgcgacctggaccgggcggcgctgatgcggcagctggacgagacgcagcagagctggctcctggccggggcccgcgacccagccgggcagaagaagaagcggtacgtcgacctcggctgcctcgtcgtcgaccgcagggtcttcatgtggaccgtcggcaccgtcctcgggcctcggcgtcttcatcggcttcgtcatcatgatcgtcaagctcgtcccgnaaaagngcccccggccgccgccgcccgaacagtacacgcaggcgctgcacaaggcgctcatgttcttcacgggcagcgatccggcccgctgccgagcacaatggcgtgagctggagggggcactcctgctgaaggacggcctcc

SEQ ID NO: 70162 - protein, 134 aa, Zea mays
  misc_feature: Ceres CLONE 1549284
  misc_feature: SWISSPROT Homolog: EC 3.2.1.4 Cellulase
  misc_feature (99)..(99): Xaa is any aa, unknown, or other
  misc_feature (101)..(101): Xaa is any aa, unknown, or other
MFGRDPWGGPLEISNADSATDDDRSRDLDRAALMRQLDETQQSWLLAGARDPAGQKKKRYVDLGCLVVDRRVFMWTVGTVLGPRRLHRLRHHDRQARPXKXPPAAAARTVHAGAAQGAHVLHGQRSGPLPSTMA

SEQ ID NO: 70163 - DNA, 660 bp, Zea mays
  misc_feature: Ceres CLONE 1549285
  misc_feature: Encodes the peptide sequence at SEQ ID NO. 70164
  misc_feature (345)..(345): n is a, c, t, g, unknown, or other
  misc_feature (414)..(414): n is a, c, t, g, unknown, or other
  misc_feature (494)..(494): n is a, c, t, g, unknown, or other
  misc_feature (495)..(495): n is a, c, t, g, unknown, or other
aagctggagctccccgcggtggcggccgctctagaactagtggatcccccgggctgcaggaattcgtctcacccctagaaaaaaaggagaccctcctcagccgctagtaccagtagtcgtcgcgtttgcagctaggcagatctgagttagccggcggatccgatccgtgcgcgtgcgcagtgtgtgtgtgtgtgtgtgtgtgtgtgtgtgtcggtggagagatggccacagcttacgctcccatggcgagccaggtgatgaagagcagcctcgtcgtgcactcgaggccgaagggcctgtcaggcgctgctgcgctcacgaaggcgcccgggcggttcaccgtcnaggccatccagccccgaggaagccacgttacaagtggtgcagccccatcacgggcgacctctttcatcngcagccctgaagacgccggtcacctcgaagcccgctcgttggcgtggtaactcttccaactttccgggctaacgcacccnncttgagcccccctgctggggggcgtctcaggtcggcctcccgccacgggtaccttcctcgtggggggccctttgcggctcacggggcccgtttcccaacaagcccgtgtaacagggcaaggccgggccgcttcggggccccccggcttttttgcctttcttaagg

SEQ ID NO: 70164 - protein, 73 aa, Zea mays
  misc_feature: Ceres CLONE 1549285
  misc_feature (35)..(35): Xaa is any aa, unknown, or other
  misc_feature (58)..(58): Xaa is any aa, unknown, or other
MASQVMKSSLVVHSRPKGLSGAAALTKAPGRFTVXAIQPRGSHVTSGAAPSRATSFIXSPEDAGHLEARSLAW

SEQ ID NO: 70165 - DNA, 713 bp, Zea mays
  misc_feature: Ceres CLONE 1549288
  misc_feature: Encodes the peptide sequence at SEQ ID NO. 70166
  misc_feature (405)..(405): n is a, c, t, g, unknown, or other
  misc_feature (414)..(414): n is a, c, t, g, unknown, or other
  misc_feature (415)..(415): n is a, c, t, g, unknown, or other
  misc_feature (495)..(495): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
aaagctggagctcaccgcggtggcggccgctcctagaactagtggatcccccgggctgcaggaattcgtctcacccctagaaaaccctagaaaaaaaaccgctcttcccatttccctcgccctggcgccgcctgcgtccacctccgctcgccgctctccccgcgtatccctctcatacgcagctcgcccaggtaagatgtcgtccgtggcgtcgaaggtggcggtgccggagtctgtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgccccagagaaagaactggtgcagcttaagcgtgnagcccgttnngaagggtgtttctatgtcagtcctgaaagcaagctgctctttgtggtccgcatcccgggtattaacgccatgcaccctangacagggagatctggcagcttctgcgattgagcaaatcttcaagggtgtggtcctcaaggcaacaagcgactattacatgctacccaggggtgaaccatttgtgccattggttcccaaccttgaaaaggcaggggatttattctcaaaagggctttgaaacgtaaaaacgaaagatccctttgccaaaaaccagttatgnnnnnnaaagaaggcttgg

SEQ ID NO: 70166 - protein, 109 aa, Zea mays
  misc_feature: Ceres CLONE 1549288
  misc_feature (13)..(83): Pfam Name: Ribosomal_L30_N Pfam Description: Ribosomal L30 N-terminal domain
  misc_feature (70)..(70): Xaa is any aa, unknown, or other
  misc_feature (73)..(73): Xaa is any aa, unknown, or other
  misc_feature (100)..(100): Xaa is any aa, unknown, or other
MSSVASKVAVPESVLRKRKREEQWATEKKEKALVEKKKSIESRKLIFTRAKQYAEEYDAPEKELVQLKRXARXEGCFYVSPESKLLFVVRIPGINAMHPXTGRSGSFCD

SEQ ID NO: 70167 - DNA, 952 bp, Zea mays
  misc_feature: Ceres CLONE 1549292-R
ggcgaattgggtacctcgagcgtctcgtttttttttttttttttcttttttttttttgaccatccttctgatagttggcttacttattttaaagtgtaaacatccctttggagacatgaatggaaacatgtgcgctctacagaagaaacaagtgatatgaacatttctgcgggtgcaaaagaaacaaactagcaaacaaaaacaaaacatgtgcactctactatcgacaaactacgccgccttgatgaccctgaaggagtccatgactcttctgaggtcctcctcttcctgcatgaacacctgctcgggcgtctgcaggcagagctcgtatatccgcttgttctctacgcccagcactgacaggtatcggcagtgcctctgcaagatctgcaccctagtcctgtggggatcaccgccagccaccttgcttacttggcatagggatttttatatttcaaccccaaccctccctagataaaaccttgcctatccttcacgggaaactttggtatgtacgcccgaatcgcggaacgtttgggaattcacgagccagaaaaccccgccgaggccttggggggggacaataaaaaccccccgggtcaaaggggtaccgtgaacccggaaagagaaccctttgccacctggtccagggcgctttgctctcccaggcgtgggtccccaaaagagttccctctggaaagaccacgccgcgtttacccttgggaaccatacacaaaagggctatatacaattatttcctcccctcacaaaataggattatcaggacttgtcagagggaacaaataggggggtcgttcttggaaaaaaataatatgtctcggatgtcaagagtgtcccctcgggaaacggaaggatcgactttttcgttcccgaggttaaaaagaaatgggtgggggggcctcataacaagtagttgcaatatgacccgccc

SEQ ID NO: 70168 - DNA, 681 bp, Zea mays
  misc_feature: Ceres CLONE 1549297
  misc_feature: Translation starting site: 294
  misc_feature (380)..(380): n is a, c, t, g, unknown, or other
ggagctccccgcggtggcggccgctctagaactagtggatcccccgggctgcaggaattcgtctcacccctagaaaaaacaccacccacctccatagcagcctactatcctctccttcctccattctctcgctatcttccccactccccagccaacaaatcgaccttgctgggaacgagagggctatagagcctggggagggcagcgcaacacgcgccacggagcagcggcggcggcggcggcggcagagcagtccgccgggagcagaggccgcgcgcgcagcgcaggcagccatgggcgcgccggtgaacggcgccgtcgtcttgttcctcctgctgctggctggaacgggggcggtgaccgaggagacggctccgcangaacccacattgcccgccgccggctccggctccggctccggcgccggcgccggcgcggcggtcggggtcaactccaactccgtgctggtcgcgctgctcgactcgcactacaccgagcttgcggagctgggtggagaaggcgctgctcctgcagacgcttgaagacgccgtcgggaagcacaacgtccacatcttcgccgcccggaaagaaggccttggagcgggaacttggaccccggatttcaagccctttcctggctggacccgcccaacctccagtcccttgcaggccctgcttgtc

SEQ ID NO: 70169 - DNA, 726 bp, Zea mays
  misc_feature: Ceres CLONE 1549298
  misc_feature: Encodes the peptide sequence at SEQ ID NO. 70170
  misc_feature (450)..(450): n is a, c, t, g, unknown, or other
  misc_feature (661)..(661): n is a, c, t, g, unknown, or other
  misc_feature (662)..(662): n is a, c, t, g, unknown, or other
  misc_feature (696)..(696): n is a, c, t, g, unknown, or other
  misc_feature (726)..(726): n is a, c, t, g, unknown, or other
ctggagctcaccgcggtggcggccgctctagaactagtggatcccccgggctgcaggaattcgtctcacccctagaaaaagccgccactcacgaccacgccgcgcctccgcctggaaccctttagccgagcggagcaaggaaagaaatggggaagggtacgggcagcttcggcaagcgccggaacaagacgcacacgctctgcatccgctgcggccgccgcagcttccacctccagaagagcacctgctcctcctgcggctaccccgccgcccgcatccgcaagtataactggagtgtgaaggccatcaggcgtaagacaactggtaccggaaggatgaggtacatgcgacacgtgcctcgccgtttcaagagcaacttcagagaagggactgaggctgccccaaagaagggtgttgctgctgccaactaagtgtggtcttgctgccatncagaagcgctagaacttgagactttttgattgaattgtacttctgaactatttagcccataatactatgcttgaattaatttcagagccttatagccacatcccggccagccgcagcaagtgcccagaaggccagaacccagaccaggtagcccgtgcaacctcatatcatccccctgcacgcacctccgtccgccgcgccatggaatcgnnagagagggccgtgcccaccgtgacggcggttgcngtggcaacgctgctgctgctgctgatgtcn

SEQ ID NO: 70170 - protein, 94 aa, Zea mays
  misc_feature: Ceres CLONE 1549298
  misc_feature (2)..(55): Pfam Name: Ribosomal_L37e Pfam Description: Ribosomal protein L37e
MGKGTGSFGKRRNKTHTLCIRCGRRSFHLQKSTCSSCGYPAARIRKYNWSVKAIRRKTTGTGRMRYMRHVPRRFKSNFREGTEAAPKKGVAAAN

SEQ ID NO: 70171 - DNA, 593 bp, Zea mays
  misc_feature: Ceres CLONE 1549300
  misc_feature: Encodes the peptide sequence at SEQ ID NO. 70172
  misc_feature (108)..(108): n is a, c, t, g, unknown, or other
  misc_feature (400)..(400): n is a, c, t, g, unknown, or other
  misc_feature (401)..(401): n is a, c, t, g, unknown, or other
ccgcggtggcggccgctctagaactagtggatcccccgggctgcaggaattcgtctcacccctagaaaaaatgcactcggacggacgagcgaggcagacccgcaggtncgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcgggagggtgtcnntcctctcaaggggactctcctcatctggctcgtcaccatcacctgcaccctggcgatccagtctctggtccccttcttgtatttcatgataagggatctgcatattgctaaacaaacacagacattggatttatgccgggttttgtggcgctttctatatgtggtgggaagccagtctcctcacagtatggg

SEQ ID NO: 70172 - protein, 106 aa, Zea mays
  misc_feature: Ceres CLONE 1549300
  misc_feature (43)..(43): Xaa is any aa, unknown, or other
MGGGNGETTQLGEPLLAKKAKAYRPRCPGCRVDRLNAEREGVXPLKGTLLIWLVTITCTLAIQSLVPFLYFMIRDLHIAKQTQTLDLCRVLWRFLYVVGSQSPHSM

SEQ ID NO: 70173 - DNA, 672 bp, Zea mays
  misc_feature: Ceres CLONE 1549301
  misc_feature: Encodes the peptide sequence at SEQ ID NO. 70174
ggagctccccgcggtggcggccgctctagaactagtggatcccccgggctgcaggaattcgtctcacccctagaaaaatcgtgtgacctcccccgatctggagctgaagtgcttgacgccttccgcttccacttccacggcagcacgagccttcttctccttctcgcttagcggctatagcgccagccaaaggagaagtctgcgggcgagtgcgatagatagacacagagaaaccgatagatcatcaaaaaacgagcgaaaaaatcggtccaaaccccaggccggacgcgcgttagagtctccaaagcttatccttccatccactccccgcagccagcttctcttctcgttcccggttatattaataacgcggcggcgtgctctgcttcctccggtttgctctgccctgcttcctaaacacaaacgcgctctgcacccaagaactatttacaacggagaacctagccgcggcgtccctcccttttgttggcaacctgcaacacgcacttgttgagaaaggggtagccttggcaaagggtaacctaggtgcccttgcccaagaaaaaacaaacaggccgggggaaactggcccctaacagggtttgaaaaccccccagaaaaaactccccccggtgcaaaagggccttaaaaaaaggggctggggaaatgggg

SEQ ID NO: 70174 - protein, 56 aa, Zea mays
  misc_feature: Ceres CLONE 1549301
GAPRGGGRSRTSGSPGLQEFVSPLEKSCDLPRSGAEVLDAFRFHFHGSTSLLLLLA

SEQ ID NO: 70175 - DNA, 662 bp, Zea mays
  misc_feature: Ceres CLONE 1549304
  misc_feature: Encodes the peptide sequence at SEQ ID NO. 70176
  misc_feature (613)..(613): n is a, c, t, g, unknown, or other
  misc_feature (620)..(620): n is a, c, t, g, unknown, or other
  misc_feature (630)..(630): n is a, c, t, g, unknown, or other
  misc_feature (662)..(662): n is a, c, t, g, unknown, or other
ctccccgcggtggcggccgctctagaactagtggatcccccgggctgcaggaattcgtctcacccctagaaaaaaaccgcctctacccgcaccgcgctcttcttcggatctttccctagccgcgcgtacgcgagactagccctagccgcgcgtacgcgagacaccaatcaccggcgccgctatgccgatctcctccacgctcgccacacgcctccgcaccggtcattcttccgcacccaaacccgcacggcggagcccctacaccagacccaagcccagcggcggcgccaaggcctcccgcccttccccccgccttgatccagcgaccacgagacctctcgaaccctctcagaaggcggtgcgatccggtttgggtcgccgtgccgagcccgatgtgcccgacgcgcgcgcggctgagtcgaagccgaaactggcgcatggagacgataggccgccccttgaggagaagcgccgctgcagcggtgagggcggattcgtcttcctctgcgcccttgctggacacaccgaggctattggtgggatttctctgccgtctgggtcgaacaagctctactccggcagcgtcgacggatctgttcgcatctgggactgncattccnggcaggtagnctggttctcggcttccgacgatgtatctgatn

SEQ ID NO: 70176 - protein, 160 aa, Zea mays
  misc_feature: Ceres CLONE 1549304
  misc_feature (105)..(143): Pfam Name: WD40 Pfam Description: WD domain, G-beta repeat
  misc_feature (144)..(144): Xaa is any aa, unknown, or other
  misc_feature (147)..(147): Xaa is any aa, unknown, or other
  misc_feature (150)..(150): Xaa is any aa, unknown, or other
MPISSTLATRLRTGHSSAPKPARRSPYTRPKPSGGAKASRPSPRLDPATTRPLEPSQKAVRSGLGRRAEPDVPDARAAESKPKLAHGDDRPPLEEKRRCSGEGGFVFLCALAGHTEAIGGISLPSGSNKLYSGSVDGSVRIWDXHSXQVXWFSASDDVSD

SEQ ID NO: 70177 - DNA, 718 bp, Zea mays
  misc_feature: Ceres CLONE 1549305
  misc_feature (325)..(325): n is a, c, t, g, unknown, or other
  misc_feature (343)..(343): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (406)..(406): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (687)..(687): n is a, c, t, g, unknown, or other
  misc_feature (718)..(718): n is a, c, t, g, unknown, or other
ctccccgcggtggcggccgctctagaactagtggatcccccgggctgcaggaattcgtctcacccctagaaaaactactagtgatcagaccagtgagctagcgactgtaccatgcagcagctgtaggagagcctggtggtaggtaggataggagtagcgccagccgccaagtgcgcgtccgggctggctgcttcgacgagcaggagggagccgcaccgccgggctcccgcaatgtcgcctcctccgcccccgccgctgctgcgcaacgagctgtctcgcaggacggcggtgctgggcctgcccctgtgggtgctggtgggcatcnccgtcggggccgccttcntgctgttctttccccccccccccccgggggggggggggggggtannnnnaannnnnncccaanaaattttttctctcccacacactcaccccacaccnnnngggggggccggccgtttttccccttccaccatccccccccgtgttccaagaaagatccaggaagtggcccttcccacttcggttccctccccccactacccttcagaacgggtccgccgttttcccgagggaacgggcgtctgggaacggccgaatggcggatcttttattcccctgggtcccccgggtgtgagactattgccccccttcgaccgcctgctcggggacgccggtcctccgtgnttgtcccgtgtttctgttccgcccctttccn

SEQ ID NO: 70178 - DNA, 684 bp, Zea mays
  misc_feature: Ceres CLONE 1549306
  misc_feature: Encodes the peptide sequence at SEQ ID NO. 70179
  misc_feature (684)..(684): n is a, c, t, g, unknown, or other
ggagctccccgcggtggcggccgctctagaactagtggatcccccgggctgcaggaattcgtctcaccactagataaacgcctcttctccccctaaaaagtgtagtattaggagcgatccctgggcgtcttattagaaggagagcactggaataccctggggatattcgacttaatcccttatctgcacatcgcgctttggccggctggggtaataccgaagacgcccacctctatcatccattgccgcctattgccgctcactgaatgatcaagggaaattgaccgcctcaatatcctgttaatcttcccgttacattcatgttaagtccctgcatgtgttgtcgcgatatgaagaaagcggccaactacggtgagggggatgagatcgaccgacatagcgttgagatgtgcccctgtatggacaagagtcgactatcaggaatggggatacaacgtcaaaggcgaaaaagtgtcttggggggaattgcctacaagtggaccttcaacatagtggagttttttgggtccaggtgcctataaagcttgaattagaaccctcaaggggaccccccaatttttttttttgtgggggaaaggctcccaactttgtggggggaaagaaagggaaataaacgccacctggagagcggggttccccgagggtctttgggggaggttaaan

SEQ ID NO: 70179 - protein, 31 aa, Zea mays
  misc_feature: Ceres CLONE 1549306
GAPRGGGRSRTSGSPGLQEFVSPLDKRLFSP

SEQ ID NO: 70180 - DNA, 694 bp, Zea mays
  misc_feature: Ceres CLONE 1549308
  misc_feature: Encodes the peptide sequence at SEQ ID NO. 70181
  misc_feature (584)..(584): n is a, c, t, g, unknown, or other
ctggagctccccgcggtggcggccgctctagaactagtggatcccccgggctgcaggaattcgtctcacccctagaaaaaatcaagattccgaccccaaaatccctctccgagctcgaccaaaaaccaccctctctgattcattccacccacgtccacgtacgtacgtacattcccaccacctcccagtgcagcgccagtctgtaacccataaccatggtggtcctcaccaaaggcgagctggagcagatcgcgctgccggccgtgcagcgcgcatcgccgccgccgccggccgccgtgccggaggtcgacctggcagccggggacgccgccgccgcgcgcgccgtggccaaggcgtgcgaggaccacggcttcttcaaggtgacgggccacggcgtgccgccgcacctcctggcgcgcctcgaggccgcccgcgccgcgttcttcgcgctcccgcagcgggagaaggacagggccgccggctgcccgttttcgatacgcagcaagcggattggcgccaacggcgatctcggctgggtcgagtacctcttgctttgcgttcacgccgcccgggcagcggccgcncctgtgtctgcctgccagggccccggaacccccttggttccctgctgtgcttgaccaaatatttggcggccggggaggggcatgacactgaccgtgctgcaactgatggc

SEQ ID NO: 70181 - protein, 140 aa, Zea mays
  misc_feature: Ceres CLONE 1549308
  misc_feature: SWISSPROT Homolog: EC 1.14.11.13 Gibberellin 2-beta-dioxygenase
MVVLTKGELEQIALPAVQRASPPPPAAVPEVDLAAGDAAAARAVAKACEDHGFFKVTGHGVPPHLLARLEAARAAFFALPQREKDRAAGCPFSIRSKRIGANGDLGWVEYLLLCVHAARAAAAPVSACQGPGTPLVPCCA

SEQ ID NO: 70182 - DNA, 726 bp, Zea mays
  misc_feature: Ceres CLONE 1549312
  misc_feature: Encodes the peptide sequence at SEQ ID NO. 70183
  misc_feature (307)..(307): n is a, c, t, g, unknown, or other
  misc_feature (328)..(328): n is a, c, t, g, unknown, or other
  misc_feature (386)..(386): n is a, c, t, g, unknown, or other
  misc_feature (388)..(388): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (399)..(399): n is a, c, t, g, unknown, or other
  misc_feature (406)..(406): n is a, c, t, g, unknown, or other
  misc_feature (409)..(409): n is a, c, t, g, unknown, or other
  misc_feature (644)..(644): n is a, c, t, g, unknown, or other
  misc_feature (647)..(647): n is a, c, t, g, unknown, or other
  misc_feature (659)..(659): n is a, c, t, g, unknown, or other
  misc_feature (724)..(724): n is a, c, t, g, unknown, or other
ctccccgcggtggcggccgctctagaactagtggatcccccgggctgcaggaattcgtctcacccctaggaaaacaccttccgtctcccggcctccgctcgcctgtccctgtctctctctctcctcgctgagtcgccgccagccatgaacaacctcctcacggattcctttgagctcccccggcgggactcctcaagagatgcagacattgaaatgggaatgcatcaagctgatgcttcaaacaacttaaaagattttgaagaaggtcgatacaattgacagttaattagcaaagctgacaaatctnttgaataatctacagactgcnaatggaggaatccaaagctgttttctaccccccctcccctggggggggggtggggggncnaatnnanaaanaattttnatnaagtggggaaaaattagctcatacagggcaaagaacaaggggggggggattggaaaaaaaaaaaccttttcaaattaggcaaaaaccctggaatgtggaaaaaggttcttgcccgtggacccctataggggaggggcaaacttccgggaggctgtggaacaagaaaattgatagggacccggatcgcttcgacttttccaccccttcggccaccacccgctcctgccactcgggnacncggggagagctnttgcaacaaaacttttttttttcccgcgacaccgggtcactccgcgcgggcagggagaaagcgcncg

SEQ ID NO: 70183 - protein, 44 aa, Zea mays
  misc_feature: Ceres CLONE 1549312
MNNLLTDSFELPRRDSSRDADIEMGMHQADASNNLKDFEEGRYN

SEQ ID NO: 70184 - DNA, 688 bp, Zea mays
  misc_feature: Ceres CLONE 1549313
  misc_feature: Encodes the peptide sequence at SEQ ID NO. 70185
cgcggtggcggccgctctagaactagtggatcccccgggctgcaggaattcgtctcacccctagaaaaaaaagcctacggggtactgctacctcaacgagcgtatctgcttttttttttttggtaaaagaatttgtttttgcaaagctagctcctacgctgccgccgccatgcaccgcttcgccgccgacagggcgcgccgcgcggtggccgcgtccctgcgcggcgcagcttccagagcagcagcagcgccgtcgcgtcacgctccggcgcctcgccatccaacctccccagtcggggcggcggcgccggttgctgccgccgccatggcgagggccgccatgtccacggcggtcgcgggcgtggaacccccgggtgtcgctcgacaccatcagcccccaagtgcccgcagtgtcgctcgacaccatcaaacccaaggtcttgaaagtgtcattttgcagtccggggaagagattgtcacacgtggcttcagaaactggcacaagacctgcagaagaattccagagtccccttcctttttgatgagaaacctctactggaaccatggaaaatcccccattccattgggccaacagccaggttccctattttcaaaaaaagtcctatccttaatgggaaaaaacccagccctcccgggcaaaaagggaaaacgcaggcttttatacggg

SEQ ID NO: 70185 - protein, 121 aa, Zea mays
  misc_feature: Ceres CLONE 1549313
MARAAMSTAVAGVEPPGVARHHQPPSARSVARHHQTQGLESVILQSGEEIVTRGFRNWHKTCRRIPESPSFLMRNLYWNHGKSPIPLGQQPGSLFSKKVLSLMGKNPALPGKKGKRRLLYG

SEQ ID NO: 70186 - DNA, 695 bp, Zea mays
  misc_feature: Ceres CLONE 1549315
  misc_feature: Encodes the peptide sequence at SEQ ID NO. 70187
tggagctccccgcggtggcggccgctctagaactagtggatcccccgggctgcaggaattcgtctcacccctagaaaaagcgcgatcccattcccattctcttgctcaatagcaacctgccggcttcagcaagccgcagcgccaagcctagaagcggagcgcggaacacacgaggccaggaagaggaggtgctgccgtccccgcgccgccgctgtgggagtgcggggaatggggcggcacagcgtggaccagatcggcgctgtggcagcgttcgtctgggtcaccctccttcccttgctgcttgtgtgcgtcgtgtggccgggcgcccagaccggccatacaagcgagtaccggcgccaactcggctccgccatcgacatgccactcgacgccaatgtcttcctccctccctcgggctacaatgcgctcgagcaggttcacatcacactaggcgatcttgatggcacagccttgataatctcatgagtgacaacatgtggagcatggctcgagtactgtgatctacgagacttcagaggaggacctcaactatactgctagatggaagcatactctgaatactttctacagctacacctcatgatgcattcatctttgcacgatgaaaaaagtaggggtttgaccccaagcagtactactgcgtttggaatgggaccaacttggaaggaaatttt

SEQ ID NO: 70187 - protein, 85 aa, Zea mays
  misc_feature: Ceres CLONE 1549315
  misc_feature: SWISSPROT Homolog: EC 3.1.3.2 Acid phosphatase
MGRHSVDQIGAVAAFVWVTLLPLLLVCVVWPGAQTGHTSEYRRQLGSAIDMPLDANVFLPPSGYNALEQVHITLGDLDGTALIIS

SEQ ID NO: 70188 - DNA, 663 bp, Zea mays
  misc_feature: Ceres CLONE 1549316
  misc_feature: Encodes the peptide sequence at SEQ ID NO. 70189
  misc_feature (502)..(502): n is a, c, t, g, unknown, or other
ctccccgcggtggcggccgctctagaactagtggatcccccgggctgcaggaattcgtctcacccctagaaaaagcaaacccctctcgatcgacgcacgcagccgcgacccatcgcgacctgacccgaccctcccgaggccgccagccttatcctctccgcctccgcctcccgccgtcccccgcgacccatcgcaagcgcgagtagaagacatggcctcgacgttcggtgccacttctacagttggccttatggctgctccaacggggaagaatgtgcgccttcagaggagggctaacttcagagtaaaagcggctaaggagctgtacttcaacaaggatgggtcagctatcaagaagctccagactggagtcaataagcttgcagacctagttggagttacactcggaccgaagggaaggaatgtcgttttggagagcaagtacggctctcccaagattgttaacgatggcgttacagttgcaagagaggttgagctggangaccctgtggaaacattggagctaaattggtcaggcaagctgcagctaagaccaacgatcttgctggagatgggacaaccacctctgtggtccttgctcaggggctaattgctgagggtgttaagtcgtagcagctggggctaatctgtcagattactcgg

SEQ ID NO: 70189 - protein, 132 aa, Zea mays
  misc_feature: Ceres CLONE 1549316
  misc_feature (97)..(97): Xaa is any aa, unknown, or other
MASTFGATSTVGLMAAPTGKNVRLQRRANFRVKAAKELYFNKDGSAIKKLQTGVNKLADLVGVTLGPKGRNVVLESKYGSPKIVNDGVTVAREVELXDPVETLELNWSGKLQLRPTILLEMGQPPLWSLLRG

SEQ ID NO: 70190 - DNA, 663 bp, Zea mays
  misc_feature: Ceres CLONE 1549317
tccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgacacgtcgctctacgtgggcgacctggaggggggcgtctcggactcccagctgtacgaactctttcgcccagggggggagggggtgtcggtgcccgtctgcagggatgtccctcgcgccgctcggtgggatacccctactcaactaaaggaatcctttggatggctgcaaaaactttggaagggctaaacttggcgggctttaaaaaaaagcctttcggggggggatgttttaaaccccgtgatccaaagcccccccaagggaggggaattgcgaaaaatttttctaaaaaattttggaaaaa

SEQ ID NO: 70191 - DNA, 732 bp, Zea mays
  misc_feature: Ceres CLONE 1549318
  misc_feature: Encodes the peptide sequence at SEQ ID NO. 70192
  misc_feature (635)..(635): n is a, c, t, g, unknown, or other
ggagctccccgcggtggcggccgctctagaactagtggatcccccgggctgcaggaattcgtctcacccctagaaaaaacagccatcacacgcacgcatacacagcacagagtgaggtaagcatccgaaaaaagctgtgatctgatcgacatggccgccgccaccatggctctcacctcccgcgcgctcgtcggcaagccggcgaccagcaccagggacgtcttcggcgaggggcgcatcaccatgcgcaagactgctggcaagcccaagccagcggcgtccggcagcccctggtacggggccgaccgcgtcctgtacctgggcccgctgtccggccagcccccaagctacctgaccggcgagttccccggcgactacggctgggacaccgcggggctgtccgccgacccggagactttcgccaagaaccgcgagctggaggtgatccactgccgctgggccatgctgggcgcgctcgggtgcgtgttcccggagctgctcgccccgcaccgcgtcaagttcggcgaaggccgtgtggtttcaaggccgggtccccagatctcagcgagggcgggctggactacctcggcaacccgagcctgatccacgcgcaagcatcctggcccatctgggcntgccaggtggtgcctcatggggcgcccgtccaggggtaccgcaatccccggtgcccctctcggggaagtggtcaaccccttttaccccggggggatt

SEQ ID NO: 70192 - protein, 145 aa, Zea mays
  misc_feature: Ceres CLONE 1549318
  misc_feature (58)..(143): Pfam Name: Chloroa_b-bind Pfam Description: Chlorophyll A-B binding protein
MALTSRALVGKPATSTRDVFGEGRITMRKTAGKPKPAASGSPWYGADRVLYLGPLSGQPPSYLTGEFPGDYGWDTAGLSADPETFAKNRELEVIHCRWAMLGALGCVFPELLAPHRVKFGEGRVVSRPGPQISARAGWTTSATRA

SEQ ID NO: 70193 - DNA, 713 bp, Zea mays
  misc_feature: Ceres CLONE 1549320
  misc_feature: Encodes the peptide sequence at SEQ ID NO. 70194
  misc_feature (622)..(622): n is a, c, t, g, unknown, or other
  misc_feature (623)..(623): n is a, c, t, g, unknown, or other
  misc_feature (713)..(713): n is a, c, t, g, unknown, or other
caaagctggagctcaccgcggtggcggccgctctagaactagtggatcccccgggctgcaggaattcgtctcacccctagaaaaagcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggcaaggaccccaacaagcctaagagggctcccagcgctttcttcgtgttcatggaggaatttcgcaaggagttcaaggagaagaaccctaagaacaagtctgtcgctgcggtggggaaagctgctggcgacaggtggaaatccctgagcgagtcggacaaggctccctatgtagccaaggctaacaagctcaagctcgagtacaacaaggccatcgctgcctacaacaagggcgagagcactgcagctaagaaggctcccctgccaggagaanngagagaagatgaagaggagtctgacaagtccaagtcggaaggtcatgacgaggatgatgaacagggtagtgagggagatgacgatgatgn

SEQ ID NO: 70194 - protein, 155 aa, Zea mays
  misc_feature: Ceres CLONE 1549320
  misc_feature (41)..(110): Pfam Name: HMG_box Pfam Description: HMG (high mobility group) box
  misc_feature (126)..(126): Xaa is any aa, unknown, or other
MKGAKSKGAAKADAKLAVKSKGAEKPAKGRKGKAGKDPNKPKRAPSAFFVFMEEFRKEFKEKNPKNKSVAAVGKAAGDRWKSLSESDKAPYVAKANKLKLEYNKAIAAYNKGESTAAKKAPLPGEXREDEEESDKSKSEGHDEDDEQGSEGDDDD

SEQ ID NO: 70195 - DNA, 680 bp, Zea mays
  misc_feature: Ceres CLONE 1549322
  misc_feature: Encodes the peptide sequence at SEQ ID NO. 70196
ctggagctccccgcggtggcggccgctctagaactagtggatcccccgggctgcaggaattcgtctcacccctagaaaaatccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccgggcggcggcagatcaccgacgagttcaccggcgccggcgccatcggccaggtgtgccaggtgatcggcgccgtcgtcaacgtgcgctacgatgaggggctccggcccatcctcacggggctcaaggtgctcgaaaacaacctccgcctcgtgctccagggtggcgcaccccctggccaagaacatggggccccccatccctttggacggccccgagggggtccccccggggccaggcttccctcaaaagtgggtcccccatacccggggccggttggggggggccccccttgggacgttattttaaggttttccgggggg

SEQ ID NO: 70196 - protein, 174 aa, Zea mays
  misc_feature: Ceres CLONE 1549322
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGRRQITDEFTGAGAIGQVCQVIGAVVNVRYDEGLRPILTGLKVLENNLRLVLQGGAPPGQEHGAPHPFGRPRGGPPGARLPSKVGPPYPGPVGGGPPWDVILRFSGG

SEQ ID NO: 70197 - DNA, 667 bp, Zea mays
  misc_feature: Ceres CLONE 1549324
  misc_feature: Encodes the peptide sequence at SEQ ID NO. 70198
  misc_feature (505)..(505): n is a, c, t, g, unknown, or other
  misc_feature (506)..(506): n is a, c, t, g, unknown, or other
  misc_feature (667)..(667): n is a, c, t, g, unknown, or other
tccccgcggtggcggccgctctagaactagtggatcccccgggctgcaggaattcgtctcacccctagaaaaaaattgccgacgtagccgtcgtcttcgccagagcagcgccagcggttgttttgttcctcctcgtcggacccagcgttctagtcgagcatggcttcgattccgcctccgtcttcctccgtcgctgccctcacccgccaaccggcccagttcttgaaagggtgcagtgtatccaaggagacaaaggcatcggtctgcagtttcttggctacaaattcaaacagcactagggtgaaatcagtgggcttgagagtagcatcatccttcaaaaatgatggtggttatccagctgacggtttctctgggaatggcacacgctattgccaaaaagcacatccgttcgtggcgaggacatccgggtgctgatccctgtactccaatggattcaatgatgacgccagaaatcctctctgctaattggcactttgtatggacnnagtctcagatgatgacacagatactgaacttgatttggatagcccgaccgagggctccgcgtcaattgcgatgccattgaagacgtacgggcaagaaaactttgggattgtttgtgatgaccaatccgggaaaaatgaagaaatctgatatgggctgcccn

SEQ ID NO: 70198 - protein, 91 aa, Zea mays
  misc_feature: Ceres CLONE 1549324
MASIPPPSSSVAALTRQPAQFLKGCSVSKETKASVCSFLATNSNSTRVKSVGLRVASSFKNDGGYPADGFSGNGTRYCQKAHPFVARTSGC

SEQ ID NO: 70199 - DNA, 712 bp, Zea mays
  misc_feature: Ceres CLONE 1549325
  misc_feature: Encodes the peptide sequence at SEQ ID NO. 70200
ccatgctgtagctcaccgcggtggcggccgctctagaactagtggatcccccgggctgcaggaattcgtctaacccctagaaaaatgaccaacgtgctcgatctccatctcgaccgtcgctcatcgggaagctactctacgacgaagcatggcgtccgtcaccgcccgcgccccggtcgcagccctgcgcccgtcgtcgtcgtcggccttccttgaccactctagccgcctctgccgcactgctaccgcatcacagacgaggcgcactctcaaagcggaggccaaggacgagtggctaccgggacttccctcccccgcctacctcgacggcagcctgccgggtgacaatggattctacccgttgggcctggcggatgacccggagaacctgaggtggtacgtgcacccccaccacgtgaacgggcggatggcaatgctgcgcgtggccgggatgctgatcccggatgagctgaccaaggtcgggctgatcaacgcgccgcagtggtacgacgccggcaagtcggagtacttcgagtcgacatcgacgctgtttcgtgatctatttcatcgtgttctaccaggagctagatccggttgtgggaaggacatctggcaacccccgccggcgacaattcaggaccccctccttcaggagcttacagcttggccgcccgcacgaagtgcctggtaacccccggtagaagtcctacaa

SEQ ID NO: 70200 - protein, 180 aa, Zea mays
  misc_feature: Ceres CLONE 1549325
  misc_feature (54)..(173): Pfam Name: Chloroa_b-bind Pfam Description: Chlorophyll A-B binding protein
MASVTARAPVAALRPSSSSAFLDHSSRLCRTATASQTRRTLKAEAKDEWLPGLPSPAYLDGSLPGDNGFYPLGLADDPENLRWYVHPHHVNGRMAMLRVAGMLIPDELTKVGLINAPQWYDAGKSEYFESTSTLFRDLFHRVLPGARSGCGKDIWQPPPATIQDPLLQELTAWPPARSAW

SEQ ID NO: 70201 - DNA, 732 bp, Zea mays
  misc_feature: Ceres CLONE 1549326
  misc_feature: Encodes the peptide sequence at SEQ ID NO. 70202
  misc_feature (476)..(476): n is a, c, t, g, unknown, or other
ctggagctcaccgcggtggcggccgctctagaactagtggatcccccgggctgcaggaattcgtctcacccctagaaaaatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggggaaggccaagccggcggcggcgtccgggagcccgtggtacggccccgaccgcgtgctgtacctgggcccactgtccggcgagccgccgagctacctgacgggcgagttcccgggcgactacggctgggacaccgcggggctgtcggcggacccggagacgttcgccaagaaccccggagctggagtgatccactcccgctgggccatgctgggcgcgctncgctgcgtcttcccggagctgctcgcccgcacggcgtcaagttcgcgaaggccgtgtggttcaaggccggcttccagatcttcagcggaggtggaactggactacctcggggaaccgaggcctcatccacgcgcaaagcatcctcgccattctgggctgtgccagtcctggccatgggggccccttcaaggttaaacccatccccgggggcccctcttggggaaagtcttcaacccctctttacccgggggggatc

SEQ ID NO: 70202 - protein, 175 aa, Zea mays
  misc_feature: Ceres CLONE 1549326
  misc_feature (65)..(147): Pfam Name: Chloroa_b-bind Pfam Description: Chlorophyll A-B binding protein
MASSTMALSSTAFAGKAVNVPSSSAFGEARVTMRKTAGKAKPAAASGSPWYGPDRVLYLGPLSGEPPSYLTGEFPGDYGWDTAGLSADPETFAKNPGAGVIHSRWAMLGALRCVFPELLARTASSSRRPCGSRPASRSSAEVELDYLGEPRPHPRAKHPRHSGLCQSWPWGPLQG

SEQ ID NO: 70203 - DNA, 663 bp, Zea mays
  misc_feature: Ceres CLONE 1549329
  misc_feature: Encodes the peptide sequence at SEQ ID NO. 70204
  misc_feature (400)..(400): n is a, c, t, g, unknown, or other
  misc_feature (405)..(405): n is a, c, t, g, unknown, or other
  misc_feature (464)..(464): n is a, c, t, g, unknown, or other
  misc_feature (465)..(465): n is a, c, t, g, unknown, or other
  misc_feature (496)..(496): n is a, c, t, g, unknown, or other
agctccccgcggtggcggccgctctagaactagtggatcccccgggctgcaggaattcgtctcacccctagaaaaaatctcccttccgttccccaattcgaaatcgaatcgggtccgacgggtcggtcttgccgtgcgtgcgtggctgcgcgagcgactcgactgcacccccgctcctcccagtccccacacactgcgcgccgccgccgggtcctcctagggtttcgccgcgatgtcgctccggccgagcgagcgggagcagatgcggaagggcaactacaagcagacggtagacgcggaggagagccgccgccgccgcgagggccagatggtggacatccgcaaggccaagcgcgaggaaagcctcagaagaagcgccgcgatggggttccgccctcgncggcngtgtgcccgcgatggggcactccaccgcgctccagcaaaagctcgatggcttgcccgcnnatggtgcaggcgtccactccaacgacccctncgtggagctttgaggccaccacacagtccaggaagctgctttcctaaggacgtagtcccccaatccaagaagtggatccgccacggaatgggggccccgattcattgagttttcttacccgtgaggaccatccccaacccccgtttggaggtgcttgggccctcccc

SEQ ID NO: 70204 - protein, 123 aa, Zea mays
  misc_feature: Ceres CLONE 1549329
  misc_feature (4)..(93): Pfam Name: IBB Pfam Description: Importin beta binding domain
  misc_feature (58)..(58): Xaa is any aa, unknown, or other
  misc_feature (78)..(78): Xaa is any aa, unknown, or other
MSLRPSEREQMRKGNYKQTVDAEESRRRREGQMVDIRKAKREESLRRSAAMGFRPRRXCARDGALHRAPAKARWLARXWCRRPLQRPLRGALRPPHSPGSCFPKDVVPQSKKWIRHGMGAPIH

SEQ ID NO: 70205 - DNA, 717 bp, Zea mays
  misc_feature: Ceres CLONE 1549334
  misc_feature (231)..(231): n is a, c, t, g, unknown, or other
  misc_feature (239)..(239): n is a, c, t, g, unknown, or other
  misc_feature (260)..(260): n is a, c, t, g, unknown, or other
  misc_feature (263)..(263): n is a, c, t, g, unknown, or other
aaagctggagctcaccgcggtggcggccgctctagaactagtggatcccccgggctgcaggaattcgtctcacccctagaaaaaagcagcagccagcagcgggggctggagcactcaccactcagcagcgatcgcagcaccgcggcgagataatgagcagcagcctgtcctccggcatctctgccctcgcatctgcagcggccagcaccgctcggcgcccgcatgacgcancgccccancacctgacaaaggtgaaggcngcngccccgccaaacttgctcaccccggcccgcggggttccattgcccgaagaaacccggccgccccccccttgtggttaaggcccggccttggcccctttcgaaaatcagcccggacctgagagaaaaccccttcaaagtttacccgcccaagcggttttccccggaggaatttcgaaaccggaaaatttacggaaacccccccctttttttaagaggcaaaaaaaaaagggtttttgggggaaaatttcccaaaggggccaaaaaaaaagaaaacccccccggggtttttaaaaccctcccccgggggatttttccccccggaaaacaccccggggggggtttttaataggcgggggggaaaatattttaatatagtgggggggcccctttactggggggggtttccccccccaccagggggggggaccccccaaaaaccccccaaatttttggc

SEQ ID NO: 70206 - DNA, 663 bp, Zea mays
  misc_feature: Ceres CLONE 1549337
  misc_feature (536)..(536): n is a, c, t, g, unknown, or other
ggagctccccgcggtggcggccgctctagaactagtggatcccccgggctgcaggaattcgtctcacccctagaaaaaacggtcacggcaccgcccccgcacccactgccctctagcttcttcctccccgctttcatggcaggaaaggctgaggcgatgatgcccataggccatccagtttgatccatgccatcctgaacctctatacatactgccccagcccgggcactcgcgatctctacttctctaccgccgctgtgcctgtgctagctcctctctctgcttctgcttctgcttttgcctcactcagcctgctgcaagcttttgctttggtttaggtgcttcttttgcattcctttactgttcccccccactttcgctcgctttgccacgcacacgaaaagctcctgcctttaccttctcggaccttatctccgccccgtagtgggatttgggtgggagctgcgctgcagctgcttgccccctcgcgtttcttgctcaattgggggtgtcccgcgtgctcgtgggcggattcngtgttcttgcttgcgcggtccacgtccccgtccccgtcccccatccttggcgcgattgcggttgcggacgctcgctgcagatcttcgcgcgactccgggagcgccgccggagatgactgcgggcgcc

SEQ ID NO: 70207 - DNA, 661 bp, Zea mays
  misc_feature: Ceres CLONE 1549339
  misc_feature: Translation starting site: 176
ctccccgcggtggcggccgctctagaactagtggatcccccgggctgcaggaattcgtctcacccctagaaaaaagagtaccaatccagcgaaaccatgcgaggggagtactacaatcgcaaataactcttcccttccctctccacccccccgttccatccctaccactgacaccatgtccgcccgcatcgacctcaacaacaacgccggatccgcctcccaaaccctggcggcacacaagcgcggccgcggccgcccccgcaagaaccccccgccccccgctcacccgcgccctccgcatcccgacacccccatggtcagcggcttcgctccgggcgacatggtctggggaaagaagctgaaccacgccgcctggccgggcctcatctactccgccggagggaacggcaccggccacgagggccagcttctcgtatcctactttggcgacaaggccttcgcctggtgcgacacagccgagctcaggccctatgaaccctacttccctgtcgccgagctctatgacgacggcggcgaggatttcgacgccgccgtcgaggcctccctcgacgagttctccagccgcgtcgagtccgccctcgcctccgccgcccgccctttcgcccccgccgatttccctgcctcgctccatgatctcgcc

SEQ ID NO: 70208 - DNA, 665 bp, Zea mays
  misc_feature: Ceres CLONE 1549340
  misc_feature: Encodes the peptide sequence at SEQ ID NO. 70209
  misc_feature (457)..(457): n is a, c, t, g, unknown, or other
ctccccgcggtggcggccgctctagaactagtggatcccccgggctgcaggaattcgtctcacccctagaaaaaaaaggctcgcagcgaagccgccctcacagtcacagctacttctgctcgcccgccactcggagtagcgtagtgccgtgcggtggtgagtgacaggaaggatggaagaaggcttcaccggcggcgtccggatcgtgtccaggcgtctcgtccggccggagccgaccgcgagctcgccggacaacaacagcgcgccaccggaagaggaggaggatgagataatgcacatgacgccgtgggatctgcgcatgatcacggtggactacatccagaagggactgctcctgcccaagcccccggcagcaggcggggcacacgcgcaccgactcgtggacgggcctcgctcgtccttcgcacgcgccctggccggcttctaccctctggcnggcccgctcgcgtgaatgccgccacggggggccgggggtcgtcttctccttccgcttgaagggggagggcggccaatttctccaccccaaggccccggaggtcacggtaaggaaattattacgttggcccgaaggcaattattagttccccagggcggtgggtttggtgccctttcccctttaaaagggggtgtggggcccggaaccc

SEQ ID NO: 70209 - protein, 99 aa, Zea mays
  misc_feature: Ceres CLONE 1549340
MEEGFTGGVRIVSRRLVRPEPTASSPDNNSAPPEEEEDEIMHMTPWDLRMITVDYIQKGLLLPKPPAAGGAHAHRLVDGPRSSFARALAGFYPLAGPLA

SEQ ID NO: 70210 - DNA, 3155 bp, Zea mays
  misc_feature: Ceres CLONE 1549345
  misc_feature: Encodes the peptide sequence at SEQ ID NO. 70211
ccttccccaacactccaagctagtccaagaggcgagcagcagagagggaaagcgaatcccctcctctcctcctcccactcttcaatgctctccccgtcccctccgccatggacgccgccgccctcgccctctccatcatcctgctcgccgccgccgccgccaccactctcgcccgcggggccacgcacccggcggaccaggcggcgctggaggaccttcggaaatcgctgacgaacccggacgcgctggggtggcccgacgacggggacgcgtgcgcgtggccgcacgtctcctgcgaccgcaccggccgcgtcgacaacctcgacctcaagaacgccggcctggcggggacgctcccgccgtcgctcccctcgctcgcggcgctgcgcgacctcagcctccaggggaacagcctctctggcgcgctcccgtccttccggggcatggcgtccctccagcgcgccttcctcaacgacaacgacttcgacgccatcccgcccgacttcttcgacggcctcgccgacctgctcgagatctcgctcgccaacaacccgcgcctcaacgcgtcccagggcggctggacgctcccgcggggcctcgccgactcgtcgctgcagctgcaggcgctctccctcgacaactgcagcctcaccggcgggatcccggactccctcgcccgcctcacgggcctccagaacctcacgctctcctacaacaacctctccggccccgtccccgccgcgctcaacggctccgccatccagaggctgtggctcaacaaccagcaaggggacgccaagctctccggcaccctcgacgtcgtcgccaccatgaccggcctccaggagctctggctccacggcaacgacttctccggcccggtccccgacgccatcgccagctgcaaggaactctacaccgtcaggctcaacaacaaccagctcctcggcctcctgccgcccggcctcgccgcgctccccgcgctccgggagctcaagctcgacaacaacaacctactgggccccgtcccggcgctcaaggcccccactttcaccttctccgggaacgagttctgcgccgccaaacccggggaagcctgcgccccggaggtcatggcgctgctgcacttcctcgccgaggtgcagtacccgaacaggctggtcgggacctggtccgggaacgacccctgcgcgggctggctcggcgtcacctgcgtccagggcaaggtcactatgctcaacctgccggggtacggcctcaacggcaccgtcagccagagcctcgccaacgtcaccacgctctccgaagtgaacctcgccgggaacaacctcaccggccgagtgccggacagcctcaccaggctggcctcgctccagaagctggacctgtccatgaacgacctgtatggcccgctgcccgcattcagtcccaccgtggatgtgaacgtcaccggcaatctcagcttcaacacaacggatacgcagccaacggatgcgcagccaaacggcgagtccccgcggcctcgtcctacgcctggcgcatctgctggtgctgggggtaatactagtgcaggggggatccctgggagtgggaagaaggcctcatcagctgtgttgctgggcacaaccattccagtcgcggtgagcgtggtcgcactggtctccgtgggcgccgtgttcttgtgcaagagaagagcgtcggtgccgccgcaggcagcctccgtggtggtgcatccccgtaatagctctgatccggacaacctggccaagatcgtggtggccaccaacgacgacggcagcagcagcggcacgtcccatagcgggagcagcagcggccaggctggcgacgtgcacgtggtggaggccggaagtttcgtgatcgcggtgcaggtcctccgtggcgccaccaggaacttcgcccaggacaatgtgcttggccgtgggggatttggggtggtctacagaggggagctgcacgacggcaccatgatcgcggtgaagaggatggaggccgtggcggtgagcaacaaggccttggacgagttccaggccgagatcgccgtcctgaccaaggtccggcaccgcaacctggtgtcgatactgggatacgcgatcgaagggaacgagaggctgctggtgtacgagtacatgcccaacggggctctgagcaagcacctgttccactggaaacagttgcagctggagcctctctcgtggaagaagcgtctcaacatcgccctggatgttgcccgtgggatggagtacctgcacaacctggggcaccaccgcttcatacatagggatctcaagtcagcgaacattctcctcggcgacgacttccgggccaaggtggcggacttcgggctcatgaaagatgcgccggatgggaactactctgtggcgaccagacttgccgggacgttcgggtacttggctcctgagtatgcagttaccgggaagatctcgacgaaagcagacgtgttcagcttcggtgtagtgctgctggagctgataacagggacgacggccatcgacgacagccgcgtgggcgagggcgaggagacccggcacctggcgtactggttcagccagatacggaaggacgcggagcagctgcgcgcggcgatcgacccggccctggacgtgggcgacggcgagacaatggagagcatcggcgtgatcgcggagctggcggggcactgcacggcccgggagccgtcgcagcggccggacatggggcacgcggtgaacgtgctggtgcccatggtggagaagtggaggcccgtgaaggacgaggccgaggactacctgggcatcgacctgcacctgccgctgctgcagatggtgaagagctggcaggacgcggaggccggcggcctgacggacggcggcgggagcgtcatgagcctggacgacagcaagggcagcatccccgcccgccccgccggcttcgccgagtccttcacctcggccgatggccggtgatcggatgcatgcaatgcatgcatccatgtgtctctcaaatgtctctcgtctcccggtccctcccttgcctgttttcgcacattcgttgctgtaggtacaaaagaaagcagtacatgggatcgtcgtccatgtgcacaaccttgtgcttcttcttaaaaaaaaaaaaaaaaa

SEQ ID NO: 70211 - protein, 958 aa, Zea mays
  misc_feature: Ceres CLONE 1549345
  misc_feature (603)..(883): Pfam Name: Pkinase_Tyr Pfam Description: Protein tyrosine kinase
  misc_feature: SWISSPROT Homolog: EC 2.7.11.1 Non-specific serine/threonine protein kinase
MDAAALALSIILLAAAAATTLARGATHPADQAALEDLRKSLTNPDALGWPDDGDACAWPHVSCDRTGRVDNLDLKNAGLAGTLPPSLPSLAALRDLSLQGNSLSGALPSFRGMASLQRAFLNDNDFDAIPPDFFDGLADLLEISLANNPRLNASQGGWTLPRGLADSSLQLQALSLDNCSLTGGIPDSLARLTGLQNLTLSYNNLSGPVPAALNGSAIQRLWLNNQQGDAKLSGTLDVVATMTGLQELWLHGNDFSGPVPDAIASCKELYTVRLNNNQLLGLLPPGLAALPALRELKLDNNNLLGPVPALKAPTFTFSGNEFCAAKPGEACAPEVMALLHFLAEVQYPNRLVGTWSGNDPCAGWLGVTCVQGKVTMLNLPGYGLNGTVSQSLANVTTLSEVNLAGNNLTGRVPDSLTRLASLQKLDLSMNDLYGPLPAFSPTVDVNVTGNLSFNTTDTQPTDAQPNGESPRPRPTPGASAGAGGNTSAGGIPGSGKKASSAVLLGTTIPVAVSVVALVSVGAVFLCKRRASVPPQAASVVVHPRNSSDPDNLAKIVVATNDDGSSSGTSHSGSSSGQAGDVHVVEAGSFVIAVQVLRGATRNFAQDNVLGRGGFGVVYRGELHDGTMIAVKRMEAVAVSNKALDEFQAEIAVLTKVRHRNLVSILGYAIEGNERLLVYEYMPNGALSKHLFHWKQLQLEPLSWKKRLNIALDVARGMEYLHNLGHHRFIHRDLKSANILLGDDFRAKVADFGLMKDAPDGNYSVATRLAGTFGYLAPEYAVTGKISTKADVFSFGVVLLELITGTTAIDDSRVGEGEETRHLAYWFSQIRKDAEQLRAAIDPALDVGDGETMESIGVIAELAGHCTAREPSQRPDMGHAVNVLVPMVEKWRPVKDEAEDYLGIDLHLPLLQMVKSWQDAEAGGLTDGGGSVMSLDDSKGSIPARPAGFAESFTSADGR

SEQ ID NO: 70212 - DNA, 676 bp, Zea mays
  misc_feature: Ceres CLONE 1549350
  misc_feature: Translation starting site: 231
  misc_feature: SWISSPROT Homolog: EC 3.2.1.26 Beta-fructofuranosidase
  misc_feature (498)..(498): n is a, c, t, g, unknown, or other
  misc_feature (507)..(507): n is a, c, t, g, unknown, or other
  misc_feature (676)..(676): n is a, c, t, g, unknown, or other
ctccccgcggtggcggccgctctagaactagtggatcccccgggctgcaggaattcgtctcacccctagaaaaatcccacccctcgcccaatgcgtagttgtatctgcatctccaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccggccgccgacgccgcgtcggccgaggtcttcggcaccggcaggacgcggagcaggcggcggcccctctgcgcggcggcgctcgtgctctccgccgcgctgctcctagccgtggccgcgctcgtcggcgtcggtagccggcccggcgcggtggggatgacagagtcggcggcctcgtcgccgacgccgagcaggagcaggggcccccgagccngcgtgtccnaagagaacgtcggcgcgtctgacgacggcggcaggctccctggaagccgcgggaaacgccttcccgtggagcaatgcaatgctgcaattggcagccccacggaattcccactcccaccccacgaaaaactggatgaccgacccccaatggcccccgtgtactaccaggn

SEQ ID NO: 70213 - DNA, 733 bp, Zea mays
  misc_feature: Ceres CLONE 1549355
  misc_feature: Encodes the peptide sequence at SEQ ID NO. 70214
  misc_feature (421)..(421): n is a, c, t, g, unknown, or other
  misc_feature (422)..(422): n is a, c, t, g, unknown, or other
aaagctggagctccccgcggtggcggccgctctagaactagtggatcccccgggctgcaggaattcgtctcacccctagaaaaagcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaacggccgcaggatcagggagctcacgtctgtcgtccagaagaggtttcacttnncccgagaaacgcgtcgagctctacgccgaggaggtcgtcaaccgcggcctctgcggcatcgcgcaggctgagtcccctccgctacagctccttcgaaggcttgccgtccggagggcctgctatggtggtcctcccttggtaaggaaagtgtgcccagggttggtgaggccattgtgagtggaaagctcaagggctccaaaaaccaagtccctgaaaattcaggatgggctcctgatcccctctggtccgcccgtgaatgaataccttcaccccccttgggaaaaacctcccccctaaaaaggggggtttgg

SEQ ID NO: 70214 - protein, 102 aa, Zea mays
  misc_feature: Ceres CLONE 1549355
  misc_feature (79)..(79): Xaa is any aa, unknown, or other
  misc_feature (80)..(80): Xaa is any aa, unknown, or other
MATQISKKKKFVSDGVFYAELNEMLTRELAEDGYSGVEVRVTPMRTEIIIRATRTQNVLGENGRRIRELTSVVQKRFHXXRETRRALRRGGRQPRPLRHRAG

SEQ ID NO: 70215 - DNA, 682 bp, Zea mays
  misc_feature: Ceres CLONE 1549356
  misc_feature: Encodes the peptide sequence at SEQ ID NO. 70216
  misc_feature (382)..(382): n is a, c, t, g, unknown, or other
  misc_feature (500)..(500): n is a, c, t, g, unknown, or other
tggagctccccgcggtggcggccgctctagaactagtggatcccccgggctgcaggaattcgtctcacccctagaaaaagctcactcgtgccgtggagatctccaacgccgactcggcgacggacgacgaccggagccgcgacctggaccgggcggcgctgatgcggcagctggacgagacgcagcagagctggctcctggccgggcccggcgaccaggccggcaagaagaagaagcggtacgtcgacctcggctgcgtcgtcgtcgaccgtaaggtcttcatgtggaccgtcggcaccatcctcggcctcggcgtcttcatcggcttcgtcatcatgatcgtcaagctcgtcccgcacaagcgccccccgccgcgggcggnccgacagtacacgcaggcgctgcacaaggcgctcatgttctccaacgcgcagcgatccggcccgctgccgaagcacaatggcgtgagctggaggggcaactcctgcatggaagacggnctctccgacagcaccgtccgccggagcctggtcgggagcttctacgacggcgggggacgccattcaggttccactcccccatggggagggcccatggaccatgctcgctgggagcgtgatccgagtaccagggccaagtacgagggccttcggcggagctccaaccatttcagggagccccc

SEQ ID NO: 70216 - protein, 173 aa, Zea mays
  misc_feature: Ceres CLONE 1549356
  misc_feature: SWISSPROT Homolog: EC 3.2.1.4 Cellulase
  misc_feature (74)..(74): Xaa is any aa, unknown, or other
MRQLDETQQSWLLAGPGDQAGKKKKRYVDLGCVVVDRKVFMWTVGTILGLGVFIGFVIMIVKLVPHKRPPPRAXRQYTQALHKALMFSNAQRSGPLPKHNGVSWRGNSCMEDGLSDSTVRRSLVGSFYDGGGRHSGSTPPWGGPMDHARWERDPSTRAKYEGLRRSSNHFREP

SEQ ID NO: 70217 - DNA, 661 bp, Zea mays
  misc_feature: Ceres CLONE 1549358
  misc_feature: Encodes the peptide sequence at SEQ ID NO. 70218
atagctggagctccccgcggtggcggccgctctagaactagtggatcccccgggctgcaggaattcgtctcacccctagaaaaagcgagccaggggagagaggcagcatcggtcccgcgccaactggccagtctggctggccgcagccctagtggctagtgcagtaccgcctccgggaccgcgacccgggggaattggttccacttccacccatccccgtgtgtttccgattccccccgttcgggagcagagcatccgcgcgcgatggccaaagatggtggcttcgccaaggcgctgctgctccacgtcgccgcgctgtcgacggccggcgccttcgcggccgccgctgccgccctggcgcggcgccggctgtggggaggagacaggcggaagaagcagctgccggcgcccggcatggccgagatgccccggctccagctggcggagtccggccgcctggagtacctcgagaaagtctcgcactacgtggctaggcagctggttttccaggacgtgagcgagtgcccacagctctgcaggcttgggaaaaaactacctcagcagcagcaagacttgcatgggaggacttctaccgggtttctccgccgggcccaagggacaacccccccccaaatgccctgctttttggcaaagctcataa

SEQ ID NO: 70218 - protein, 132 aa, Zea mays
  misc_feature: Ceres CLONE 1549358
MAKDGGFAKALLLHVAALSTAGAFAAAAAALARRRLWGGDRRKKQLPAPGMAEMPRLQLAESGRLEYLEKVSHYVARQLVFQDVSECPQLCRLGKKLPQQQQDLHGRTSTGFLRRAQGTTPPQMPCFLAKLI

SEQ ID NO: 70219 - DNA, 688 bp, Zea mays
  misc_feature: Ceres CLONE 1549359
  misc_feature: Encodes the peptide sequence at SEQ ID NO. 70220
  misc_feature (688)..(688): n is a, c, t, g, unknown, or other
gctggagctccccgcggtggcggccgctctagaactagtggatcccccgggctgcaggaattcgtctcacccctagaaaaaaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcggggttccccagcagtgtggcactgacgaacacgcttcagcgccgtcgtcgttctcgccgctatcttgtcgtcgcctcggggacgagagcccaacacgagggccgcccctgtgacgatcgaggacgtggacctcagctctcatcaggccgcggcccacgaacggggagctccgccgcgcggggggggggagggccacggcaacaaacactgggggagggtttgctgggacccattcaacggggtggctccttccaggagcttctctcccctaagggggagttccccccagggcccccttagaaagagtttggaataaaaaccgtttttcccccccttatggggggggggtttaaaagtacccggggaaaaaacn

SEQ ID NO: 70220 - protein, 57 aa, Zea mays
  misc_feature: Ceres CLONE 1549359
MAATVSSCLSLVPTVHHRAGGVPQQCGTDEHASAPSSFSPLSCRRLGDESPTRGPPL

SEQ ID NO: 70221 - DNA, 639 bp, Zea mays
  misc_feature: Ceres CLONE 1549364
  misc_feature: Encodes the peptide sequence at SEQ ID NO. 70222
  misc_feature (626)..(626): n is a, c, t, g, unknown, or other
acccgcggtggcggccgctctagaactagtggatcccccgggctgcaggaattcgtctcacccctagaaaaagggccacgccgcggcgcgaccctgacgcccgccgtctccggcacccgataggcctcctccccacacccctcgcgtggcttccgtggcccgtagcccggcgcgcttcccttcaaagccactgcttcgcctcctccttctacttaagcgcagccggccccggccggcattcgcatccggtagctcgatcacttcttcctctggattttgggaaggaggcatcggacgtcggatgcatgacacactcattgcattagcgcctacgcctaccgcaagtggaagcctatggatctcaagcaagccttctctggtacaatcttctgccttctgcttctattctgcgtgggctgcagatgtcggactttggaaatagaggcacccagacagcagccctcaggttgatgcctcgcccaacttgccgggaagatccctgaaacacgggttgggatattttttgaggaaatcaacctggcaggacctggtggcaaatgggcaaacttggcaaaaacaaaagtttcaaacctggaggtttcatactccataaaaatcgacccggnggggccccccacc

SEQ ID NO: 70222 - protein, 38 aa, Zea mays
  misc_feature: Ceres CLONE 1549364
MDLKQAFSGTIFCLLLLFCVGCRCRTLEIEAPRQQPSG

SEQ ID NO: 70223 - DNA, 665 bp, Zea mays
  misc_feature: Ceres CLONE 1549365
  misc_feature: Encodes the peptide sequence at SEQ ID NO. 70224
  misc_feature (568)..(568): n is a, c, t, g, unknown, or other
tggagctccccgcggtggcggccgctctagaactagtggatcccccgggctgcaggaattcgtctcacccctagaaaaagaggagctctatagagcccatcctctgcttcgcataacctagcggcaccagcagctaaccgtccagagaacagaacagagatgaccaccagcgtccccgtccctctggcctcacagtcgcaggcgccgcagcgcaagccacggacctacaccccgagcccatggggtgacttcttcctccaccacaccccatgcactccgtcacagctcttgttgatgaaggagagggcaaaggtcaaggagcaacaggtgaggcagatcatacaggaaacaatggcctcctccaacctgcttcgcaagttggagcttgtggacacgctgcagcgtctcggggtggactaccgctacaacgaggagatcgaccagttgcttcgctctgtatacgacgacgacgacaggaacggaggcggctccgacgatctctacctcacctcgctgcggttgtacttgctcaggaagcatgggtatacaacctcttcagatgtgttcnagaaattcagggacgagcgcgggagcgtctcgagcgacgatgcccgctgcttgctcatgctgtatgacgctgctcatacgagaactcacgggggagg

SEQ ID NO: 70224 - protein, 168 aa, Zea mays
  misc_feature: Ceres CLONE 1549365
  misc_feature (28)..(168): Pfam Name: Terpene_synth Pfam Description: Terpene synthase, N-terminal domain
  misc_feature: SWISSPROT Homolog: EC 4.2.3.13 (+)-delta-cadinene synthase
  misc_feature (137)..(137): Xaa is any aa, unknown, or other
MTTSVPVPLASQSQAPQRKPRTYTPSPWGDFFLHHTPCTPSQLLLMKERAKVKEQQVRQIIQETMASSNLLRKLELVDTLQRLGVDYRYNEEIDQLLRSVYDDDDRNGGGSDDLYLTSLRLYLLRKHGYTTSSDVFXKFRDERGSVSSDDARCLLMLYDAAHTRTHGG

SEQ ID NO: 70225 - DNA, 598 bp, Zea mays
  misc_feature: Ceres CLONE 1549368
  misc_feature: Encodes the peptide sequence at SEQ ID NO. 70226
aaagctggagctccccgcggtggcggctgctctttcctagtggatcccccgggctgcaggattgcctctcacccctagaaaaaaagtctgaaaccaccgcccagcgctcgcctgtttctgcggccgtcgatggagctccacctcgccaccatcgcccaccgcccgcctttgccggtaccggcgcggggccaccacctccgccgccgcctccaccacctcccggctcctctctcctttcaaaacaccttactcccccctcccctttcctccccgcatcatcatcgccttttctccaccctttcggcgcacctccgcctggctcttctcgcctcccaagcgcccaattctaacccggagcctgaaactgaccccgagcccactgggcgaagctactggcggttgtaatttccatcgccatcgggctcgccggtggggtccccgcgccccgggcctttcaaagttaccccccaggggggggaaaacccctccattttttccttccaaaattgggggggtgggggctttggccccccccccctggggggggaaggaggggcttttcccggggggtataaaacccccccgttttcccaccttg

SEQ ID NO: 70226 - protein, 91 aa, Zea mays
  misc_feature: Ceres CLONE 1549368
MELHLATIAHRPPLPVPARGHHLRRRLHHLPAPLSFQNTLLPPPLSSPHHHRLFSTLSAHLRLALLASQAPNSNPEPETDPEPTGRSYWRL

SEQ ID NO: 70227 - DNA, 674 bp, Zea mays
  misc_feature: Ceres CLONE 1549370
  misc_feature: Translation starting site: 139
  misc_feature: SWISSPROT Homolog: EC 4.4.1.5 Lactoylglutathione lyase
  misc_feature: SWISSPROT Homolog: EC 2.5.1.18 Glutathione transferase
  misc_feature (458)..(458): n is a, c, t, g, unknown, or other
  misc_feature (610)..(610): n is a, c, t, g, unknown, or other
tccccgcggtggcggccgctctagaactagtggatcccccgggctgcaggaattcgtctcacccctagaaaaaatgtcacgactcacgacgacggaaacagtagtgctgccagtagagctctcagaactcggaaaaaaatgtcagaggccgccgtgcgcgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatcccccgtcctgctccaccacggcaagcccatctccgagtctctgatcatcgtccagtacatcgacgaggtctggggtctcgggcgcgcggccttcctccccgtcgacgctcacgcccgcgccgtccagcggttctgggcgcagtacgtcgacgacnaggtgaagcaaaaacctactagctagctagtcgtagtcgaccgagacctcttacgcatacgcatacgcatacgcatgcatgcagctgccttgggcgatccgcatactgaaggggaacggacgacgggggcttggaacagggcggcggggcanctgtccgcggccctgcagctcctaaaaggaggctttcccgcactcaacccgggggaagcgcttc

SEQ ID NO: 70228 - DNA, 662 bp, Zea mays
  misc_feature: Ceres CLONE 1549373
  misc_feature: Translation starting site: 179
  misc_feature (386)..(386): n is a, c, t, g, unknown, or other
  misc_feature (402)..(402): n is a, c, t, g, unknown, or other
ctccccgcggtggcggccgctctagaactagtggatcccccgggctgcaggaattcgtctcacccctagaaaaaaaccagatcgaaccccacacgccgcataaatcccccgctgacacccaatcaagcaaatcctcgcttccctcccccacgtcgcgtccgatcggcgacggtgcgccatgtcgatgctggacaccttcttcagcaagggcggcggcggcggcggcggcggcttccgcggcgccaagtgcaagacgctgctgaagctgtcgatcccgcggataaagctgctgcggaacgggcgggagctgcagctgcgccagatgcgccgggacatcgccaagctcctagaggccggccaggaggccactgccccgatcagggtgnagcacatcatccgggnagagaacatgatggccgcgcaggagatcctcgagctcttctgcgagctcatcgcggttcgccctgccatcatcgaggcccaaaagagtgtcctattgatctcaaagaagcaatatcaggtgtctgttttgccgcttcaagatgtgcagatctacctgaactgatgcaagttcaaatgatgtttggcactaaatatggaaaggatttttgcccctgcaccttcagagttgatgcctgattggggggtcatccctcagatat

SEQ ID NO: 70229 - DNA, 675 bp, Zea mays
  misc_feature: Ceres CLONE 1549375
  misc_feature: Translation starting site: 466
  misc_feature (334)..(334): n is a, c, t, g, unknown, or other
  misc_feature (346)..(346): n is a, c, t, g, unknown, or other
ctccccgcggtggcggccgctctagaactagtggatcccccgggctgcaggaattcgtctcacccctagaaaaactgcagtctgcagagtttcaggcggccagcttcctcctccccactcgttcggctcaccacctcggtgaccgctgcccttgacgtctgcttcggacgcggcctggccctgaaatctccgtgcgtgtttggccgaaatccacgggagggtgctcgtctttgctgagctgctccggcctccggagcggagctctgcctacttgagttcaggcttgttccgccatccgagggacagattcggagcgtcgccgaagggagcgatngaggggaaagcngggcgatggaccgcaggtcctcccgcagtggagggtgttgctgctctgcgcattcagcttcggcctcggcatgctcttcaccgacgggtctggacagcacgggatagcagtaacatatcatgtctcaaagccggagggcagagcagagcttcaccttgtatcaaaaggatgccccccaaagaggaacttggggaagacaagggtttaatgggaagaggttaccagaccctggagctttacattcttgggataaggcctccccacccctccaaatggagctggcaacaaaagggaaccaccttggaccgcccccaattagtgggtccccc

SEQ ID NO: 70230 - DNA, 645 bp, Zea mays
  misc_feature: Ceres CLONE 1549380
  misc_feature (485)..(485): n is a, c, t, g, unknown, or other
gagctccccgcggtggcggccgctctagaactagtggatcccccgggctgcaggaattcgtctcacccctagaaaaaatccacgcgaccacgctgccgttctctccccttcctccccgtcgcttccattcccgtccctcacaatctcacccccgccagccgagccccaaccctaacgaaatttacacctgcttcgttggcgtgagcggtcttaggcgtcgggcgtcgctgctgtccagcggtgtcggatccgggtcccgcgccgtttagtcgaagtttcttcggcgaggtgcagccgctggatgttagtctggcagatcggggccgagctaggcagtgttgggttgtaacatttgtatcgcatgaatgaactcagagcatctcaatgttaaaactggtaaggggcaaacctggtgccagaggctcccacatgagtgggttctaggggatggataatccgaagcaaggcctcccccctgcaatgcnaagatgcggcttttaaccccgggaccctggtgactccagggagacaccttcttcacacttgaaacaggggcctgtcctttcctcctccgttaaaaactggaccatatttaatttcttccttcctaaagcaaaagggggagcctaatttggcggccattgg

SEQ ID NO: 70231 - DNA, 702 bp, Zea mays
  misc_feature: Ceres CLONE 1549385
aagctggagctccccgcggtggcggccgctctagaactagtggatcccccgggctgcaggaattcgtctcacccctagaaaaacattccatcgtcttcgcttccactccccacgttccccgcctgcttcctccaggccccggccagatccgcgcgcccgcggggaagagggcctcctctcctccctcctcccttggctcgcgctctggtcgaggaggcggaggccggtgccggcgggcgggcggggaggtaggtagcagcttgcggttgcgggagggaagctgcgcgcgctaggctgccatggcggtggagaagacgctgcccggcgcgagtgcggggaagaccgtgctggcacgggggcggggcgggctacatcggtagccacgccgtgctgcagctccttcctcgcggggcttccgccccgtcgtcttcgacaacctccacaactcctccggagctgggccgcccgcccggttccccgcgcttcgcgggggaccacttcccggaaccttcttttttccacaagattgattctcccttgacaaggggggccctgggaaatgggtttttcgcttcccacaaaattttgaaagctggtctttcccttcccctgggattgaaaacctgggggggggaaaactttccaaaaacccttttccttttttttttgacaacaacccgcctttgggacacattaaatttt

SEQ ID NO: 70232 - DNA, 654 bp, Zea mays
  misc_feature: Ceres CLONE 1549387
  misc_feature: Encodes the peptide sequence at SEQ ID NO. 70233
  misc_feature (654)..(654): n is a, c, t, g, unknown, or other
ctccccgcggtggcggccgctctagaactagtggatcccccgggctgcaggaattcgtctcacccctagaaaaacgtctcccctcacctggctctccacctgccacctcacgcgcgcccctgctctgtctcttttggctccgctgaggccgagcacacacaacaaattctctctctcctctctctctctctctctcacacacacactctgctccctgtgcggaggacgggccggccgcatggggtgggggtggacggcgctggcggcggccgcgatggcgtacgtggcggtgaagctgatggaggtgctgtggtggcggccgcggcggctggagcagcacttcgcgcggcaggggataaggggcccccgctaccgcttcttcgtcggctgcgtccgcaagatgtggcgctcatgggtgccgcctccgcaagccaatgccgcgcccctaccgctcccacaaagtcctcccgcgcgtcctcgccttctaccaccactgggaagaaaatctacggttccaccgtccctgaaaatggttcgggccccacgccggaggcttcgcccgtcccccaaccccggaacctatttcggggaaaatcctccctggccccgcgcccaaacactttccacccgcatacaaaggccccacccgaaggn

SEQ ID NO: 70233 - protein, 138 aa, Zea mays
  misc_feature: Ceres CLONE 1549387
MGWGWTALAAAAMAYVAVKLMEVLWWRPRRLEQHFARQGIRGPRYRFFVGCVRKMWRSWVPPPQANAAPLPLPQSPPARPRLLPPLGRKSTVPPSLKMVRAPRRRLRPSPNPGTYFGENPPWPRAQTLSTRIQRPHPK

SEQ ID NO: 70234 - DNA, 698 bp, Zea mays
  misc_feature: Ceres CLONE 1549389
  misc_feature: Encodes the peptide sequence at SEQ ID NO. 70235
tggagctccccgcggtggcggccgctctagaactagtggatcccccgggctgcaggaattcgtctcacccctagaaaaagacccgacaaaccaacgccgcgtactcctctctactctctgccccgccaccaagctcgaccgaccgatgatcctcagccgcctgcatgtccgcgtcacccgccgatcccccgcgtccgccgccctccgcgatgcggcaacgcgcgccttggcctccgcgggcctcttccgtggcctccacggcggcgcctcctccgagcacggccgcgaacccgcaggtcctcttacgctctacaggaagctagtgagccaagggaagctcacgcatgatagttacccaggaaatgtagcttccggaagtagacaacctacttagtaggcttcaacggcacccagtgggaaatggggggattttcctgacaaggtggactttctggggagaatagccgggagaaagagcgggccaagggcttcttggccaagaagcttaaaaattacccgcggggggggggtttgggatttaataaaaaaaagggggattttctttaaacaattgggttgcgcccggaaaaaaaaaaggacaccctttcaacctgggggttggggaaagggggggcccccccccccgggacccgagaaaaaaaaacctcgtgttcttttggggggggcccatatccccg

SEQ ID NO: 70235 - protein, 82 aa, Zea mays
  misc_feature: Ceres CLONE 1549389
MILSRLHVRVTRRSPASAALRDAATRALASAGLFRGLHGGASSEHGREPAGPLTLYRKLVSQGKLTHDSYPGNVASGSRQPT

SEQ ID NO: 70236 - DNA, 721 bp, Zea mays
  misc_feature: Ceres CLONE 1549398
  misc_feature (241)..(241): n is a, c, t, g, unknown, or other
  misc_feature (290)..(290): n is a, c, t, g, unknown, or other
  misc_feature (296)..(296): n is a, c, t, g, unknown, or other
  misc_feature (299)..(299): n is a, c, t, g, unknown, or other
ggagctccccgcggtggcggccgctctagaactagtggatcccccgggctgcaggaattcgtctcacccctagaaaaacccgccgacgagcgcgatcgattgattcggttcgagccgggcggaggaggaggagggagcgccccggggcggggtgagcccaccagatccgactaccgcagcggctatgatgaagtcgctgctgccgtagagccagctgcggagctcggctggggcggccgcncggtcgtcggctggcggcgccgcggggggcagacggggctatgtccganaggggnggntggggggtgggggggccctgctcctccactttgtgggttgtggtgcacgcggtcgggtggcccctctccctcttcctgggggttccgctttctggcggattcctctgcgccccccgctcctgctccaaccacgggtggtttaacggcttccaggaaccgtccttcctggctgcgggccgccggtccctttccccgcccacccaactttgaaacaacgcgccttctcctgaaccccccaccctttgagggagaacccaaaagcttggaagggttcttcctttagccgggcggccaaagctttcccgcctttccgcccccgggataactcggaccctggggtgggacgcgggcccaaaaaggggggcgggctcccgggaaacccccaaagtgtctgtcgcggggggggagggccgcggaattcc

SEQ ID NO: 70237 - DNA, 619 bp, Zea mays
  misc_feature: Ceres CLONE 1549403
  misc_feature: Translation starting site: 493
ctccccgcggtggcggccgctctagaactagtggatcccccgggctgcaggaattcgtctcacccctagaaaaaaagcagtcagcacagcagcggtagatagagtacaaatcctcacctgctcccctgcttcctgcttttcgtcctcacctcccttcccccactctcttctctccccgcggcccgtgactcatccacccacagtccactcgccactccccccggaacggcggcggcggcgacggcggaggagtaacgcaagatggcgaggaacctctcgactacgaggagctgaacgagaacgtcaagagggtgcagtacgcggtgcgcggggagctgtacctcggcgcctccgagctgcagaaggagggcaagaagatcatcttccacaacgtcggcaacccgcacgccctcgccagaaaccgctcacttccccgcgcaggtggtggcgctgtgccagctccgttcctcctgacatccccacgtcggcctcatgttcccggcgaacgccatcctaggggcagcactttcctgccatggcccccggcgggctaaggggctaagggaacccccggggcatcccggaaacaggaaagaaattccccaattcccccaaaagg

SEQ ID NO: 70238 - DNA, 692 bp, Zea mays
  misc_feature: Ceres CLONE 1549408
  misc_feature: Encodes the peptide sequence at SEQ ID NO. 70239
tggagctccccgcggtggcggccgctctagaactagtggatcccccgggctgcaggaattcgtctcacccctagaaaaacttttggaatcaaccatcaatttactccaatggtgtatccccttcttgtcagctctgttggtattatagcatgtctcataacaacgctgtttgcaactgatttcttcgagataaaggctgtgaatgaaatagagcctgctctcaagaaacaacttataatatccactgttgtgatgaccattggcattgcgctcatcagttggcttggtcttccatacaccttcaccatttataactttggagcccagaagacagtgcaaagctggcaattgttcttgtgtgtggcggttggtctctgggctggcttagtcattggttttattactgagtactacacaagcaatgcctacagccctgtacaagttgttgctgattcctggcaaactggagctgccactaatgtcatttttgggcttgctcctggttacaaatcactcattaacccaattttttgcttttgcggttaagaatctttccttagcttcagcccttcgctgccatgaatgggggttgccgcggcctgccccttgaatatctaactaccaatttcgcaccgggctcttggtaattgattgcctaatgggccctatacagggaaaaagcgccttgacgg

SEQ ID NO: 70239 - protein, 145 aa, Zea mays
  misc_feature: Ceres CLONE 1549408
  misc_feature: SWISSPROT Homolog: EC 3.6.1.1 Inorganic diphosphatase
MVYPLLVSSVGIIACLITTLFATDFFEIKAVNEIEPALKKQLIISTVVMTIGIALISWLGLPYTFTIYNFGAQKTVQSWQLFLCVAVGLWAGLVIGFITEYYTSNAYSPVQVVADSWQTGAATNVIFGLAPGYKSLINPIFCFCG

SEQ ID NO: 70240 - DNA, 665 bp, Zea mays
  misc_feature: Ceres CLONE 1549410
  misc_feature: Encodes the peptide sequence at SEQ ID NO. 70241
ggagctccccgcggtggcggccgctctagaactagtggatcccccgggctgcaggaattcgtctcacccctagaaaaaagcaaggagggatctcgctttagaccagcgaatccttccacacagattccgtgcacctccagcgcagcctccgttgtctgtccccgcggccgcggcaactgagcatgaagaggaggaggatcccgtcctcccagtctagagcagccgcttgcaaagcgcatcggcggcacggccgtggattccgcgaatctgccaccgcttgctgctgcttctgagactgacaccgccatcgcagctgatggggatacccagcgacggcgacgacgtggtgcaaatccggcacgccgacgccgccggagagcccaccgtcgtcaccgtgagctgccccgacaagacaggactgggctgccacctgtgccgggccgtcctcctcttcggactacacgtcgtcaagggagacatgagcaccgacggccgctggggctacatcttggtctggctgttgccacggggggcgttggcccgtggacttggcctgggaacccctaaggggaccggttgctttagctccgccccggagcgccggcctttgggcttggggtccccgaaaacctatcttgggggggggggatggcctttcaggaatt

SEQ ID NO: 70241 - protein, 116 aa, Zea mays
  misc_feature: Ceres CLONE 1549410
MGIPSDGDDVVQIRHADAAGEPTVVTVSCPDKTGLGCHLCRAVLLFGLHVVKGDMSTDGRWGYILVWLLPRGALARGLGLGTPKGTGCFSSAPERRPLGLGSPKTYLGGGGWPFRN

SEQ ID NO: 70242 - DNA, 629 bp, Zea mays
  misc_feature: Ceres CLONE 1549513
  misc_feature: Encodes the peptide sequence at SEQ ID NO. 70243
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (82)..(82): n is a, c, t, g, unknown, or other
  misc_feature (84)..(84): n is a, c, t, g, unknown, or other
  misc_feature (85)..(85): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (391)..(391): n is a, c, t, g, unknown, or other
  misc_feature (460)..(460): n is a, c, t, g, unknown, or other
nnntttttttnnnnnnnnnnnnnnnnnnnnttnnnnnnnnnnnnnnnnnnnnnnnnnnnnntttnnnnccnnnnnnggcggngnnggnnnntgggnnnnntttttttttttttttttttctattgggtacgggccccccctcgagccactgcagtggtaaagagtttgccgctctcggcagacctcgttcggcttcctctctcctctttcctgcctatcagcagtcagtttctctcgtctgtgctgatggcgtccaactacgtcgacaccggggcggaggaaggcaggttccacggccacggccacggccacggccaccaccaccaccacagcacgacgccgaacagcgcggcggcgtcgcccaagacgctgcggatgagctcgtcgtccngccacagccactgcgcggcgcccaagtgcgtgtgcgcgccgggcacgcacgcaggctcccttcagtgcngcctccacggcagcagctcccacagggcacgggcacgggagcgaccccgggtccccctcccttccccgggccacttttccccccggggccccccccccgtccccgggccccgttcctccctcccccaaccgtttcgggggcaaatgaaaggggccccccaaaaaaaacc

SEQ ID NO: 70243 - protein, 127 aa, Zea mays
  misc_feature: Ceres CLONE 1549513
  misc_feature (49)..(49): Xaa is any aa, unknown, or other
  misc_feature (72)..(72): Xaa is any aa, unknown, or other
MASNYVDTGAEEGRFHGHGHGHGHHHHHSTTPNSAAASPKTLRMSSSSXHSHCAAPKCVCAPGTHAGSLQCXLHGSSSHRARARERPRVPLPSPGHFSPRGPPPVPGPRSSLPQPFRGQMKGAPQKK

SEQ ID NO: 70244 - DNA, 655 bp, Zea mays
  misc_feature: Ceres CLONE 1549551
  misc_feature: Encodes the peptide sequence at SEQ ID NO. 70245
  misc_feature (562)..(562): n is a, c, t, g, unknown, or other
cgattgggtaccgggccccccctcgagccactgcagtggtaaagggaagaccttctttgagtgaggtccagcccttggtggccatttcaaccttcgtcctccgcaataaaagttgggcaatcctatgtcagtcactgctcttctagcccaacccattccatcgctgtttgctcctgctcccgcgccgtcgagagctcaccgaaacagaacctcgcggcggcgtttcttaggcgctgtctgattcctgtatatttattttggcattgctttcagctccaacaaaactaaccatggatggcactagctttgacctgacagagcacgaaggttcaaatttgtctccatttctactcaaacattttaatgagtgggatgatcgcaagacaaggggcttgtttcaccatgacatcagttcctgtgaaacaaaggtgctacctggagtacataattttgtggcaacattaattgaaggacgtgaccaaaagaagcggccaactgagttcacaatgaaccaagttctccagccatttgttagtgagaagttcaatttcacaaaagtcangcccgttggaggtgatctttagattcaatgacactgagaaagaccctgcacaatatttttgatggtgttcctgatactgtttcagcttcttct

SEQ ID NO: 70245 - protein, 97 aa, Zea mays
  misc_feature: Ceres CLONE 1549551
  misc_feature (91)..(91): Xaa is any aa, unknown, or other
MDGTSFDLTEHEGSNLSPFLLKHFNEWDDRKTRGLFHHDISSCETKVLPGVHNFVATLIEGRDQKKRPTEFTMNQVLQPFVSEKFNFTKVXPVGGDL

SEQ ID NO: 70246 - DNA, 619 bp, Zea mays
  misc_feature: Ceres CLONE 1549559
cgattgggtccgggccccccctccagacctgctgtggtatctgctccacgtcagatgatctcgttccggatggtgtgttaatactgcttgccccctgcgtcaaagtgcacgccgggcgagatgcgaggattcagtggaactatatcactggtaccttggcaggaccagcctccacgacttatcactctaacaactacgaccttcagttcggcgtaacttcaccgcttcaccactcacatgagctggatgtggacgacagcgctattctcgcgctgcatatattcctgaaggccgtcatccgactacttgctgaaacaatcctctagctcactggagatgttcacgcaggagaaatgtatttcctcctccagcctgcttactgcgaaaacgcacgactccgctggcgcaatccgccggacttgcgccagaatcaatgattctttatgcgtcatggatatctactgctaaatgttgttactgtgaacgcagccgccagttttgccgtaattagttgccaactaacatgctctaccgtgctcgctgcagtaatccttcgtgatatcacacgttgtactgctcatatcgcctgcagcccgtgtcgatccactatcttatagtg

SEQ ID NO: 70247 - DNA, 627 bp, Zea mays
  misc_feature: Ceres CLONE 1549573
  misc_feature: Encodes the peptide sequence at SEQ ID NO. 70248
tcgagccctgcagtggtaaagggcgtaaacatcgaatcgtctcactcgtgtctgccctgctcatactgcttgccctcgccgtatcgtccacccgcaacgcacaggaggattccatggccaacaacaccgggacgttggtgggcggcatccaggacgtgccggggagcgagaacgaccttcacctccaggagctcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtcaagaagctctacgaagctaaggtctgggagaagccatgggagaacctcagggggctgcaggaatttcagccctgttgagagggtgctagcgccctaggatgtctccttctccatgtgcgagcccctgagctcaaagcaagttgcagaataggagccatgctccccttgtggtatttcataggactacaacccctatagggcttgttttggttgtgcctgtatccaagggaaatggaaggggaataaattttccctccaatccaaaaaagggggttttaatccccctccaaaacccctc

SEQ ID NO: 70248 - protein, 134 aa, Zea mays
  misc_feature: Ceres CLONE 1549573
  misc_feature (47)..(135): Pfam Name: Cystatin Pfam Description: Cystatin domain
EPCSGKGRKHRIVSLVSALLILLALAVSSTRNAQEDSMANNTGTLVGGIQDVPGSENDLHLQELARFAVDEHNKKANALLGFEKLVKAKTQVVAGTMYYLTIEVKDGEVKKLYEAKVWEKPWENLRGLQEFQPC

SEQ ID NO: 70249 - DNA, 659 bp, Zea mays
  misc_feature: Ceres CLONE 1549584
  misc_feature (577)..(577): n is a, c, t, g, unknown, or other
cgattgtgctacccggggcatctctagttctgcagcggtcgccgccacaggggagctaccactttggttcccttgctggatggttcatttcaatcttggcgtacatcatggccatacctgtttcaatgtctgacattgtaatctggctcgcaatgcacccgactccaacccccgaaacataaagtgtaaaggatggggtgcataatgacgaagctaactcctcttaatagctgggcgctcactgcacgctttcacagcagcaaacctgtcctaccttctgcattaatcaatcgctcaacgcacgggaaaagactgtttgcgtattgagccctcttctgcttccacgctcactgactccttgcactccgtctctctgcagctctccatggtatcagactactaccacgcggtaatacggttatccaatcactacagccataacgcaggcaagatatgtgagctaaagacaaggacacgccagcaaccttagaaagtgcgttttgctggcgtttttccctatgccccgacccccctgactagcttcgcaaaaatcgacgctcatttcaagcgttggccnaaacccttcggaaactttttttattccaggcttttttccccctcgaaacttcccatcattccgcctttcctggtttccaaac

SEQ ID NO: 70250 - DNA, 642 bp, Zea mays
  misc_feature: Ceres CLONE 1549612
  misc_feature: Translation starting site: 207
cgattgggtaccgggccccccctcgagccactgcagtggtaaagggggactccggccgcgagaacccgcgactaagccaggacgcgggacgccacagacaccggcctcagcatccgcctaggacgaataacccttctaggctgccgccgccgccgtccttagctcatattgttgccggcgaagagcgccccatatccacccctgctatggagtcggcggtgaacccgaaggcgtacccgctggctgatgcgcagctgacgataggtatcatcgatatcatccagcaggccgccaactacaagcagctcaagaagggagctaacgaatcgacgaacaccctgaacagggggatatcggagttcgtattgatggcggcaggacacggagccgctcgagatcctcctccacctccccttgctagctgaagataagaacgtgccatatgtatttgttccatcgaaacaagctcttggccgtgcttgtggtgtgacaaggcctgtcattgcttgctcagtgaccagcgatgagggtagccagctgaaacaacagatactgggtctcaaggactcgattgagaagcttctcatctgatttaccaaagacctttccaggtgatgggcctcagcgacacatttttcatag

SEQ ID NO: 70251 - DNA, 639 bp, Zea mays
  misc_feature: Ceres CLONE 1549627
  misc_feature: Encodes the peptide sequence at SEQ ID NO. 70252
caattgggtaccgggccccccctcgagccctgcagtggtaaaggtcgccctcgtaatcaatctccgcctccctgcctgcttaccccgaccccgtcggcatctcggagaatcgcggcggtcaaagcccagcctaccccacctcgcgccgcgtcgccgcggtttccgcgggccagtgctctcgggagtcgggagctcagatcaggagggacgggctaggtagggttcgcgagcgagcgagggtgctgccgtccggcgccggtgtccgagtagcaagaggagagatggacgcgttcctgcagaggctcaagcggttggacgcgtaccccaaggtgaacgaggacttctacaagcggacgctctccggcggcatcgtcacgctcgtcgccgccgtcgtcatgctgcttctcttcatctccgagaccaggtcatatttttattcagcaacagagactaagttagttgtggacacatcaagaggagaaaggctacgagtaaattttgatattacttttctgagcattccttgcaccctcctcagcgttgatacaatggatattagtggagaacagcaccaggacattaggcatgacatcgaaaagatacgattagatgcacatggtaatgttattttgagcagaa

SEQ ID NO: 70252 - protein, 119 aa, Zea mays
  misc_feature: Ceres CLONE 1549627
MDAFLQRLKRLDAYPKVNEDFYKRTLSGGIVTLVAAVVMLLLFISETRSYFYSATETKLVVDTSRGERLRVNFDITFLSIPCTLLSVDTMDISGEQHQDIRHDIEKIRLDAHGNVILSR

SEQ ID NO: 70253 - DNA, 629 bp, Zea mays
  misc_feature: Ceres CLONE 1549635
  misc_feature: Encodes the peptide sequence at SEQ ID NO. 70254
  misc_feature (447)..(447): n is a, c, t, g, unknown, or other
  misc_feature (629)..(629): n is a, c, t, g, unknown, or other
cgattgggtacgggccccccctcgagccctgcagtggtaaaggagaaggcagaggagacgctatctgtggggagagaatttgttaggtctccaatatgatgatgatgatgacgacgacgataacgaaggggaggaggatgaagtggatgctgtggatgaagttcagagaccaaggagtcgtcggaggttcataagatcaagatcagaggagcgggcctaatacattgtggagatgtggatgatgtgcttccttgcttggttaaaatgctgtgcgcatccctgcaatcaaagaccaaaaggcaaatggacctcaagttcaagtttagatgatttggatgcgtctgacaccatccatgtgccctcttttatctgacgatcataagaaacactcattcttagggcaaagctggactgctctcagaccagaactgacatggaagctagcgnttggagatgctcgctccatcacaacagctggttgccgtcactcattcaccatgcctttttacctttgcactgcgtgtcatctgcatctatagtatattcttcccgtattacgtctcattgagtccatgctgctactggtctgggtgaaatacctggtcaaaagctataaaaatttttttttn

SEQ ID NO: 70254 - protein, 32 aa, Zea mays
  misc_feature: Ceres CLONE 1549635
RLGTGPPSSPAVVKEKAEETLSVGREFVRSPI

SEQ ID NO: 70255 - DNA, 645 bp, Zea mays
  misc_feature: Ceres CLONE 1549636
  misc_feature: Encodes the peptide sequence at SEQ ID NO. 70256
cgattgggtaccgggccccccctcgagccactgcagtggtaaaggattctgattggcacccgtaaatcatctgctttgtctacctcagcaggtttgcaacatttacgcgatccattgcattgcgacttgcagctgcagagccggtgatggcggaccggcggagcaatggtggttcgccccctaactggagcttcgcgtctcaaagcagccactaccacttggcggcgatgagaggaagctacgcggcacagagcctctggcgcccgacgccgatgccggtccgtggcgccgccctgtcctcgacgccgcacgttgtggcctcggcgcccgccgagaagaacttcgccgccgacttcctgctgggcggggtgtcgtcggcggtgtccaagaccgtggcggcgcctatcgagcgcgtcaagatgctgctgcagaaccaggacgagctgatccggaccggcaggctgtccgagccgtacaggggcatcggcgactgcttcggccgcaccgtcagggacgagggcttcctgtcgctgtggcgcgggaacaacaccaacgtcatccgctacttccccacgcaggccctcaacttcgcgttcaaggactacttcaagggcccctcttcacttcacaaggacagggacggct

SEQ ID NO: 70256 - protein, 166 aa, Zea mays
  misc_feature: Ceres CLONE 1549636
  misc_feature (65)..(162): Pfam Name: Mito_carr Pfam Description: Mitochondrial carrier protein
MADRRSNGGSPPNWSFASQSSHYHLAAMRGSYAAQSLWRPTPMPVRGAALSSTPHVVASAPAEKNFAADFLLGGVSSAVSKTVAAPIERVKMLLQNQDELIRTGRLSEPYRGIGDCFGRTVRDEGFLSLWRGNNTNVIRYFPTQALNFAFKDYFKGPSSLHKDRDG

SEQ ID NO: 70257 - DNA, 649 bp, Zea mays
  misc_feature: Ceres CLONE 1549670
  misc_feature: Encodes the peptide sequence at SEQ ID NO. 70258
  misc_feature (1)..(1): n is a, c, t, g, unknown, or other
ncgattgggtactcgcgcgcccccgagctctgcagtggtcaagggcgggtacgcagagtcgctagacgcacctcgctcgcggcttgttggactccaaggggcaatagacagcaggcatggccccgaactgcaggaggagattcccaaggatctcgtcggccgggtagaggaagggacggggacgggcgatggcggcggactgcggcggcggggtggactgggagagcctggcggatgccacctccggggcaatcggctcgctcgtcagcaccaccgtgctctacccgctcgacacctgcaagaccaagttgcaggccgagctccggacgcaccagggcgctcagaagtataggaacctttcacatgtcttttgggaagcgattcgtaaaatcaatttctgtccctatatcagggcctgaacacgaagatcattgagtcttttgtcgactcgtttgtttatttataggggtatagctgtttgtaacgactctactgggagaagagtggagcatagtctattggtacaaccggccactttgttagttgctgctgctcgctggagcttggacgggtatcaagcccccgcgcattataaacatccccttcctagcatcctacaaagtgcccttgggaagtctcaaggggccga

SEQ ID NO: 70258 - protein, 76 aa, Zea mays
  misc_feature: Ceres CLONE 1549670
MAADCGGGVDWESLADATSGAIGSLVSTTVLYPLDTCKTKLQAELRTHQGAQKYRNLSHVFWEAIRKINFCPYIRA

SEQ ID NO: 70259 - DNA, 665 bp, Zea mays
  misc_feature: Ceres CLONE 1549682
  misc_feature: Encodes the peptide sequence at SEQ ID NO. 70260
cgattgggtaccgggccccccctcgagccactgcagtggtaaaggagacgcaatacacatacagcccctcttgcccacagccccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccggtgctgccggtagcgccagtagcaacagcaccgtggattcgagcggtggcggtagcggctgtggcatccaggcgcctatgcaggccatgccgcttcctccggctctcgatctcgacctcttccatcgggcggccgccgtgaacgcagtctccaccggcatgcggtttcccgttcagggcttatcctgtcccctgcccgaagccccagcagatctttttctaccagcaggcgg

SEQ ID NO: 70260 - protein, 176 aa, Zea mays
  misc_feature: Ceres CLONE 1549682
  misc_feature (32)..(83): Pfam Name: AP2 Pfam Description: AP2 domain
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRAAAVNAVSTGMRFPVQGLSCPLPEAPADLFLPAG

SEQ ID NO: 70261 - DNA, 683 bp, Zea mays
  misc_feature: Ceres CLONE 1549699
  misc_feature: Encodes the peptide sequence at SEQ ID NO. 70262
cgattgggtaccgggccccccctcgagccactgcagtggtaaaggtgcgaacaccttgcacgtccccctgccacgggcctgcccctacttctctctttcgctttatcacctctcgtcgccaccaacactccaacagtcgcttcaccgtcggcgccgtcggagggacgctccaggtggctgcccccggcagcggaaagtttcctgcggcccctgccctctttcaccaccgcgggttctcaggcagagaaaccttacctgtgcatcatggagattgcagagctcctccaggagcttgtttcatggtcacgtcacctatgttggggccaattagggtatccttagtatgtagcgcgagccccaaccaccataggccaagggattttcggatatatcgcaactacaaaaggaggggtcctccagagggaaaaggaaggtcgtaccggaattaagatgactctgagaacatcgatgaatttgatagccatttccttgtcctccggtaatggaccacctattctctttggaaagactttcccgtccccaaaaaatttcaccccctggggaaaaaaaaaatatgaaaattggggaaccccttaaaaagggtttaaacccctgctcctcacctttgggtgaaaaaggccggaaaaaaaacacccggaaccccccaaaaaggcctgggcgga

SEQ ID NO: 70262 - protein, 148 aa, Zea mays
  misc_feature: Ceres CLONE 1549699
IGYRAPPRATAVVKVRTPCTSPCHGPAPTSLFRFITSRRHQHSNSRFTVGAVGGTLQVAAPGSGKFPAAPALFHHRGFSGRETLPVHHGDCRAPPGACFMVTSPMLGPIRVSLVCSASPNHHRPRDFRIYRNYKRRGPPEGKGRSYRN

SEQ ID NO: 70263 - DNA, 712 bp, Zea mays
  misc_feature: Ceres CLONE 1549706
  misc_feature: Encodes the peptide sequence at SEQ ID NO. 70264
  misc_feature (712)..(712): n is a, c, t, g, unknown, or other
gctggggctcgctccggcggctgtcagatctgaactagtggatcccccgggctgcaggaattcgtctcacccctagaaaaactctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggccctctcaggtcattcctgggcccggtgagaagccaatgatagttgttcagcaccagggggaggagaaacagtttgcacccgaaaagatctcctccgtggttctcatccagatgcgggagatcgctgaagcttaccttggcagcacgatcaagaatgctgttgtcacggtcccctgccgtacttcaaggaatcaaagaggccaggccaccaaggatgcttggggtgattggcgggcccn

SEQ ID NO: 70264 - protein, 172 aa, Zea mays
  misc_feature: Ceres CLONE 1549706
  misc_feature (9)..(172): Pfam Name: HSP70 Pfam Description: Hsp70 protein
MAGKGDGPAIGIDLGTTYSCVGVWQHDRVEIIANDQGNRTTPSYVAFTDSERLIGDAAKNQVAMNPINTVFDAKRLIGRRFSDASVQSDIKLWPSQVIPGPGEKPMIVVQHQGEEKQFAPEKISSVVLIQMREIAEAYLGSTIKNAVVTVPCRTSRNQRGQATKDAWGDWRA

SEQ ID NO: 70265 - DNA, 679 bp, Zea mays
  misc_feature: Ceres CLONE 1549711
  misc_feature: Encodes the peptide sequence at SEQ ID NO. 70266
gagctccccgcggtggcggccgctctagaactagtggatcccccgggctgcaggaattcgtctcacccctagaaaaagcagacgtcgattagccagaactgccccgtgtccacctggctctgcccctcctctccctgcgttgtgtcaccgttgccaggaggagcgctcaccgatcacgattcgtttctgagcttcgaagaatcgacggtcaagcttcggcgaccaaatgatccagttcttcgagttctacgagatcgaagatcctgagcatctgtttggtgaaggttgccttttgtgcaatctatgctcaggtaaagaagaagggagacggttgttgaaggcggtctccaggaagtccaggacttcgacgagttcaagggattaggctagcgacctcccccagtcagcaactggctgggggggttttgtttcctttgggcaaatttttgattccgggggacctttgattttaaaaaggaaaaggaccccgggtttgggaattaattacccccccccctttttgggtaaaaaaaaaaaaccttaaaaaaaaacgggggcccccacagcccccaaaaaggggaggggggggggggccccttttttttttcttcccccattttttcttgggggggggggttccttttttccccccccccccttattttttcggtttggagag

SEQ ID NO: 70266 - protein, 52 aa, Zea mays
  misc_feature: Ceres CLONE 1549711
MIQFFEFYEIEDPEHLFGEGCLLCNLCSGKEEGRRLLKAVSRKSRTSTSSRD

SEQ ID NO: 70267 - DNA, 682 bp, Zea mays
  misc_feature: Ceres CLONE 1549713
  misc_feature: Encodes the peptide sequence at SEQ ID NO. 70268
ccgcggtggcggccgctctagaactagtggatcccccgggctgcaggaattcgtctcacccctagaaaaatctatactggctcagaatacattactacagctactggtgatggggactttggtcttgtgctggaaagtacaagtttctatgctgaacaaggaggccagatatttgacactgggagcattgaggggtcatttggaactttcaatgtgaacaacgtccaagtgtttgctggctatgttctacatattggctcatttacaaaaggttcgaaggttttgtctcttggagatagtgtgatatgcaaggttgattacaaccggcgcacactgattgctccaaatcatacgtgtacccacatgttgaactttgctctaagggaagtacttggtgatcatgttgaccagaagggttcaattgttctaccagagaagctaagatttgatttctctcatggaaaacctgtccagcctgaagatctgaggaaaatcgagttcatagtgaaccagcaaataaaggacgagctgggtgtgtatgcagctttgatccgtccgccgccgcccgagaccatgccggccacggacctccagggctcctccccgttctcctccttcggccgcaccctcctctccctccgccgcgacgccccggcgtccgcgtccgcggcggccgcgatgc

SEQ ID NO: 70268 - protein, 106 aa, Zea mays
  misc_feature: Ceres CLONE 1549713
  misc_feature: SWISSPROT Homolog: EC 6.1.1.7 Alanine--tRNA ligase
MLNFALREVLGDHVDQKGSIVLPEKLRFDFSHGKPVQPEDLRKIEFIVNQQIKDELGVYAALIRPPPPETMPATDLQGSSPFSSFGRTLLSLRRDAPASASAAAAM

SEQ ID NO: 70269 - DNA, 726 bp, Zea mays
  misc_feature: Ceres CLONE 1549716
  misc_feature: Translation starting site: 165
  misc_feature: SWISSPROT Homolog: EC 1.4.1.2 Glutamate dehydrogenase
ctggagctccgcgcggtggcggccgctctagaactaggggatcccccgggctgcaggaattcgtctcacccctagaaaaactctcgaaaccctagtcccctgctccattctcagccgccgccgatcccttcccgtgctccgcaaccgctgagtgagaagaagagatggccggcaagggcgatggcccggctatcgacgtcgatctccgcacgacgtactcttgcgtcagcgtgtggcagcacgaccgcgtccagatcattgccaacgaccagggtaaccgcaccacgccctcgtacgtcgccttcaccgactccgagcgcctcatcggagatgcggccaagaaccaggtcgccatgaaccccatcaacaccgtctttgatgccaagcgtctcatcggcaggaggttcagtgatgcgtctgtccagagtgatatcaagctgtggcccttcaaggtcatttctggacctggtgagaaacctatgatcgttgtccagcacaagggtgagcagaagcagtttgcagctgaagagatctcctctatggttcttatcaagatgcgtgagattgctgaagcttaccttggtagcacgatcaagaatgctgtggtcacagtccctgcctacttcaatgactcacagaggcaagccacaaaggatgctggcggtgatgctggccttaatgtgctgcgtatcatcgacgagccgacagctgcagctatcggctatg

SEQ ID NO: 70270 - DNA, 718 bp, Zea mays
  misc_feature: Ceres CLONE 1549717
  misc_feature: Encodes the peptide sequence at SEQ ID NO. 70271
ctggagctccccgcggtggcggccgctctagaactagtggatcccccgggctgcaggaattcgtctcacccctagaaaaagctctccacccctaccgcctgcctcagatctcgatgcggcgcaagcttcccggacacgcgcctctgtcggcggcgagggccggtcatgcttcatccgcatccgcaccgtccgatgcggacctggctcagctctccgcggtcatcgcagccggggaggacctgagccccttcgtgcaccgggccttcgcgtgcgggcgccccgagccgcttgctcgcctcgctcctcggcgcggcgcgggaccgagaggccgagatcgaggagctctgccgcgcacacttccacgatttcatccgcgccgtcgactaccttcggtccctcctggccgacgccgatgcgctcaagggctccctctctgcgtcccactccgtgcttctctcctcggagggcccgctgctcgcctcgcttgagtccttcctcgctgctcgcttgctcacggggaaactctcctccgcgctagcctcctcccgacagtgcgtacggctgctcgcgctcgcagagcgggcgaacgcgcacctccaggtcggtgaccatgggctctacctcgctctgcgcgcggtcgacgacatcgatggtgatctcgcctcgggatccgagctgcttgcgctacccgcgctacgtcgcatgcttctcagcgtcg

SEQ ID NO: 70271 - protein, 124 aa, Zea mays
  misc_feature: Ceres CLONE 1549717
MRRKLPGHAPLSAARAGHASSASAPSDADLAQLSAVIAAGEDLSPFVHRAFACGRPEPLARLAPRRGAGPRGRDRGALPRTLPRFHPRRRLPSVPPGRRRCAQGLPLCVPLRASLLGGPAARLA

SEQ ID NO: 70272 - DNA, 795 bp, Zea mays
  misc_feature: Ceres CLONE 1549719
  misc_feature: SWISSPROT Homolog: EC 2.7.7.49 RNA-directed DNA polymerase
  misc_feature (1)..(1): n is a, c, t, g, unknown, or other
ntcgctgccgttcagcatgctgcaggacgctcttgaactagtggatcccccgggctgcaggaattcgtctcacccctagaaaaatacttggggcatgttatctcccatcaaggggtggctactgatccagccaaaattgatgctgtcacttcgtggcccctccctactaactgtaaagaactaaggggattcttgggcctggcggggtactatcgcaagtttgtgcgccacttcggcatattggccaaaccacttactactctattgaagaaacatgtactgtttgtctggaccagcgagcacgatcaagcatttcaggcattaaagtcagctctgtcttcagcgccggttttggctttaccccactttaccagaccattttgccatggaaacaaatgcttacggtcaccccccttaggaccagtggttacacaggaaggccacccccttagcattttgtcagtcgctccactgggtgttcaaaaaatccgggaacttttcacttattgagaaaagaatatctcgcctatacatctttaacccgggtcaataattgggggggcaatccctgcaaaaatgggtgaagttccttcctttttttgtcggatcaacggccagttttttgtccaactttgactttaccaagccgcttgcatttacccctttgggaaacatgcggagtctttccccacaatatcacgtgggggccccacaattaaaagaatagtgtggaaaaaaaaaaggggcgtccaataaaatggggtcgccgcaaaattcatttttgtatcccgcccc

SEQ ID NO: 70273 - DNA, 764 bp, Zea mays
  misc_feature: Ceres CLONE 1549722
  misc_feature: Encodes the peptide sequence at SEQ ID NO. 70274
tggagctccccgcggtggcggccgctctagtactagtggatcccccgggctgcaggaattcgtctcacccctagaaaaaagttctccctcccttcccaatcccctatcccgttactttccccggctcctcgtcttcgtccaccccaaaccctaatacgtcatggcgctcactacacggggcggcgccggcggcggggatcccgcgaaggcgccgtccgcctccgaccccagcctcggcttcctcaccaagcgcgataccgaggtcaagctaccccgcgcaacgcgggtcaagaacaagacccccgcgccgatccagattacagccgagcagatcctccgggaggccagggagaggcaggagcctgacatccgcccgcccaaacagaagatcacagacccccacgatttctccccccagcgggcctccgtaagcggaaggagttccgaggacgtcatccgccgcggtgcgctggagcgtctccggatggggtcaagtacgccccgcggggaggagcaaccagccgagacttcgtgcggcgcgcgctccggtctacaagcggcgcgctccaacgtcgccccacccgcgaacagaacggtctgggctccaaaatatgcgtgaattcccaggatgcgggaacgcgggtttggtcaacccatgccccggaaaggccctgggaaccagcccgggtgtccccttccttcccccggggaggggtgccgttcttgtgtacaaacctcctccccccaggggagggatactggtg

SEQ ID NO: 70274 - protein, 152 aa, Zea mays
  misc_feature: Ceres CLONE 1549722
MALTTRGGAGGGDPAKAPSASDPSLGFLTKRDTEVKLPRATRVKNKTPAPIQITAEQILREARERQEPDIRPPKQKITDPHDFSPQRASVSGRSSEDVIRRGALERLRMGSSTPRGEEQPAETSCGARSGLQAARSNVAPPANRTVWAPKYA

SEQ ID NO: 70275 - DNA, 717 bp, Zea mays
  misc_feature: Ceres CLONE 1549724
  misc_feature: Translation starting site: 207
ggagctccccgcggtggcggccgctctagaactagtggatcccccgggctgcaggaattcgtctcacccctagaaaaactcgaaaccctagtcctctgttacttctcccgccgccgccaatcccctcccgttctctgccaccgccgtatcccctcccgtcctccgccacctctgctgagagcgagaacagatggccggcaacggtgatgggccggcaatcggcatcgatctctgcacgacctactcttgcgtcggtgtgtggcagacacgaccgtgtcgagatcatcgccaacgaccagggtaaccgcaccacagcctcggacgtctccttcaccgactccgatcgcctcatcggatatgcggccaagaaccaggtcgccatgaacgccatcaacaccgtcttacatgcctagcgtctcattgccaggaggtttagtgatgccactgtccagagtgatattaagctgtgggcctgcgcagtcattcctgcgcgctgtgagaagccaatgatagttgttcatcacaatgccggaggataaacattttgcaaccaaagagatctcctccttggttctcatcaggaatgcgtgagatcgcataaaccttcccttggaaagatcgatcaaaaatgctgtgttcacggtcccttgcttcctcaacaaactccaaaagcgctggccacaaagggatcccggggtgaattgcctggcccaaatt

SEQ ID NO: 70276 - DNA, 692 bp, Zea mays
  misc_feature: Ceres CLONE 1549727
  misc_feature: Encodes the peptide sequence at SEQ ID NO. 70277
  misc_feature (334)..(334): n is a, c, t, g, unknown, or other
  misc_feature (401)..(401): n is a, c, t, g, unknown, or other
  misc_feature (692)..(692): n is a, c, t, g, unknown, or other
gcggtggcggccgctctatactagtggatcccccgggctgcaggaattcgtctcacccctagaaaaacacccccagcgcacgaactccaaaatagcgagccgaagggggccacgaccacgagtcctccacctccctctccgccgcgtcgcacgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacggctccaagttcaccgtgcggaccgacctgngcgccaccgtcggggcgtttaaggcgatcgtcgcccacagctgcgacgtgccggcgccgcacccccngctgatctacaagggccggatcttgaaggacgagcaaaccctagccagctacggtgtggagacagaccatacaatccacatggtacgtggtgctgtgctatcaccaacatctactgcacctgcagccaaccaagaacctaccattgctgctcctggcagttccccggcaacagggattgggtggcttgttgcaaaggctgggtactacaggcgctgctgctaacagtgaggggttgtttgggtctgcccccctggaatagacaaatgccgcaaccgctagctgaaaatccn

SEQ ID NO: 70277 - protein, 131 aa, Zea mays
  misc_feature: Ceres CLONE 1549727
  misc_feature (22)..(90): Pfam Name: ubiquitin Pfam Description: Ubiquitin family
  misc_feature (36)..(36): Xaa is any aa, unknown, or other
  misc_feature (58)..(58): Xaa is any aa, unknown, or other
MGGGDADAGGEPADAQATLHIRCTNGSKFTVRTDLXATVGAFKAIVAHSCDVPAPHPXLIYKGRILKDEQTLASYGVETDHTIHMVRGAVLSPTSTAPAANQEPTIAAPGSSPATGIGWLVAKAGYYRRCC

SEQ ID NO: 70278 - DNA, 684 bp, Zea mays
  misc_feature: Ceres CLONE 1549729
agctccccgcggtggcggccgctctagaactagtggatcccccgggctgcaggaattcgtctcacccctagaaaaaacccctcctccgcccgccaataagtaccgccccgctcgccacctccatctcagaggagagagtcgctctgcactgcacgactcctcccccatctaccactacctgtctacctacccagcccatcgactgcccctcgcaacgcaatggcgctcgcccacaactccgccgctgccgcagcagctgccgtatccgggcgcgcgggatccccagccgcaccgcgggggccacgtttcctcccgctgaaagaggggcaacattctccggcaattccaaggccggcggaaacccgttttaaaaaaaaaggggcccgccggtcccccgggggccgccgcccccttaagtcaaaccggcccctggggggggccccgcccgaaaaaaaaacccggggcgccccggaaaaagggggggcgccaaaaccctggaaaatcaaaaaaagggggtgtcaacccccccaaggaaccccaaaccccaggagagatgtgtgcccgggggccccaaaacaacataaaaaacttcccccccgggggggggtttcccccgaaaaagggcgctccccccctgggaaggaaaatgggccaaagagccccctttgtggcccccgctttttc

SEQ ID NO: 70279 - DNA, 689 bp, Zea mays
  misc_feature: Ceres CLONE 1549732
  misc_feature: Encodes the peptide sequence at SEQ ID NO. 70280
agcggaccaccgtgggggcggctctagaactagtggatccgccgggctgcaggaattcgtctcacccctaaaaaaaaaaatcatccgcctcactaccatccgatgccctcctctcaagcttattccttccccatccattactcatggcgctctcttcccacacacaccaccgctgctgcggcggcggacgacggtccctttactcaatcaactcgctcctcttccaagctattccccgcgtcatttgacgcccctcgtcccgcacggctaccatgctccctactactcgactatgcaatggcgccgtctctctcccaagacaccatggccgagacaaatagactcctcgctgcagatatcgaaaaacgggagcgcgagggaccatactacgcatcacatgaagccacgctcgcggagctctccccgcgagagctgcagctggtggtcctatacttaccgcagcaagaatccgacacctaaagcgcgctccaagtcttccactggataaagcgcgcctacaatactcaactgtgaaagcatggagctcatcgccaacatctaatgcagctgaatccagctcctcgacgaggatctcggagacgtcgacgacttagcaccactccacgaggatatggactgctgtcggctacacccctgtcacagcaacgtagagcacgtcgtatgtctat

SEQ ID NO: 70280 - protein, 125 aa, Zea mays
  misc_feature: Ceres CLONE 1549732
MPSSQAYSFPIHYSWRSLPTHTTAAAAADDGPFTQSTRSSSKLFPASFDAPRPARLPCSLLLDYAMAPSLSQDTMAETNRLLAADIEKREREGPYYASHEATLAELSPRELQLVVLYLPQQESDT

SEQ ID NO: 70281 - DNA, 758 bp, Zea mays
  misc_feature: Ceres CLONE 1549734
  misc_feature (368)..(368): n is a, c, t, g, unknown, or other
  misc_feature (758)..(758): n is a, c, t, g, unknown, or other
ggagctccccgcggtggcggccgctctataatagtggatcccccgggctgcaggaattcgtctcacccctagaaaaaacacggtcgcctctcaccttttcgctgtactcactcgccacacacaccccctctccagctccgttggagctccggacagcagcacgcgcggggcggtcacgtagtaaccagctctcggctccctctccccttgctccataggatcgtgcaacccatcgagcgacgcgcgtggactggcttccctgggtcggcgcaggaggggatcgcaaggatgacgggatcgggttgcaggggcatctgcgcacggaagccgggttcagaaggggcccgggacagggaagggacggacgncggacgccaagagaaagcaagaacctaaaataggcgcccccccacaactcttggggggcggggcgtggggatcagcgggatctcacccttgctggtatggggtacagagcagggaggcctgtcaggggtaggccgggggccgaggaggggggtagatcccccttcagggtgggtcgatgtggcgggcaaggaggggagagctagggtggagaataggcaggagagggggggattcaggtgggagggttgggtggggggaggcgaggggcgtgtggacgtggagcgtggggagggagatggagggtaggagcgctggtgcgtagcagctgtagtggtggggcgagtggtggtaattgcgtaggtagctgagtgagtacggagggtggtacn

SEQ ID NO: 70282 - DNA, 688 bp, Zea mays
  misc_feature: Ceres CLONE 1549736
  misc_feature: Encodes the peptide sequence at SEQ ID NO. 70283
tccccgcggtggcggccgctctagaactagtggatcccccgggctgcaggaattcgtctcacccctagaataagcggcgagagccggagaccgatgatgcgccgcccgccgcgcgcccggtcatggagatcggacagtcaccccgcgagcggttgctcctaggagccctgacgatctaccaggagtggttcgctgctcgcggacacatatggtgatggccgcatctctggccccgatgcgatcatagttttttggcatgtacaagctctcccgccctgacctcaagctggtctgggctatcgcggacaccatatggcctgtgtagctgggtctctccgaattcttctcggcgatgctgctcttgtctctggctgatgccgggctctgagattactcaagatacgcttcagcgagctgactcgcgctgtttgaatccacctgtgatggaaggtctagatgccctcctggcgaatcctaaacatagcgcgaagcccgttgatccagaaatggctggccatcctcgtggacagtctccctttacttaccaatggctttagctcttggtcaccttaggaggattcctctgacaatcgtcacatcttttgccctacggcttggaacaacttttccaccgtaaagtttgacccccttgggaaccaccccccactttcaattgaattccgactgg

SEQ ID NO: 70283 - protein, 30 aa, Zea mays
  misc_feature: Ceres CLONE 1549736
MEIGQSPRERLLLGALTIYQEWFAARGHIW

SEQ ID NO: 70284 - DNA, 716 bp, Zea mays
  misc_feature: Ceres CLONE 1549738
  misc_feature: Encodes the peptide sequence at SEQ ID NO. 70285
  misc_feature (640)..(640): n is a, c, t, g, unknown, or other
  misc_feature (716)..(716): n is a, c, t, g, unknown, or other
tggagctccccgcggtggcggccgctctagaactagtggatcccccgggctgcaggaattcgtctcacccctagaaaaagccctacgccgccagcttcccacggagccaccctcctccacttctcaccactgccgtctccttcccaaacccggctgccgtctcctttgattccacggcttgccacgcagcagcagcaaaactcctagtcaacccttcaactcgcctactactcctactagcccgccccttcttttcttcgatctccgcaatctacagctttgcttctcccggctcgagcggctagggtttcaggagtgcgcggtgagacggcatgacaacgcggggagctaagcgcgcggccacctccgaccccgccgcacccgatttaccaagtaagagagtaatggacggaccctcttttgatgttcacagggcggagtcttcccatcagcatgtgatggcaggacccgctagtttagatcctcggcgggcggaggctgctagcaaacatgtgagggcacttaatacccagtttgcaagctgggttcaattgcagctgcaaaatcatccagctgaactttgggaggacggccctaaggattacatatcacatgcttctgaaatcatggaaaaattcanggatgttgtcaactggctaaggcaaaatcaagcaggggtcatagtttgttcatccccaagctcactgaaggatgan

SEQ ID NO: 70285 - protein, 103 aa, Zea mays
  misc_feature: Ceres CLONE 1549738
  misc_feature (79)..(79): Xaa is any aa, unknown, or other
MDGPSFDVHRAESSHQHVMAGPASLDPRRAEAASKHVRALNTQFASWVQLQLQNHPAELWEDGPKDYISHASEIMEKFXDVVNWLRQNQAGVIVCSSPSSLKD

SEQ ID NO: 70286 - DNA, 706 bp, Zea mays
  misc_feature: Ceres CLONE 1549743
  misc_feature (706)..(706): n is a, c, t, g, unknown, or other
ctggagctccacgcggtggcggcccgctctagaactagtggatccccggggctgccaggatttcgtccttcaccccttagaaaaaacttcggccaccactttccttcctttttcttcagcttcggtcgcccaccgccggagttccaaaaggccccgcgccggccgcttttcttggtaaaaaacccaacctttacctagctaaccgttcctcttttccccctactccccttgcccaattcgaagaaaatttttaacggaggaggggaaggagaggatatttagctgattgttgattggtggtccggggtacggtggttcttgagtcgtgaagcgaccgtacattggctagggccttctccgggttgcgtgcaggatggtcttcaaaaatcgggagtgaggaggcagctcgtggccccgaaggttaaatgtaccgcaagaacgactcggcactctcctgtttctacctcttcctcctctggttcttcttcttgaaatagaccagcgccagccaccaggtagctacctactagctagcagcccagttgcgactggggacgggctgctgcttgcaagtgggaatcttggagcaggagcagaggagcgggagatggagttggatctgaacgtggccaaggtggcgccggagaagccatcgacggcgctggaggcgagctactcggggtcctcgagctcgtcggtgctgaan

SEQ ID NO: 70287 - DNA, 671 bp, Zea mays
  misc_feature: Ceres CLONE 1549744
  misc_feature (512)..(512): n is a, c, t, g, unknown, or other
ctggagctcaccgcggtggcggccgctctagaactagtggatcccccgggctgcaggaattcgtctcacccctagaaaaagtcaggtcgctgtatatgctctgggtgaaaaataatggagaaaagctgctcagtactcgcggtccctgacgagcgcaataaagcctgagcacccgtcgccaggattaatatgaccccggtgagctgccactgccaacttcgccgtgcacgagctgtgctactgctcctcggcgcgcccactccccgaggcgctccctcgtcactcagcctgccgataatcggtctcacatatatatacgtggatcaaggtgatcggctgaaccacacaagcaaacatggcgagcatgcactatgccaccacccttgttctcatgttctgcctgctacctctggtgagagtggactacctcaagtactaggacccatagctgccctgcgctgttcacatcaaggacctgcatagctccgatgactctcgccgaaaagatctgncagattgacccagatccacatggaaaacaccaaagcccaaacacttggctaaaacattaataaggaggcttgcttaacccttggaaagaacccttgccctgctcccacagggggtcgagtaaaggcttttgggcccccattggtggacccaaaaaatat

SEQ ID NO: 70288 - DNA, 597 bp, Zea mays
  misc_feature: Ceres CLONE 1549752
  misc_feature: Encodes the peptide sequence at SEQ ID NO. 70289
  misc_feature (46)..(46): n is a, c, t, g, unknown, or other
  misc_feature (55)..(55): n is a, c, t, g, unknown, or other
  misc_feature (62)..(62): n is a, c, t, g, unknown, or other
  misc_feature (63)..(63): n is a, c, t, g, unknown, or other
  misc_feature (398)..(398): n is a, c, t, g, unknown, or other
  misc_feature (465)..(465): n is a, c, t, g, unknown, or other
  misc_feature (495)..(495): n is a, c, t, g, unknown, or other
ggagctccccgcggtggcggccgctctagaactagtggatcccccngggctgcanggaattnncgtctcacccctagaaaaaggacccgttcaaggagccgatactgagcacggccaactccgtgctgtccatcctggccgccgactaccccgtggagcgcaacacgtgctacctctccgacgactccgggatgctgctcacctacgaggccatggcggaggccgccaagttcgccaccgtctgggtgcccttctgccgcaagcacggcatcgagccgcgcggccccgagagctacttcgacctcaagtcccacccttacatgggccgctcccaggaggacttcgtcaacgaccgccgccgcgtgcgcaaggactacgacgagttcaaggcgcgcatncacggcctcgaccacgacatcaagcagaagtccgacgcgtacaacgccgccagggggctcaaggacngcgagcccaggcaaacctggatggccgacngcaccccagtggggagggcaccctgggtcgagcccctccgagaaccaccgcaggggagaccacgccggcattcgtactggtggcttctgaaccacccgagcc

SEQ ID NO: 70289 - protein, 135 aa, Zea mays
  misc_feature: Ceres CLONE 1549752
  misc_feature: SWISSPROT Homolog: EC 2.4.1.12 Cellulose synthase (UDP-forming)
  misc_feature (69)..(69): Xaa is any aa, unknown, or other
  misc_feature (92)..(92): Xaa is any aa, unknown, or other
  misc_feature (102)..(102): Xaa is any aa, unknown, or other
MLLTYEAMAEAAKFATVWVPFCRKHGIEPRGPESYFDLKSHPYMGRSQEDFVNDRRRVRKDYDEFKARXHGLDHDIKQKSDAYNAARGLKDXEPRQTWMADXTPVGRAPWVEPLREPPQGRPRRHSYWWLLNHPS

SEQ ID NO: 70290 - DNA, 674 bp, Zea mays
  misc_feature: Ceres CLONE 1549754
  misc_feature: Encodes the peptide sequence at SEQ ID NO. 70291
  misc_feature (517)..(517): n is a, c, t, g, unknown, or other
ctccccgcggtggcggccgctctagaactagtggatcccccgggctgcaggaattcgtctcacccctagaaaaaaaagcgaccttcctcctctccctccagctccagttcgtctctctcctctcctcgcctaaggtttcgcctcctgtgatcccgtctcgccgtcgtcgccatgggggacaactacgacgacgaaggcgagccaatcgtggacctcgacgaacgggagccctctcctgagccacagccctacgaagatctcgatgacgacctcggcgacggcggcgattggacccgcagccgctccccgacccccgtccacggcgacgacggtgaggcggggtcctccgccaagccccggaagcgcctcctcaagaagggcggcggtggcggcatgcccggcgacgacgggctcgatgactttgggttggaggacgaggacgcggaccccgcggctgaggcgaggaagaggaaggggtcctcggcgctgagggacctcgcgaggggcggggcgggcnaagagaagaaggagaagaaaaggcggagggaggacgacgggagggggagtgatatgggattgggggaaggaaccagccgggggccacggaggggagggccctcgggggggggggggggcccgggatatgggggggaaggggaaattccgggaccctg

SEQ ID NO: 70291 - protein, 167 aa, Zea mays
  misc_feature: Ceres CLONE 1549754
  misc_feature (116)..(116): Xaa is any aa, unknown, or other
MGDNYDDEGEPIVDLDEREPSPEPQPYEDLDDDLGDGGDWTRSRSPTPVHGDDGEAGSSAKPRKRLLKKGGGGGMPGDDGLDDFGLEDEDADPAAEARKRKGSSALRDLARGGAGXEKKEKKRRREDDGRGSDMGLGEGTSRGPRRGGPSGGGGGPGYGGEGEIPGP

SEQ ID NO: 70292 - DNA, 612 bp, Zea mays
  misc_feature: Ceres CLONE 1549757
  misc_feature: Translation starting site: 204
  misc_feature (472)..(472): n is a, c, t, g, unknown, or other
  misc_feature (481)..(481): n is a, c, t, g, unknown, or other
  misc_feature (489)..(489): n is a, c, t, g, unknown, or other
  misc_feature (496)..(496): n is a, c, t, g, unknown, or other
ctccccgcggtggcggccgctctagaactagtggatcccccgggctgcaggaattcgtctcacccctagaaaaagccaaccgcgaagcactacactacactacaccacacccacccgacgacgatcacacacgcagaagatcgagttcgttcgatcgtgaccgtgacgcaggaagctataagctagccaagacaggaataataatggcggcgtcgacggtggcgagcctctctgtcccggtgacgacgacgaccttcgcggcggcgggcggcggcgacgtgctgatcgtcgtcccgaggagggcgggcgccaagcgcgtcgtctggttccccgcggcggcgcgccgcggcggcgggcggttggtcgccgtgcggtccagcgggccggccaccgccgccggagatctccgacaaggtgtcggagagcatcaagcaggcggaagagacgtgcgcggacgaccagaagggcgacnccaagtgcncggcggcntgggacnaaggtggaagaactcagcgccacggccaggccacgcccgcgaaagccctcaagggagacaaacgcccaacgacccgctccaagaagtactgcaaggaacaccccggacttccgagg

SEQ ID NO: 70293 - DNA, 661 bp, Zea mays
  misc_feature: Ceres CLONE 1549761
  misc_feature: Encodes the peptide sequence at SEQ ID NO. 70294
aagctggagctccccgcggtggcggccgctctagaactagtggatcccccgggctgcaggaattcgtctcacccctagaaaaaactgacaggcgccagagagagagaccacaactcctcgagacaccacaagggcaagggaggcgcgctcctctcgcctcgcctcgcctcccccggggaagaagaggaggagagggagctgagcagcagccggccgacgcgggaatgctcgtcggcggcgggcgggacgacgaggaggtgctccggaagctcaagagcatggacgtggacaagctggagaacggcggaggcggcggcgacgcggagagcccgcgccccgtcgtcaagtaccacggctggaaggccatgcccttcatcatcgggaacgagacgttcgagaagctgggcacgctgggcacgtcggccaacctgctggtgtacctgacgcaggtgttccacatgcggagcgtggacgcggccacgctgctcaacgggctcaacggcaccaccagcctcgcccccatcgtcggcgccttcctctccgacgcctacctcgggcgctacctcgcgctcgccatcgcctccatcgcctccctcatcggcatgttcctgctgacgcttacggccggcgcggacagccttcacccggcggagtgcggcgg

SEQ ID NO: 70294 - protein, 145 aa, Zea mays
  misc_feature: Ceres CLONE 1549761
MLVGGGRDDEEVLRKLKSMDVDKLENGGGGGDAESPRPVVKYHGWKAMPFIIGNETFEKLGTLGTSANLLVYLTQVFHMRSVDAATLLNGLNGTTSLAPIVGAFLSDAYLGRYLALAIASIASLIGMFLLTLTAGADSLHPAECG

SEQ ID NO: 70295 - DNA, 523 bp, Zea mays
  misc_feature: Ceres CLONE 1549762
tccccgcggtggcggccgctctagactagtggatcccccgggctgcaggaattcgtctcacccctagaaaaacagcggcggcaggccaggccagcagagcgcagaggaccgccgctcggaaagtgcggagccgtttccctctagctgctctctgcttgcctcgtccctccagtcacagcccagtcacgcctgcgctctctccagctcccagtgctccccgatcatcgcttcgctgctagcgcgcgcgcgatccccgaggccgcgcgcttgatcgcgctcaacggcatgtcgttccgcccccgggcgggttattggcgggcggcggccggccccggaaaaccgggggccccaaaacccccccggggggccccccccgaaaatttccttggggttggcaccccaccgtgggaaaaaaaaaaaaatttttcccccccccgcaaaaaaaactctttttccccagggggggcccccccaaaaaaaaaaaccccccccccaaaaaaaaaaaaaatcttgcgggtttttc

SEQ ID NO: 70296 - DNA, 650 bp, Zea mays
  misc_feature: Ceres CLONE 1549768
  misc_feature: Encodes the peptide sequence at SEQ ID NO. 70297
  misc_feature (393)..(393): n is a, c, t, g, unknown, or other
ctccccgcggtggcggccgctctagaactagtggatcccccgggctgcaggaattcgtctcacccctagaaaaaactccctctcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatncacaccgtctttgatgccaagcgtctcattggcaggagggttagtgatgccctctgtcagagtgatattaagctgtggcccttcaagggtcatcctgggggccggtgagaagcccatgataggttgttcagcacaggggggagggaaaaccggtttgcagccgaagaagatccccccccaggggtctcatcaagaggcgggaaatccctgaagcttaccttggcaacccaataaaaaatggttttgtcccgggcccc

SEQ ID NO: 70297 - protein, 102 aa, Zea mays
  misc_feature: Ceres CLONE 1549768
  misc_feature (67)..(67): Xaa is any aa, unknown, or other
MAGKGDGPAIGIDLGTTYSCVGVWQHDRVEIIANDQGNRTTPSYVAFTDSERLIGDAAKNQVAMNPXHTVFDAKRLIGRRVSDALCQSDIKLWPFKGHPGGR

SEQ ID NO: 70298 - DNA, 692 bp, Zea mays
  misc_feature: Ceres CLONE 1549771
ggagctccccgcggtggcggccgctctagaactagtggatcccccgggctgcaggaattcgtctcacccctagaaaaaaccgcactcagaggaggcatggagcctcatccttatccatctggtgctgatgctgggaaaacggctcgcctatggggggttgccgggagcaccgctgcggcttctcgttggttccgctcctgctctccctgatggacgatgacgagtactgacggctcatctctgacggctgcttctcccgcgcagatcctctcagtgatcagcctctggtggtcctcgccagccgcgggagtaggcgccaaagatggagtacaaatgtagagcccctacgagatcctcccctgggactggatcgtgtttgagaacatcttcctcgtgccgacctccggctacctaatgtaaagggctggcactgaccaggcaaaggggaaaaacctgttggatcagatctggggcgctcgtctcgaaaggggctgtctcgtagcaattctagaacttcctcccaaattcgctcctcgtggttcatatctagccctcggatggctctagggaaggagggactggagctcaggtacggatcccgtaatggggcggcctctaattggctgccccaaaggctacccccctgaagcggtggttttttgggggtggcatgggtcccctcagttcggaag

SEQ ID NO: 70299 - DNA, 660 bp, Zea mays
  misc_feature: Ceres CLONE 1549774
  misc_feature: Encodes the peptide sequence at SEQ ID NO. 70300
aaagctggagctccccgcggtggcggccgctctagaactagtggatcccccgggctgcaggaattcgtctcacccctagaaaaatagcacgcgatggccaccgactgctcgacgcaattctccagccgctgatcgcgccgcaccctttcccacccgcgcccatcatggcctcctccctccccgcgccgccggcctcgccctcttcctcctggcgcggactcacgccccgctgccctccgcctcgctgcggtcccctcctcgcctgcgcggcagcgcgttcttaccgttaccgcttccgaaccgacgacgacggcgtggtggacgtggccgtcgccgggaaagacggcgatgcggggtatgtggtcgctatcgaggctcctacccatggacagaggggcggtcttgtgctccgccccgccggctccggctccggcgtccctctggccccagccgcgccgggaggtgccctcgtggctgagtttgtctacgacgtgggccgcgcgccgtccacgtctcgttcacgctggccgacgcgatgggagccgagataccgacacacgggggacgagcttcccgtgcctgttggcgtcggagggggtgcccctcgcccgctcggccggtccgttccaggggggggccgctaacttccgggttaaagaa

SEQ ID NO: 70300 - protein, 159 aa, Zea mays
  misc_feature: Ceres CLONE 1549774
MASSLPAPPASPSSSWRGLTPRCPPPRCGPLLACAAARSYRYRFRTDDDGVVDVAVAGKDGDAGYVVAIEAPTHGQRGGLVLRPAGSGSGVPLAPAAPGGALVAEFVYDVGRAPSTSRSRWPTRWEPRYRHTGDELPVPVGVGGGAPRPLGRSVPGGGR

SEQ ID NO: 70301 - DNA, 668 bp, Zea mays
  misc_feature: Ceres CLONE 1549775
ggagctccccgcggtggcggccgctctagaactagtggatcccccgggctgcaggaattcgtctcacccctagaaaaaaatttctcgcggcgtcgttccgtcccaaatatcgccccgcgatcccccacctcgccgactggctccccccttccacctcgtcgacgggcagaggagacccctcagggccgggatcggactcctctttcaccgatttttccatgcactttaggctaaaaatgctttggtctgaaacctatctgccctttttgctggccgccaacggtttcagccaacgcataccagtgatgaagatcttccgctgaagcttgctcaagctgcaataaagcatgacggttgtgcacataatgatgcttaatcattcatgttgcgaaaccctccagtggaacttccttcttctgatgccaccatgtctaggtggacctagttttgaggtggatgcgctgagttttgaatgtggcgagggatctttgctgccgagttctatttgttcccagcgatttttgggacacgttcattggtcagatcaagaatctagggcaaggtccacctttgacccgacatagataggtgatggaaacccgcggggaaagttttttattgggcttccaataggagaaccctaaaagaacatctgtagcccgccctac

SEQ ID NO: 70302 - DNA, 669 bp, Zea mays
  misc_feature: Ceres CLONE 1549776
  misc_feature: Encodes the peptide sequence at SEQ ID NO. 70303
ctggagctccccgcggtggcggccgctctagaactagtggatcccccgggctgcaggaattcgtctcacccctagaaaaagaacagacaaagcacgagcggtggtagctggccagccaccatggctccaccacctctgttcccgctcccgcctctcctcatcctcctcgtcatcgtgcctctgttccccaccgccgcgccgacggccacgacgctgccgctgtaccgccacctaccgcacgtagccgaggccgtggcatcgcaccaccacccgctgtcccgcctggccgccgcgtcgctggcccgcgcgttgcacctcaagcgccgggaccccaaccaccacagccagaaaggatcaggcggccacccgtcagtaccagccaccgccgcgctgtacccgcactcctacggcggctacgccttcacggcgtcgctcggcacgccgccgcagccgctccccgtgctgctcgacaccggcagccacctcacgtgggtgccatgcacctcgagctacgagtgccgcaactgctcctccccatccgccttcggcgtcccgggtctccaccccaagaactcctcctctcccgcctcgtggggctggcgaacccctcttgcaaggggggtccctcggccgggaacctcgccaccaatggcgccgggcccctggtcc

SEQ ID NO: 70303 - protein, 183 aa, Zea mays
  misc_feature: Ceres CLONE 1549776
  misc_feature (97)..(174): SWISSPROT Homolog: EC 3.4.23.12 Nepenthesin
  misc_feature (72)..(126): SWISSPROT Homolog: EC 3.4.23.5 Cathepsin D
MAPPPLFPLPPLLILLVIVPLFPTAAPTATTLPLYRHLPHVAEAVASHHHPLSRLAAASLARALHLKRRDPNHHSQKGSGGHPSVPATAALYPHSYGGYAFTASLGTPPQPLPVLLDTGSHLTWVPCTSSYECRNCSSPSAFGVPGLHPKNSSSPASWGWRTPLARGVPRPGTSPPMAPGPWS

SEQ ID NO: 70304 - DNA, 888 bp, Zea mays
  misc_feature: Ceres CLONE 1549779-R
  misc_feature (888)..(888): n is a, c, t, g, unknown, or other
aaaccaattgggtacctcgagcgtctcgttttttttttttttttttgataccatccccattcctgccttttatttcttcaataatcagcgttttcctcttgttcctgctttggtttgggactcgtccctagcctggtgaactaccaactttactatttacactatcagtcctgccatttaaaatttcacgtgcccgatcatattggcatctcaaacaacactttaacgtttctgatggctttaaaggctgccctccaacacactgaatctttcctccttggcttctgtgccctctgaccttgccggcaactcccacactttctcgatcatgagggtcccgagcgtgaactacccggtcccaaaggtgtaacgtgggattctttatcaatttgatgaacagtctcgaacagccccaacggagagggcgcggctcactatgagacacctccgaataacccccgtgatttgctcctgggtccttgaataagtcccctgccataaaccatacagagtggtcccggactagcaccctctcttggactatgaaccccgtgccggctggagatagtgtattctttcaaacgccaatcccttgtgggaaaaaattccattgaggacttctccccgtttgtggattctcctccaccccttaaaatgtgaccctaggaaatggtgtccggtcttaggggcccctcccataacaattttcccctttttcgactttggttttccccccccattttgcgggcgccttttttttggcccgttgtcgcccgcgatgatagagttcgccccagtggggtctcctgcatagctcgggattgttttgacgagtggtttatgccccggtcgtttggtcggcgcgcactctatttaaatagccggagn

SEQ ID NO: 70305 - DNA, 657 bp, Zea mays
  misc_feature: Ceres CLONE 1549782
  misc_feature: Encodes the peptide sequence at SEQ ID NO. 70306
tcaccgcggtggcggccgctctagaactagtggatcccccgggctgcaggaattcgtctcacccctagaaaaatcatatcaagccacagcatgcatcttggagtattggccacagcctcccatgccatctccactggaaccctcttttctgttttctacaaaccaaggtttgatgttgttttgctttatctatacatatgtctgcagtgcacttcttattaatggatgtgcaactgtcctgatttgactgtactttctgtttgctaatttcactctgtttcaaatttcaaagtcagttctgtactctgctttagttgtaaacaagctttttgattgtagctactgcatccattgagtgatgtcttatcccttgccccttcctttgcaccaaagatacacactatggttgtcctagttagcattatcgtgtgcatgttttgtttccttcataatcttgctcgctaaaactttatgctcccttttatgtgttcccagaactagtcgctctgattttattgtgattgtgaacaagtaccttgaactaaaaaccaaaaaattcctgttggaatgaaggttaaaataaaaatttaaagggaagaagcccctgaaaaaaagtataatttggaacttcttctaaacattttattttggcctggg

SEQ ID NO: 70306 - protein, 43 aa, Zea mays
  misc_feature: Ceres CLONE 1549782
MHLGVLATASHAISTGTLFSVFYKPRFDVVLLYLYICLQCTSY

SEQ ID NO: 70307 - DNA, 592 bp, Zea mays
  misc_feature: Ceres CLONE 1549785
  misc_feature (191)..(191): n is a, c, t, g, unknown, or other
  misc_feature (409)..(409): n is a, c, t, g, unknown, or other
  misc_feature (479)..(479): n is a, c, t, g, unknown, or other
ctccccgcggtggcggccgctctagaactagtggatcccccgggctgcaggaattcgtctcacccctagaaaaaaagagtgaaggaggagcctgcccgcgcctgcgcctggttgtaattgtagctcacgctcacccttcagttgaccaccgctgcggcagcaatggcggcgagtcgccggcagcaccgccngcggcttcccgctggtcccgctgctgctgtcgctcctggcggccgccgcgtacggccgcctcatctccgacggcggcccgcccgcgccgctcctcccggtcatccgcctcgcggcgccgccggccgaggccgagtgcgagcagacctacggcttcctcccctgcaccaccaccgtgctcggcaacctcttcctggtgctggcctacggcttcctcatnggtcaggcggccacgttcctgtcggcgggcagcgagctgctgctagagatcatggggccccgggctcgtncggcgcctcctcctccccatcctaggcgccctccccgacgcgctcctcgtcctagtgtccgggcctctccgggagcaaaaaggaaggccaaaaaccaggtgcttgatcgggga

SEQ ID NO: 70308 - DNA, 671 bp, Zea mays
  misc_feature: Ceres CLONE 1549787
  misc_feature: Encodes the peptide sequence at SEQ ID NO. 70309
  misc_feature (439)..(439): n is a, c, t, g, unknown, or other
  misc_feature (445)..(445): n is a, c, t, g, unknown, or other
  misc_feature (446)..(446): n is a, c, t, g, unknown, or other
  misc_feature (551)..(551): n is a, c, t, g, unknown, or other
ctggagctccccgcggtggcggccgctctagaactagtggatcccccgggctgcaggaattcgtctcacccctagaaaaaaaactcacagcacaaacgttcctctcctcttccatcgtcgtcctcgctcccggccccgcctgtctagtctagtcccctcttctcgcgtgcaacccctgtactgtacgtgctaggcacacagctagctgcagctacagcagggcagcaaatggtttctggtgcgggtcatggtgggtacggcggcggcgacgacgggcaggccgtcgacttccggggcaacccggcggacaagtcgaggaccggaggctggctgggcgccgggctgatcctgggcacggagctggcggagcgcgtgtgcgtgatgggcatctccatgaacctggtgacgtacctcgtcggcgagctgcaccctctcaacntcaagnntcgcaccgtggtgaccaacttcatgggcacgctcaacctgctcgccctcgtcggcggcttccctcgcgaacgcaagctcggggcgctacctcaacatcgcatctncggcacaatcgccgccacgggcttgagcttgctgacggtggacaccacgggcccagcaatgcgtccccggcgtgcctggaaccccccggcccccccccccaaaaatgcttcccggccccc

SEQ ID NO: 70309 - protein, 147 aa, Zea mays
  misc_feature: Ceres CLONE 1549787
  misc_feature (71)..(71): Xaa is any aa, unknown, or other
  misc_feature (73)..(73): Xaa is any aa, unknown, or other
  misc_feature (108)..(108): Xaa is any aa, unknown, or other
MVSGAGHGGYGGGDDGQAVDFRGNPADKSRTGGWLGAGLILGTELAERVCVMGISMNLVTYLVGELHPLNXKXRTVVTNFMGTLNLLALVGGFPRERKLGALPQHRIXGTIAATGLSLLTVDTTGPAMRPRRAWNPPAPPPKNASRP

SEQ ID NO: 70310 - DNA, 536 bp, Zea mays
  misc_feature: Ceres CLONE 1549788
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
ggagctccccgcggtggcggccgctctagaactagtggatcccccgggctgcaggaattcgtctcacccctagaaaaaccgctaaggagtgtgtaacaactcacctgccgaatcaactagccccgaaaatggatggcgctgaagcgcgcgacccacacccggccatctgggcgagcgacatgccccgatgaagtaggagggcgcggcggccgccgcaaaacccgggggctgcgagccccggggcggagccggccgttccggtgcagatccttggtggtagtagcaatatccaaatgaggtcattcctcgcctcccccggtcgaaaaaccctgccggaaacccgggggggggggggggccaatttttcccnnntccccccccggggcctaaaaaaccccaattttttttggccttttccccccggtcccggggggaaaaaccccctgggggggggccccccccccggggggggttttccccccccccccccccggggggccccctttggggggggggggggcccccccccccccccc

SEQ ID NO: 70311 - DNA, 672 bp, Zea mays
  misc_feature: Ceres CLONE 1549789
  misc_feature: Encodes the peptide sequence at SEQ ID NO. 70312
  misc_feature (376)..(376): n is a, c, t, g, unknown, or other
  misc_feature (377)..(377): n is a, c, t, g, unknown, or other
tcaccgcggtggcggccgctctagaactagtggatcccccgggctgcaggaattcgtctcacccctagaaaaaagcatcccttctcccgatcacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaagggcaagccgccgctccctccctcgccgccgggcaccctccccatcgtggggcacctacaccacatcgggccccagacccacatctcgctccaggagctggtggccaagtacgggcacaacgggttccnntgttcctcgcgccggcgccgtgcccaccctgatcgtgtcgtcgcccagcgccgccgagccgtgatgcgcacccacgaacacatcttcgcgtcccggccgtgggtccatgggcttccaaaatcttccggttacacacctgggaagtgggccttctccccgctcgggcaaatactgggcgcaaacccggaaaactgattgaaacacccccggctaagaaaaaaaaaggttctaccccttcccccatggcccccaaagaaaaaaggggtcccccccctctgggaaaaacccccccgga

SEQ ID NO: 70312 - protein, 158 aa, Zea mays
  misc_feature: Ceres CLONE 1549789
  misc_feature (94)..(94): Xaa is any aa, unknown, or other
MALQAAYEYLQQAVGHGAWSSTQTLTLLLIAVPTVLLLLASLAKSTSSSGKGKPPLPPSPPGTLPIVGHLHHIGPQTHISLQELVAKYGHNGFXCSSRRRRAHPDRVVAQRRRAVMRTHEHIFASRPWVHGLPKSSGYTPGKWAFSPLGQILGANPEN

SEQ ID NO: 70313 - DNA, 651 bp, Zea mays
  misc_feature: Ceres CLONE 1549798
  misc_feature (483)..(483): n is a, c, t, g, unknown, or other
  misc_feature (518)..(518): n is a, c, t, g, unknown, or other
aagctggagctccccgcggtggcggccgctctagaactagtggatcccccgggctgcaggaattcgtctcacccctagaaaaaagttactctagggataacaggctgatcttccccaagagtccacatcgacgggaaggtttggcacctcgatgtcggctcttcgccacctggagctgtaggtggttccaagggttgggctgttcgcccattaatgcggtacgtgagctgggttcagaacgtcgtgagacagttcggtccatatccggtgtgggcgttagagcattgagaggacctttccctagtacgagaggaccgggaaggacgcacctctggtgtaccagttatcgtgcctacggtaaacgctgggtagccaagtgtggagaggataactgctgaaagcatataagtagtaagcccaccccaagatgagtgctctctaaggacctcgggaatccagaaaattccggtgtcggtgcccacnggacaggcgtgtgcgccacgagcccgacgaacaanggaacgaggctatttccaccggtcaaactaggagaaagcagcaaagctccccaccattagcagaatccgcccgaagtctgccccgctctttcggcctcgtcccttctctccaggccatggatgtagatgatgt

SEQ ID NO: 70314 - DNA, 663 bp, Zea mays
  misc_feature: Ceres CLONE 1549805
  misc_feature: Encodes the peptide sequence at SEQ ID NO. 70315
  misc_feature (417)..(417): n is a, c, t, g, unknown, or other
  misc_feature (444)..(444): n is a, c, t, g, unknown, or other
  misc_feature (445)..(445): n is a, c, t, g, unknown, or other
  misc_feature (493)..(493): n is a, c, t, g, unknown, or other
  misc_feature (494)..(494): n is a, c, t, g, unknown, or other
ctcaccgcggtggcggccgctctagaactagtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccgtcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggataccctgcctcgagttcagcaaggtcngcttcgtgtaccgcgagaactccaccnntcccgtgctactacgacgggcgctactgggacatggtgaaagctgccnnatgtcggctgcaaagacgccacccaggtggacaaggagctgcaggagggccataaaatcctacccggaacccttttcaccgggttattgggtttcaaaaacttaaagcaaaaccgggggttaagttttatcggcaaaaacccccgggggaagaaaaaaaaacgcccccc

SEQ ID NO: 70315 - protein, 154 aa, Zea mays
  misc_feature: Ceres CLONE 1549805
  misc_feature (58)..(127): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
  misc_feature (95)..(95): Xaa is any aa, unknown, or other
  misc_feature (104)..(104): Xaa is any aa, unknown, or other
  misc_feature (120)..(120): Xaa is any aa, unknown, or other
MAPTVMMASSATAVAPFQGLKSTASLPVARRSSRSLGNVSNGGRIRCMQVWPAYGNKKFETLSYLPPLSTDDLLKQVDYLLRNGWIPCLEFSKVXFVYRENSTXPVLLRRALLGHGESCXMSAAKTPPRWTRSCRRAIKSYPEPFSPGYWVSKT

SEQ ID NO: 70316 - DNA, 633 bp, Zea mays
  misc_feature: Ceres CLONE 1549809
  misc_feature (256)..(256): n is a, c, t, g, unknown, or other
  misc_feature (571)..(571): n is a, c, t, g, unknown, or other
  misc_feature (572)..(572): n is a, c, t, g, unknown, or other
ctccaccgcggtggcggccgctctagaactagtggatcccccgggctgcaggaattcgtctcacccctagaaaaagcaagccttcccggttacttgttcactaacaaggtcgggacggcatggcccttggagctgcgtaccatcactacctgcagctcgccggcgaccatggcaccgccacacacgcactgctcctcggcgtacttatcttcctcgtcatccgcctagtatccgaagggggaccgggccaacctcngccaaaaaagttaggggaaaagggggttcccctcccccctttcccccgggaaaggtcccctttttgggccccccccccttttggggccgaaaacccctttttttttgggggggttgggccccaaaagggggggaaaaggcttttttttccctccctaaggggccgcccccccccttttgtttttctccccccaggccccaaaaaattttttttccaaaaaaaaaatttttttttttggcgcccccccctttggtgggaaaaaattattttttgccccgcccccccaatatttttttcccccccccagaggaaggnngggggggggggagaaaaaaccccccccccccccccccctcttaaaaaacagaggaggtggc

SEQ ID NO: 70317 - DNA, 648 bp, Zea mays
  misc_feature: Ceres CLONE 1549816
  misc_feature: Encodes the peptide sequence at SEQ ID NO. 70318
ctggagctcaccgcggtggcggccgctctagaactagtggatcccccgggctgcaggaattcgtctcacccctagaaaaaacacgcctcttctccccccaaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgcccgtccctgctgcggtgccgcgcgttcaagcaggaggccagcgacggcgacccggctgaggccgacgcgcgcaagcgcaggaagggcccgctgtacaagctcaaggcggcgatccagggcctcgcgggatcccgctccgccgcgccgaagtgtacggggggagagtaccagtaccagcgcgccgtcgagaaggcggaggagatattcttctcggttgctactcagctaggcagatatgttatcactatgatgagcagcggtgttgtacttgggggtgggattccagctgtcaggcggagacagccaaatgaacgaact

SEQ ID NO: 70318 - protein, 148 aa, Zea mays
  misc_feature: Ceres CLONE 1549816
MAAAAAAAVAHLSIHGRLRRSPEHRPSITTTTTSSSSPSAHRPSLLRCRAFKQEASDGDPAEADARKRRKGPLYKLKAAIQGLAGSRSAAPKCTGGEYQYQRAVEKAEEIFFSVATQLGRYVITMMSSGVVLGGGIPAVRRRQPNERT

SEQ ID NO: 70319 - DNA, 672 bp, Zea mays
  misc_feature: Ceres CLONE 1549818
  misc_feature (214)..(214): n is a, c, t, g, unknown, or other
  misc_feature (264)..(264): n is a, c, t, g, unknown, or other
  misc_feature (311)..(311): n is a, c, t, g, unknown, or other
  misc_feature (398)..(398): n is a, c, t, g, unknown, or other
  misc_feature (400)..(400): n is a, c, t, g, unknown, or other
  misc_feature (429)..(429): n is a, c, t, g, unknown, or other
  misc_feature (430)..(430): n is a, c, t, g, unknown, or other
  misc_feature (594)..(594): n is a, c, t, g, unknown, or other
  misc_feature (672)..(672): n is a, c, t, g, unknown, or other
tcccccggggctgcaggagttcgtctcacccctagaaaaagccttcttctctcttggtagttttcgcccctcgcgttgcgtgtatggactgtgaaatacaggagtggggatggggaaacccaggaaagacagagagagagagagagagagagagagcgttcaccgagaatgggcgtctcctccggcgaacgcccggcgtacgggcagtaccacnctgggactggtggttggtttaggccggtggtgtgttggtgcggttggttntgggttggttactttgtgcgagggagattttgtggatgttggcagtnggtgggcctcatccctcatgccaccgaggcgggttccgggctcggggccggggttggtgttcccccggcgcccccccttgtaggggnangctttcctgcggcccgcccgaccactgcnncaccccggccccaaaagcctaagggcgggggagggcttccggagagggggcccgtgccggggagcgcgtccactcctagaaagtttcctccccggagtcggcaagtgccgggggcctcgggtcatttatgaatcccctgttcggggcgccccgcctttggccgnccccgtcacctgataagtgcggcgggcccgccgggggtctcgggggggcggggggtccgcctgggtgggtcgatcgtn

SEQ ID NO: 70320 - DNA, 661 bp, Zea mays
  misc_feature: Ceres CLONE 1549820
  misc_feature: Encodes the peptide sequence at SEQ ID NO. 70321
  misc_feature (661)..(661): n is a, c, t, g, unknown, or other
agctccccgcggtggcggccgctctagaactagtggatcccccgggctgcaggaattcgtctcacccctagaaaaaaggcctcgcccccccgtgccctcccccgtcccactgacggtggcccccaccgcccggccccgctcgtcggcgagcgccccttccccacgctgcaccgctgtcctgggcttcctgcccaagagatccgcccgactccggtcgctcggaggccggcgagccgcgcgtgctgggcgccgggatgcaggcggccggcgccagccggtggcccggatctcgctggcggcgcgtctcggcgagacaaataatggaagagttacaagattgcaactcaagaagcctggctgcccttccgggctctttgggtctgcgtctctttaggctgtttggccagcaagatcagagttcatgggagaagtacatactagcttactttctgttggccaggaatgagtacttctctggggagtcgaaaaaaccctcaatgggtcctgggatatttccaaattagatttctttctatttgcctacaatttggataggggaaaaacttgaactggaggagcaaaaaaccctttccaaagcctcatccggagggggattcaagggggaaccaatccaaatgatttgttctttccccgggccttn

SEQ ID NO: 70321 - protein, 89 aa, Zea mays
  misc_feature: Ceres CLONE 1549820
MQAAGASRWPGSRWRRVSARQIMEELQDCNSRSLAALPGSLGLRLFRLFGQQDQSSWEKYILAYFLLARNEYFSGESKKPSMGPGIFPN

SEQ ID NO: 70322 - DNA, 652 bp, Zea mays
  misc_feature: Ceres CLONE 1549822
  misc_feature: Encodes the peptide sequence at SEQ ID NO. 70323
tacccgcggtggcggccgctctagaactagtggatcccccgggctgcaggaattcgtctcacccctagaaaaagcctctcccaccgccgccgccgccgcggcgacctgctcgccgccaatctctaccccgccggcgacaccaagcttctcaagcagcacctccagcaccaggccacgcccaccaaggacatccaggagattgtccgccgccagcaggcggagacgccgcctccgccggcggtgcagctcgccaaggccgtggcggagccgaagacgcctcctccgccgccgccgccgcagcacaggcagccggcgcggaagacgcccggcagcggcgccacgaccagcggcgggagcgaacgggacggggccacgcctaggagcacgggaagcgcggggatgccggaggtttcgcatctcgggtggggccactggttcacgctccgtgagctggaggaggccaccgacggcctcaccgaggagaagtcatcgggggagggtggctacggggatcgtgtacaaaggcacgctgcacgactccacttttgatcgccgtcaagaatctcctccataatagggggcaggcccgagaaggagttcaaaggtggaggtcgaaagcaattgggtcgtgttcggcacaaaaatctcgtcg

SEQ ID NO: 70323 - protein, 49 aa, Zea mays
  misc_feature: Ceres CLONE 1549822
MPEVSHLGWGHWFTLRELEEATDGLTEEKSSGEGGYGDRVQRHAARLHF

SEQ ID NO: 70324 - DNA, 684 bp, Zea mays
  misc_feature: Ceres CLONE 1549823
  misc_feature: Encodes the peptide sequence at SEQ ID NO. 70325
  misc_feature (582)..(582): n is a, c, t, g, unknown, or other
  misc_feature (599)..(599): n is a, c, t, g, unknown, or other
  misc_feature (608)..(608): n is a, c, t, g, unknown, or other
  misc_feature (609)..(609): n is a, c, t, g, unknown, or other
ctccccgcggtggcggccgctctagaactagtggatcccccgggctgcaggaattcgtctcacccctagaaaaagtccattcattcccgtctcgtcttccgctgcttgcctccaactccccccgcgtcgtctcgtgcttcccaatcaccatagagccggttgatccccaaaggcccatggttttctccgacgccgcgtcgcctctcgtagccaccgccgctgactctgcttcctcctgcgtcgcccacctcccctgctgctgtcgcgttagttgttgccgttgttgttgaagacgcgtagctcgctagggttcgtgatttctcgccgatcggttcgggaactggtaagctatggatctctcgcggcccgcatcgtcagacctctcgctcgggctgcactctcatgcccacgcccacgctcgcgtgcatgcggcagccgcgccgctgcgcctgttcgacgacgcgaagccggagcgcctcgtggccggggaggccgacgcggagagggacgacggggacggtggcgaccagcacttctccctcctcgggcactccctctgcgtcaagcgcccgcgccgcgccngtcacggcgggggggcngggggtttnnaaaaaactcattcctgctcgtccccggcgctgcgccccgccaagcggcagcggcgggggaaaaaaataaccggcc

SEQ ID NO: 70325 - protein, 111 aa, Zea mays
  misc_feature: Ceres CLONE 1549823
  misc_feature (78)..(78): Xaa is any aa, unknown, or other
  misc_feature (86)..(86): Xaa is any aa, unknown, or other
  misc_feature (87)..(87): Xaa is any aa, unknown, or other
MDLSRPASSDLSLGLHSHAHAHARVHAAAAPLRLFDDAKPERLVAGEADAERDDGDGGDQHFSLLGHSLCVKRPRRAXHGGGAGGXXKTHSCSSPALRPAKRQRRGKKITG

SEQ ID NO: 70326 - DNA, 669 bp, Zea mays
  misc_feature: Ceres CLONE 1549827
  misc_feature: Encodes the peptide sequence at SEQ ID NO. 70327
ggagctccccgcggtggcggccgctctagaactagtggatcccccgggctgcaggaattcgtctcacccctagaaaaacttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtaggagaggaagaggggacaaggcccggtcggtcggtcggtcggtcggggggctctcggatctcgccgctgcctccccgttcgttcgttcgttcgttgggatctcgcgccatggccgccgtcgcgccgcccccggcccccgcgccggcaccggttcctgctcctgctcctgccaccggccctgtcgcggatcaaaccacggatctgctgcagaagctgtcgctcgactcgcagcccaagccggcggacgcaacacagcctgctgctgccaccgccaaaaagcagggcgccgcggcgagccagccgctgagcgtggcgatcccgccggagccgtccatcacgccggtgatccaagactttacggatcccaacctgttttatctaccagcgtattactacgg

SEQ ID NO: 70327 - protein, 96 aa, Zea mays
  misc_feature: Ceres CLONE 1549827
MAAVAPPPAPAPAPVPAPAPATGPVADQTTDLLQKLSLDSQPKPADATQPAAATAKKQGAAASQPLSVAIPPEPSITPVIQDFTDPNLFYLPAYYY

SEQ ID NO: 70328 - DNA, 684 bp, Zea mays
  misc_feature: Ceres CLONE 1549828
  misc_feature: Encodes the peptide sequence at SEQ ID NO. 70329
  misc_feature (644)..(644): n is a, c, t, g, unknown, or other
ctccccgcggtggcggccgctctagaactagtggatcccccgggctgcaggaattcgtctcacccctagaaaaagctctcttcgccgccaccgccgacaaataaccgccgcaattcgaagcaagagagccgcaccaggagaagatatagtgagagtgagagcccgaggagggggtggcgcgatggggctctcgggcgcgacgatctcggcgccgctcggctgctgcgtgctgcggtgcggggcagttggcggaggtaaggccctgaaggcggacgcggagaggtggcggcgggcgggatggagccgacgcgttggcggaccgaaggtgaggtgcgtggcgaccgagaagcacgacgagacggcggcggtcggggcggcagtgggcgtggatttcgcggacgaggaggactaccgcaagggcggcggcggcgagctgctctacgtgcaaatgcagtcaaccaagcccatggaaagccagtccaagatcgcctccaagctatcgcccatatctggatgaaaatccagtgcctgaattgggttaccttgggttgggggccaacctgggccttcccctggctttcgaagtcggctaaaaaaagggcccccctgtaggggctccttggggccctgaccctttcccttcnaaaaataaactttgggggtggggggaaaggattaaatttt

SEQ ID NO: 70329 - protein, 111 aa, Zea mays
  misc_feature: Ceres CLONE 1549828
MGLSGATISAPLGCCVLRCGAVGGGKALKADAERWRRAGWSRRVGGPKVRCVATEKHDETAAVGAAVGVDFADEEDYRKGGGGELLYVQMQSTKPMESQSKIASKLSPISG

SEQ ID NO: 70330 - DNA, 612 bp, Zea mays
  misc_feature: Ceres CLONE 1549829
  misc_feature: Encodes the peptide sequence at SEQ ID NO. 70331
  misc_feature (473)..(473): n is a, c, t, g, unknown, or other
  misc_feature (483)..(483): n is a, c, t, g, unknown, or other
  misc_feature (506)..(506): n is a, c, t, g, unknown, or other
ctggagctccccgcggtggcggccgctctagaactagtggatcccccgggctgcaggaattcgtctcacccctagaaaaattttcaaagtccttcaaggaaatggttgcgatgtgcttggtgaaagatcaaacgaagaggccaacagctgaaaaattacttaagcattcttttttcaagaatgcaaaacctccggagctaactgttaagaacattttaactgatttgccccctctttgggaccgtgtaaaggcactccagctaaaggatgcagcacaactagctttgaagagaatgccttcttcagaacaagaagcactttctatgagtgagtaccaacgaggtgtcagtgcatggaacttcgatattgaggatctaaaggctcaggcatcactgatatgtgatgatgatccacctgaaataaaagaagacgatgacactggtagaataactgacattgataaggatacatcnttctgacganttattttggaaagacagcaccantcgatgggaaaataactgcaggtgatcggttctttctggtgcccagcaaatcctggtcaaaatggtcccgaaataaatgaaattttgctttcaacaatgggaatgc

SEQ ID NO: 70331 - protein, 158 aa, Zea mays
  misc_feature: Ceres CLONE 1549829
  misc_feature: SWISSPROT Homolog: EC 2.7.11.1 Non-specific serine/threonine protein kinase
GAPRGGGRSRTSGSPGLQEFVSPLEKFSKSFKEMVAMCLVKDQTKRPTAEKLLKHSFFKNAKPPELTVKNILTDLPPLWDRVKALQLKDAAQLALKRMPSSEQEALSMSEYQRGVSAWNFDIEDLKAQASLICDDDPPEIKEDDDTGRITDIDKDTSF

SEQ ID NO: 70332 - DNA, 681 bp, Zea mays
  misc_feature: Ceres CLONE 1549834
  misc_feature: Encodes the peptide sequence at SEQ ID NO. 70333
  misc_feature (409)..(409): n is a, c, t, g, unknown, or other
  misc_feature (479)..(479): n is a, c, t, g, unknown, or other
ggagctccccgcggtggcggccgctctagaactagtggatcccccgggctgcaggaattcgtctcacccctagaaaaagcgagcgagaggcgcgctgttgcggaaatgccgctcccggcgttcctggcggcggcggcgaggctcgccgtcctgctggccgccgccgtgactgcggccaacgcggtctccttcgcgcgctaccggcgccgccacctccgccgcatccccaaccccatcgacgagtccgccgaccccgtcgccgacttccgcgccctccgccccgcctcggccgaggacgccgcagaagatgacagcttcttctttgggctagcgaccgcgccggcacatgtggaggacaggttggaagacgcttgtcttcagtttgcggtggagcactcctgcgacgacnaggaggccatgcgcgaccctacgacagcagatgcggtgatggcgtccgctgcaggggacggaggtgctcnagtggcttctcgtaggtcgtccagagggagatgataggatggtgatggggaatttttttaagaacccctcttaagatccccctgggaggccaatgctcggggggtttgaaatgtttgctaaaggtggggaaaccagggttccgcctccgcctcccgggggaaaattgccacccccaaactgtgcgggcttggccacaatgtc

SEQ ID NO: 70333 - protein, 135 aa, Zea mays
  misc_feature: Ceres CLONE 1549834
  misc_feature (102)..(102): Xaa is any aa, unknown, or other
  misc_feature (125)..(125): Xaa is any aa, unknown, or other
MPLPAFLAAAARLAVLLAAAVTAANAVSFARYRRRHLRRIPNPIDESADPVADFRALRPASAEDAAEDDSFFFGLATAPAHVEDRLEDACLQFAVEHSCDDXEAMRDPTTADAVMASAAGDGGAXVASRRSSRGR

SEQ ID NO: 70334 - DNA, 680 bp, Zea mays
  misc_feature: Ceres CLONE 1549835
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
gcggtggcggccgctctagaactagtggatcccccgggctgcaggaattcgtctcacccctagaaaaagcctctctctccgctccctctgacttgttcgcttgccgtcctcgctcgcggcaaagctgcagcgtgtctcggctccggcgcgccaccgctcgggacgcccgacggatccgctcccgcgtgcgctcgatatcccttgcttcaacggtccaagtcaacccccccaccaaatcgccgtccgtccggccgctgccgcaccctagcaggatcgcagcgtgcacagctcttcttcaatctgcaggattgcagccacgcacaagtcgtagctgttttccttggaactttgagctttggaagatgccaaggagaacaggaaatgctgcttcgaccaaatcagttgaattggtcaaacaagacaaatggagtttgatcatcttgatgaaggagatgaaaaggaagaagttgagtttgaggaaattgaggaggaggttggattttgaaaagttaaagtatgagaaagaagaannnnnnnnnnnnnnnnannnngnnncccaccactctgtggcgccgtgtttaagtggcaggaacccccgctccccccctactatctttttcaccgatgcccacgttaggggccccccactgtcatttctttcccccagacagacggctgac

SEQ ID NO: 70335 - DNA, 668 bp, Zea mays
  misc_feature: Ceres CLONE 1549837
  misc_feature: Encodes the peptide sequence at SEQ ID NO. 70336
  misc_feature (461)..(461): n is a, c, t, g, unknown, or other
  misc_feature (482)..(482): n is a, c, t, g, unknown, or other
aagctggagctccccgcggtggcggccgctctagaactagtggatcccccgggctgcaggaattcgtctcacccctagaaaaaagtccccagtcccccactgggagcggcagccagcacgaggaaggagcagcgcgagggcaggcgccatgggggtccgctcggcggccacgaagctgcacatcccaccatccgccgcccgccgccccacgttcctgccattcgtggccgtcctcctcctctgctctgcctcctatctcatcggcgtctggcagcacggcggcttcgccactccatccgacaaacccgccgccgtctccaccgctacggccgtcgcctgcaccaacatcgccgccgccccgaagaagaggacccggtccggcgccagctccccgtccctcgacttctccgcgcgccacgcggccgcggcggacgacgcgctcgacgctagcaccgccaccngcgcctccctcggcgcgccgngggaggtcgtcgtacccggcgtgcccccgcaggtactccgagtacacgccctggcaagacctgggacgggtccctgccgttcccgcgggaccccctggtgtaacgggagcggaaattccccgcgtcaaaaagggagcggctgcctgtccttgggccccccccccccgggtaccgacccccctttcc

SEQ ID NO: 70336 - protein, 173 aa, Zea mays
  misc_feature: Ceres CLONE 1549837
  misc_feature (105)..(105): Xaa is any aa, unknown, or other
  misc_feature (112)..(112): Xaa is any aa, unknown, or other
MGVRSAATKLHIPPSAARRPTFLPFVAVLLLCSASYLIGVWQHGGFATPSDKPAAVSTATAVACTNIAAAPKKRTRSGASSPSLDFSARHAAAADDALDASTATXASLGAPXEVVVPGVPPQVLRVHALARPGTGPCRSRGTPWCNGSGNSPRQKGSGCLSLGPPPPGTDPPF

SEQ ID NO: 70337 - DNA, 643 bp, Zea mays
  misc_feature: Ceres CLONE 1549839
  misc_feature: Encodes the peptide sequence at SEQ ID NO. 70338
  misc_feature (305)..(305): n is a, c, t, g, unknown, or other
  misc_feature (323)..(323): n is a, c, t, g, unknown, or other
  misc_feature (619)..(619): n is a, c, t, g, unknown, or other
ctggagctccccgcggtggcggccgctctagaactagtggatcccccgggctgcaggaattcgtctcacccctagaaaaactgtgactgtgagtgagcagccccgtggagtggcggcaatcatcgctagcaagacgtgaagagttctcaagcaggaggcgtgtgacgtcagcaaggacaccagtgttttcagtggagtggtggcgccagcaggaggccggcgaggggtcttctcttctagtagatgatgattgatgtggacttgaatttggaagttctaggaggagtaggagtatataaactggnaggaagaagtggaagaanaggagagccaaatgcgagcgcgatccatggctccaaatcgaatccaaagaaactagtagaagtaatgcgggcgagggatttgcacccgctgtgctgcctccccgccgccgacggaggaccccctccgcctccccttgctcatgcaccgccggccgtggctgggctgctctacaagtggaccaacatcggcaagggctggcgcccgcgctggttcgccatccgcggtgccgtcctcgcctactccaagattccacgccgctccacgtcgcccccctccctccgcactttctcacagnccaccggatcattgggcacgcccg

SEQ ID NO: 70338 - protein, 133 aa, Zea mays
  misc_feature: Ceres CLONE 1549839
  misc_feature (21)..(21): Xaa is any aa, unknown, or other
  misc_feature (27)..(27): Xaa is any aa, unknown, or other
  misc_feature (126)..(126): Xaa is any aa, unknown, or other
MMIDVDLNLEVLGGVGVYKLXGRSGRXGEPNASAIHGSKSNPKKLVEVMRARDLHPLCCLPAADGGPPPPPLAHAPPAVAGLLYKWTNIGKGWRPRWFAIRGAVLAYSKIPRRSTSPPSLRTFSQXTGSLGTP

SEQ ID NO: 70339 - DNA, 666 bp, Zea mays
  misc_feature: Ceres CLONE 1549844
  misc_feature: Encodes the peptide sequence at SEQ ID NO. 70340
gcggtggcggccgctctagaactagtggatcccccgggctgcaggaattcgtctcacccctagaaaaagaaattggactcaaaagtttcggcggccttctccatgaacacggtggcttcgctgcctttggcgccgcgcctgctcattaagccctccctcgcctgcttctccagaaaggacgtcggccgctatggcgggatcaaggtgtacgccgtgctcagggaagacggggccgagttcgcccggaacaacaacctggaggccctgttccaggtggacgaccccgggccgcgggtgcccgtcaagaagttcctggacgtgaacgaggctctggaggtggtccgcttcgacatccagtactgcgactggagggcgcgccaggatctcctcaccatcatgcttctccacagcaaggtggtggaggtcctcaaccctctggcgagggagttcaagtccatcgggaccttgaggaaagagctcgccgagctacagcaggagctggaaaaagctcacaatcaggtccatctctcggaagccagagtctcatcggcgctcgacaagctagcgcatatggagaccctggtgagcgcatcatccacagccgagccgcccacttcttcctccctggctgcaactgcaactgcaaccgcaaacagcaccgcccgg

SEQ ID NO: 70340 - protein, 188 aa, Zea mays
  misc_feature: Ceres CLONE 1549844
  misc_feature: SWISSPROT Homolog: EC 1.13.12.14 Chlorophyllide-a oxygenase
MNTVASLPLAPRLLIKPSLACFSRKDVGRYGGIKVYAVLREDGAEFARNNNLEALFQVDDPGPRVPVKKFLDVNEALEVVRFDIQYCDWRARQDLLTIMLLHSKVVEVLNPLAREFKSIGTLRKELAELQQELEKAHNQVHLSEARVSSALDKLAHMETLVSASSTAEPPTSSSLAATATATANSTAR

SEQ ID NO: 70341 - DNA, 678 bp, Zea mays
  misc_feature: Ceres CLONE 1549845
  misc_feature: Translation starting site: 232
  misc_feature (353)..(353): n is a, c, t, g, unknown, or other
  misc_feature (489)..(489): n is a, c, t, g, unknown, or other
  misc_feature (522)..(522): n is a, c, t, g, unknown, or other
  misc_feature (537)..(537): n is a, c, t, g, unknown, or other
  misc_feature (576)..(576): n is a, c, t, g, unknown, or other
ctccccgcggtggcggccgctctagaactagtggatcccccgggctgcaggaattcgtctcacccctagaaaaaacgccgcctcgccttcctcttccacccctcgccgtccgtcgtcctcagcgcttgtacgcttgcctcaaaacccctggcgccgtgctaaaaccctagccctcgaattccttcccctgcccgcgcggagcagacgagcctgagcccgtcctcctcgtccatggcgtcctcaggggccgccgctaacctctgggtactgcttggtctcggcatcgcgggcgttctcctggcggcgcggcgactgaggcgccctgcgcgccccgatcacggcgccttcgtcgncccgcctcgagctcctcccgccgccccagcctccgccgccgcaggcgccccacccgctcaccggactctgcttcgccatcgctgacgcattgcatgtcagtggtttatattacagtttcggcagtcttgaatgggncaagacacacgatgcagaggtgctaacatcttncagtgggttcagctnctgtcgatggtggtgctatttgtgttggaaaactgttantgatgagatggcataccagtatccttggtgagaatggatattttgaacaccccacaatcctgcccgctccagatcgaggtcccggaggatgttcaagtggat

SEQ ID NO: 70342 - DNA, 646 bp, Zea mays
  misc_feature: Ceres CLONE 1549858
  misc_feature: Encodes the peptide sequence at SEQ ID NO. 70343
  misc_feature (229)..(229): n is a, c, t, g, unknown, or other
  misc_feature (245)..(245): n is a, c, t, g, unknown, or other
  misc_feature (304)..(304): n is a, c, t, g, unknown, or other
  misc_feature (305)..(305): n is a, c, t, g, unknown, or other
gcggtggcggccgctctagaactagtggatcccccgggctgcaggaattcgtctcacccctagaaaaactcttctccgctgcttgcctccggctccccaattccacgagatctccaattccaccgcgtcgtctctgcatccggaccccataccccgatcgatccctaaggcccatggttttctccgccgccgcgtcgcctctagtagccaccgctgctgactctgcttncctctgcgtcgccaancctcgctgctgctgtcgcgttagttgctgcccgtgttgaagacgcctagctctttaggnntcgcgatttctcgctgatcgttcgagaatggtaagctattgatttcttcccggccaaacgggtgaacctttcgtcgggctccatcttaagggaaacccaaacccaaccttcaagggaaccgtaaacccgccctttgccctttttaaaaaaccgaagaaacccaaaccggaacccgcttgggccaaaaaggccaaacccaaaaggaaaacaagaagggggggaaaaaaaattttttccccccgggggaaacccctcttttaaaaaaaccccccttgttcccggaaaaaaggggggggggggaaaaaaaacaaatttggttgttcaacaacccggggggtttc

SEQ ID NO: 70343 - protein, 36 aa, Zea mays
  misc_feature: Ceres CLONE 1549858
  misc_feature (19)..(19): Xaa is any aa, unknown, or other
  misc_feature (24)..(24): Xaa is any aa, unknown, or other
MVFSAAASPLVATAADSAXLCVAXPRCCCRVSCCPC

SEQ ID NO: 70344 - DNA, 503 bp, Zea mays
  misc_feature: Ceres CLONE 1549859
  misc_feature (62)..(62): n is a, c, t, g, unknown, or other
  misc_feature (289)..(289): n is a, c, t, g, unknown, or other
gcggtggcggccgctctagaactagtggatcccccgggctgcaggaattcgtctcacccctnagaaaaaaattttctcgcccgggagccgcaattccatcctgctgctcgagttatatactcacccaatagaacaattctatgcctgatgattgtacttcttgaggtagaagatcatactgaagcagaactcgagcggtgttgaatcgaaatggaaggcaggatgacaagtttggaagccaccatgaaagtttcctcatcgatggcaagcagcatatcaaggaatgctngaccctgaccaacagactctacgcccccaattcgggtggaagcagttttattttccagacctgtcatctttgccagcattcctccatctttgggcctccctcctccagtttgtatcttcctaatgacaatggaactaaattggcatcagttgaatcaaaccttcccagaatcaaatggggaccccaggctttgtgagcactaaccttcctgaga

SEQ ID NO: 70345 - DNA, 689 bp, Zea mays
  misc_feature: Ceres CLONE 1549861
  misc_feature: Encodes the peptide sequence at SEQ ID NO. 70346
tccccgcggtggcggccgctctagaactagtggatcccccgggctgcaggaattcgtctcacccctagaaaaaggcaacgccctttaccacatctgaatctcacccacccacccccgcgtcccccacctcatggcgccggcgatggggctgaagcggcctgcggcgggagcgggggcggcagcagcgcagaccgtcacactgtccgcgccggccgtgcgggacgcggtgcgcaccgccgtaagggaggccgaggccacggcgaaggctaccgccccggtcgccagggtcccggcgacggcggcagtgccggcggagatcgctagggatggggtgctgtgcctggaggaggtcgacccccccccccggagtgggggggcgacgcccctggccccccggctaaaggccaagggaagggcgtccgtccgcggcccctccaaggccctcccgcttccagtccccgatgccgcccgtctagaaaatcctgtcccttttaagatcccatcgttgtgccccacaggctttccaaatactgtcacaccctcctaaggtccccaacgtggacttggcagagccttgaaaccatttctttggggggagagaatgggggggcttgcccactagagaccctttcccccccctcgtttggggtccccccccacacacggggttggccaactgcccgcgtggg

SEQ ID NO: 70346 - protein, 138 aa, Zea mays
  misc_feature: Ceres CLONE 1549861
MAPAMGLKRPAAGAGAAAAQTVTLSAPAVRDAVRTAVREAEATAKATAPVARVPATAAVPAEIARDGVLCLEEVDPPPRSGGATPLAPRLKAKGRASVRGPSKALPLPVPDAARLENPVPFKIPSLCPTGFPNTVTPS

SEQ ID NO: 70347 - DNA, 686 bp, Zea mays
  misc_feature: Ceres CLONE 1549863
  misc_feature: Encodes the peptide sequence at SEQ ID NO. 70348
atagctggagctccccgcggtggcggccgctctagaactagtggatcccccgggctgcaggaattcgtctcacccctagaaaaaaatcgctgccaccctcctctccgccgtcgccgccgccgccggggatggggggagcgcaattccccggcgacaacgacgtcgcggaagtagacgcggcccgcgacggagaggtggaccgccgtgacgtgggcaagatgaagcacgggtgcgagcattaccggcggaggtgcaagatcgtggcaccgtgctgcaaccaggtgttcccctgccgccactgccacaacgaggctacggcttccggagatcggcatacaatatgtcgtcaggatgttgaaaaagtagtttgcctactctgtgaaacaaaccagccggtgtcacaagtcccccccacctgtggagtcaatatgggaaagtacttttgtgatatatgcaacttttttgatgatgattcagacaaggggcatgacccttgcatccattgtggattttgcagggttgggggcaaggaaaacttcttccccggggggaaggggggggccggatttcttgttaaagcccctgaaaaccccccgtgtgtggggggaatccaggagggggaaattgggccaatcctggtttaggcccctttttttaccccttaacagggaaaaggaaatttttac

SEQ ID NO: 70348 - protein, 171 aa, Zea mays
  misc_feature: Ceres CLONE 1549863
  misc_feature (35)..(113): Pfam Name: zf-CHY Pfam Description: CHY zinc finger
MGGAQFPGDNDVAEVDAARDGEVDRRDVGKMKHGCEHYRRRCKIVAPCCNQVFPCRHCHNEATASGDRHTICRQDVEKVVCLLCETNQPVSQVPPTCGVNMGKYFCDICNFFDDDSDKGHDPCIHCGFCRVGGKENFFPGGKGGAGFLVKAPENPPCVGGIQEGEIGPILV

SEQ ID NO: 70349 - DNA, 670 bp, Zea mays
  misc_feature: Ceres CLONE 1549864
  misc_feature: Encodes the peptide sequence at SEQ ID NO. 70350
ctccccgcggtggcggccgctctagaactagtggatcccccgggctgcaggaattcgtctcacccctagaaaaaatccgcatagcactgagggcggcggccgcttcctctcctccgcggccgaggtcgctcccccgcccgccgcctcttgcccgcggccgatctcttccctccgctcgcagcgtcgcagcccgtaacgagaccgcgctcggttgagcaccacctggggcccagcgccccagcgtcctcgtgaccacctcggcgcggcatccgccctctgcagccccggtgtctccgcgaccggctccggtgcgtccggaacgcagctccacaggagcatcattatttatagaatacgatctactttatagcggaggacaatgtctgcttctactgctgcaattcgtactgcgaatacaaatggaaaccatgcagtaagttcggattcacattctagccaagatgctaggcagcgaacagctggtattacaaaaagaaaagcattgcccttcgattcttcaaaaaattcctagcaatgatctgagtcatactatccgaaggagaatccgttccttcaaagtcaaattattccttctgaaggaagaaaaaaagtgggtgctttcagcaaccggcggaacgccaaaacaaaacacctacaaatggggggtggg

SEQ ID NO: 70350 - protein, 50 aa, Zea mays
  misc_feature: Ceres CLONE 1549864
MSASTAAIRTANTNGNHAVSSDSHSSQDARQRTAGITKRKALPFDSSKNS

SEQ ID NO: 70351 - DNA, 661 bp, Zea mays
  misc_feature: Ceres CLONE 1549865
  misc_feature: Encodes the peptide sequence at SEQ ID NO. 70352
  misc_feature (496)..(496): n is a, c, t, g, unknown, or other
  misc_feature (548)..(548): n is a, c, t, g, unknown, or other
gcggtggcggccgctctagaactagtggatcccccgggctgcaggaattcgtctcacccctagaaaaaagctgacaaccagacgcgccagggtttcaggcttccacgaatctccccgccgccctcaattcccctcggcgccgccgccctcaattcccctcggagccgccgcctcctcccctcgcttcggtcctcggttagttaaccatccaggttctgtcaagatgtctgatagccatgagactgacaggaacattgagatttggaaaattaagaaactgatcaaggcattggaatcagccagaggcaatggcacaagcatgatctctctaatcatgcctccacgtgatcaggttgctcgagtggctaagatgttaggtgatgaatatggtactgcttcgaacatcaagagtagagttaatcgtcaatctgtgttggctgccatcagctcagctcagcagaggttgatgctctacaacagagtgcctcctaacggnatgggtctgtacactggaactattggtactgaagacggaaaggaaaaaaagntactattgattttgagccattcagcctatgattgtgcactctactttgtgacacaagttcacactgaagtttaaatgagctctggaactgatgacaggttgggtcattgtaag

SEQ ID NO: 70352 - protein, 132 aa, Zea mays
  misc_feature: Ceres CLONE 1549865
  misc_feature (6)..(133): Pfam Name: eRF1_1 Pfam Description: eRF1 domain 1
  misc_feature (109)..(109): Xaa is any aa, unknown, or other
MSDSHETDRNIEIWKIKKLIKALESARGNGTSMISLIMPPRDQVARVAKMLGDEYGTASNIKSRVNRQSVLAAISSAQQRLMLYNRVPPNGMGLYTGTIGTEDGKEKKXLLILSHSAYDCALYFVTQVHTEV

SEQ ID NO: 70353 - DNA, 724 bp, Zea mays
  misc_feature: Ceres CLONE 1549871
  misc_feature: Encodes the peptide sequence at SEQ ID NO. 70354
  misc_feature (488)..(488): n is a, c, t, g, unknown, or other
aaagctggagctcaccgcggtggcggccgctctagaactagtggatcccccgggctgcaggaattcgtctcacccctagaaaaaggaaaacacacgcacaaaactgccgtttccgaatggccacggccgtgctccgccgcccattcctcgccgcgctcctccccgccgccggaggggcgtccgggacctcctcttggttccgtccccggagacgtaggtcctctccttccgtgcgcgcggtgtcttccgactcccccaagcccgtcgcctccacctcctcccccaccggcggtgacagccccgacgaggaaccaccggtcctaccgctcctccaggagcttgcggattgcttgattcttccacccaagctcctcgctcagctcccgagcgaccttcgtctcgaccctcatgacgctgcgtttgatctctccacggggcagttctcgacgagtgtggccaagaagtgggtgatctgctcctgaacctgncaaagcatgggagttagctgatactccacatcaaatagcattgccaaacagctgccgttgatggacccttacttgacccgcaacgccaaacaccggttgccaagcgctggtgtcacctggaaggagtttcatccatgggacggcccaccggggaaactcaaaaaattgctaaaccatggtcaaaatggtaactgcttcgaacccccgggggttaatccaattgtccggtttaaaga

SEQ ID NO: 70354 - protein, 121 aa, Zea mays
  misc_feature: Ceres CLONE 1549871
MATAVLRRPFLAALLPAAGGASGTSSWFRPRRRRSSPSVRAVSSDSPKPVASTSSPTGGDSPDEEPPVLPLLQELADCLILPPKLLAQLPSDLRLDPHDAAFDLSTGQFSTSVAKKWVICS

SEQ ID NO: 70355 - DNA, 721 bp, Zea mays
  misc_feature: Ceres CLONE 1549872
  misc_feature: Encodes the peptide sequence at SEQ ID NO. 70356
  misc_feature (396)..(396): n is a, c, t, g, unknown, or other
  misc_feature (457)..(457): n is a, c, t, g, unknown, or other
aaagctggagctccccgcggtggcggccgctctagaactagtggatcccccgggctgcaggaattcgtctcacccctagaaaagtctgtcttcctccgtgcgtcccggcgcgaaccctagccgagattagattgaggcgagcgccatcaccggaggaagaggaagacacgatgctgcgggttgcgggaagaaggctctcgtcttccctctcctggcgccccgccgtggcggcggccaggggccccctcgccggcgctggcgcccccgatcgggacgacggctcggctcgcggccggagccagacgcggttctccatcgactcccccttctttgtcgctgccaggggtttctcttcgactgaaacacttgtcccaggaaaccgagatgctggcctanctgacctccccagcactgtggctgctgtgaagaatcctaaccctaaggtggtttatgatgnagtacatcatgaaagatatcctcctggagatcccagcaaacgtgcatttgctttacttgtcctgagtggtggggagatcatatatgcatcactgctgcgtctcctcgtattgaatttgtcctgagcatgtcaacaagtaaggacgtgcttgcccctgcttcactcgaggtggacctctccgcattgagccaggacccccgtgactgtgaggtggctgggaaagccatcttcataaaaccccggaggaggacaatttaagttgcc

SEQ ID NO: 70356 - protein, 136 aa, Zea mays
  misc_feature: Ceres CLONE 1549872
  misc_feature: SWISSPROT Homolog: EC 1.10.2.2 Ubiquinol--cytochrome-c reductase
  misc_feature (76)..(76): Xaa is any aa, unknown, or other
  misc_feature (96)..(96): Xaa is any aa, unknown, or other
MLRVAGRRLSSSLSWRPAVAAARGPLAGAGAPDRDDGSARGRSQTRFSIDSPFFVAARGFSSTETLVPGNRDAGLXDLPSTVAAVKNPNPKVVYDXVHHERYPPGDPSKRAFALLVLSGGEIIYASLLRLLVLNLS

SEQ ID NO: 70357 - DNA, 712 bp, Zea mays
  misc_feature: Ceres CLONE 1549873
  misc_feature: Pfam Name: Trypan_PARP Pfam Description: Procyclic acidic repetitive protein (PARP)
  misc_feature (376)..(376): n is a, c, t, g, unknown, or other
aaagctggagctccccgcggtggcggccgctctagaactagtggatcccccgggctgcaggaattcgtctcacccctagaaaaaatccacacacacacaacacagcagagagattactacgatccaacagttctagagcaagagagaggaagacacaccgcagagttagcaggctaataacttgcaggagcagcaggaatggcggcgacgcgtcgcctctcttgccttctcctcgccgtgcttctggcaggagtggccgctgccaccgccttcgacgaagcggctgctgccggcttcgggcttggccacggcgcgcgtttcgcgcgcaagcatggacgagctgccgctgagatgccccagccggagccacacctanaactaagccggagccccatatgcagccactgccccagccagaaccctaaccgaaacctatgccacatcccagagcaaagccctgaccctcaccaaagcccaaccctgaactcaacaatgccaaagcctctaccaaaatcaaagcagagcccatgcctacccgaagccagaacctaagcccgaacctagcccgagcctaagccccaacgaaaatgaagccaagcccaaccctgatcaaatccgagccaagccaaatcaaacctgagcccaggcaacccaaacaaaccggggcttaaccaaactaacccaggcccagccgagccgacccaaaccagcc

SEQ ID NO: 70358 - DNA, 655 bp, Zea mays
  misc_feature: Ceres CLONE 1549874
  misc_feature: Encodes the peptide sequence at SEQ ID NO. 70359
  misc_feature (374)..(374): n is a, c, t, g, unknown, or other
  misc_feature (458)..(458): n is a, c, t, g, unknown, or other
  misc_feature (559)..(559): n is a, c, t, g, unknown, or other
  misc_feature (574)..(574): n is a, c, t, g, unknown, or other
gcggtggcggccgctctagaactagtggatcccccgggctgcaggaattcgtctcacccctagaaaaaagcctgccgctccccacattcccgttccgctcacagcggaaaaggaagccggctagggtttcatcttcctttcccctcctctctttcatcgacgaccgctggccaccccctcgatctcttgacccggaggcgaggacgggggccagcagcggccgccagcgcctgcccgtcttgttatagggagcgttcgccatgtctgaaatggagtctgtcgcggctcttatggactcgacaagctccaagatacaacagcttcaggaggcattcgctgagcttgagagccagagcgctttctgcatgaacttncagtggaagcagcttgaagaccactttcgtggtcttgaaacatccctcaagaaaaagtttgacgagctaaaagagcaggagaanggagtccaggagactgtcgcaaaatcagagcagatgctggagcagcggggagcagctgttgtggccaagaactgacctcttttgaagagttgcaggaaaangagggagctgcatancctatgatctttagcaagtcagggctttcttaacctggtccctccctcaccccatggaacagcactggataaacttgggtg

SEQ ID NO: 70359 - protein, 90 aa, Zea mays
  misc_feature: Ceres CLONE 1549874
  misc_feature (38)..(38): Xaa is any aa, unknown, or other
  misc_feature (66)..(66): Xaa is any aa, unknown, or other
MSEMESVAALMDSTSSKIQQLQEAFAELESQSAFCMNXQWKQLEDHFRGLETSLKKKFDELKEQEXGVQETVAKSEQMLEQRGAAVVAKN

SEQ ID NO: 70360 - DNA, 745 bp, Zea mays
  misc_feature: Ceres CLONE 1549877
  misc_feature: SWISSPROT Homolog: EC 2.7.7.6 DNA-directed RNA polymerase
aagctggagctcaccgcggtggcggccgctctagaactagtggatcccccgggctgcaggaattcgtctcacccctagaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcataccgcccaccgcgccccactgcactcccactccggccccgaacactccgcccccggccccgaacactcctcccccggcttccacaacgccgcccccggggccgaaaacgtcaacttcggccccacaaagccccctccgtcccaacagggttgcaacggcccggtcccacaatccgccacggtttccccgggaaggccggcgcccgttccggcaaccccgcaacgtttccggccattggggccacttccggcaaggccccttcacccggcaaccccgggcggacgggcggggcaaatgggggccccaaggggggccccaaatcccccgcccgtgggaaacccgggtgggctcccccagaagcccataaaaacccaaaacccccccgccccggaaaatacccccgggcccctttttatttgcccgggggaaccccccaaaaacaaaaaaatccggggaaaaacgccccctcccc

SEQ ID NO: 70361 - DNA, 670 bp, Zea mays
  misc_feature: Ceres CLONE 1549879
  misc_feature: Translation starting site: 162
  misc_feature (403)..(403): n is a, c, t, g, unknown, or other
  misc_feature (414)..(414): n is a, c, t, g, unknown, or other
  misc_feature (446)..(446): n is a, c, t, g, unknown, or other
ctccccgcggtggcggccgctctagaactagtggatcccccgggctgcaggaattcgtctcacccctagaaaaaacgctccgctcgttcccccaaatagttcctcggcttcgctcccttcccctccctgctccggctccggttcgcacacagtaagaaaagatggcgctgccatccatgagtcttgcggcaaagggtgtgcttcccttctcagcacgtacctcgagtggtgtcacacaaaggccggtgtcagtgaccgcttccttggagcacaaaaccagcgatgccagaaggaagttcctaaaacttgcgcttgggaaccttggagttggactgcccaccttgttgggcgctaagaaagctctcgctgatgagcaaggcgtctcgtcctcgaggatgtcttnatcgaggtccnttgagtatcttgacaaggatagagtgaagaanggtgatttgtttgagaatgggacaattgctatttgtgaggccattctcctgagcttggtaacgcatgcaaggagtccgtgtgcagctccctggtctaagccaggagcttcttcagaagttgagggagaagaacatcgattttgctgctcacgcaaccagaaagatctgggtccctcctgttcaccttaatggaaattgtgcatccccgctatccctttcggggg

SEQ ID NO: 70362 - DNA, 731 bp, Zea mays
  misc_feature: Ceres CLONE 1549882
  misc_feature: Encodes the peptide sequence at SEQ ID NO. 70363
  misc_feature (469)..(469): n is a, c, t, g, unknown, or other
caaagctggagctcaccgcggtggcggccgctctagaactagtggatcccccgggctgcaggaattcgtctcacccctagaaaaagcccgaccttcatccgcattccacgcgcactccgctgcctcactccgagactccgccgctgcttccaacttccgttgcgcacgagcgaaacatccggagctagcaagggaggaggaggaggaggaggaggcgatggcggggggcggggataaggtggactacgtcttcaaggtggtgctcatcggcgactccgctgtcggcaagtcgcagatccttgcgcgcttcgcccgcaacgagtttagcctcgactcgaaggccaccattggggtcgagttccagactcggactctcgtcatcgaacacaagtccgtcaaggcgcaaaccccgcacaccgccgggcaggagaggtatagagctgtcacaagtgcctactacagaggtgcnttgggagctctgctagtctatgatatcacaaaacgccagagcttcaaccacatacctcgctggctggaagagctccggggccatgctgacaaaaacattgtgatcatgctggttgggaacagagcgacctcaaagacgagcgtgccgtaggcaccgaggaccccaggaagttggccgagaaggaagacctccttcttccttgagacctccgcgctgcaggcgaccaatgtgaaaatgccctccagaccgtccttgacagaga

SEQ ID NO: 70363 - protein, 133 aa, Zea mays
  misc_feature: Ceres CLONE 1549882
  misc_feature (13)..(134): Pfam Name: Ras Pfam Description: Ras family
MAGGGDKVDYVFKVVLIGDSAVGKSQILARFARNEFSLDSKATIGVEFQTRTLVIEHKSVKAQTPHTAGQERYRAVTSAYYRGALGALLVYDITKRQSFNHIPRWLEELRGHADKNIVIMLVGNRATSKTSVP

SEQ ID NO: 70364 - DNA, 650 bp, Zea mays
  misc_feature: Ceres CLONE 1549883
  misc_feature: Encodes the peptide sequence at SEQ ID NO. 70365
  misc_feature (509)..(509): n is a, c, t, g, unknown, or other
  misc_feature (646)..(646): n is a, c, t, g, unknown, or other
ctccccgcggtggcggccgctctagaactagtggatcccccgggctgcaggaattcgtctcacccctagaaaaaaggaaggcaggaagaaccgccgccacgccacacacaaaacagtgactcagtgagaaaggacagcaagccctcccctccctccatctccgccccgtcgccatggtccttctcttcgtggagaagctcctggtcggcctcttggcgtccgtcatggtcgccatcgcggtgtccaagatccgtggccgcaagctccggctgcctcccggccccgtccccgtgcccgtcttcgggaactggctgcaggtcggcgacgacctcaaccaccgcaacctcgccgcgctgtcccgcaagttcggcgacgtcttcctcctccggatggggcagcgcaacctggtggtggtctcgtcgcccgcgctggcgcgagaggtgctccacacgcagggcgtggagttcggctcccgcacccgcaacgtgttcttcgacatcttcacggancaagggcaagacatggtggtcaccgtgtacggcgaccactggcgcaagatgcgccgcatcatgaccgtgcccttcttcaccaacaagtcctgccacagtaccgccccgcctgggaaggccaaggcccccgccgttcntcaa

SEQ ID NO: 70365 - protein, 159 aa, Zea mays
  misc_feature: Ceres CLONE 1549883
  misc_feature: SWISSPROT Homolog: EC 1.14.13.11 Trans-cinnamate 4-monooxygenase
  misc_feature: The sequence is a functional homolog of SEQ ID NO 8 in US patent 7148406
  misc_feature (112)..(112): Xaa is any aa, unknown, or other
  misc_feature (158)..(158): Xaa is any aa, unknown, or other
MVLLFVEKLLVGLLASVMVAIAVSKIRGRKLRLPPGPVPVPVFGNWLQVGDDLNHRNLAALSRKFGDVFLLRMGQRNLVVVSSPALAREVLHTQGVEFGSRTRNVFFDIFTXQGQDMVVTVYGDHWRKMRRIMTVPFFTNKSCHSTAPPGKAKAPAVXQ

SEQ ID NO: 70366 - DNA, 727 bp, Zea mays
  misc_feature: Ceres CLONE 1549888
  misc_feature: Translation starting site: 164
  misc_feature (419)..(419): n is a, c, t, g, unknown, or other
  misc_feature (542)..(542): n is a, c, t, g, unknown, or other
  misc_feature (562)..(562): n is a, c, t, g, unknown, or other
  misc_feature (592)..(592): n is a, c, t, g, unknown, or other
aaagctggagctcaccgcggtggcggccgctctagaactagtggatcccccgggctgcaggaattcgtctcacccctagaaaaaacccaccccagtaccccacccgcaaaaccgaatccaaataatcgccaccgctctccgcaccgaatcgaagaaagcggcaatggcagcggagaagccggccccggtgcgcgtgctgtactgcggcgtctgcggcctcccggccgagtactgcgagttcggccccgacttccagcgctgcaagccctggctgcgggcgcacgcgcccggcgtctaccccgacgacctcgtcgccggtccctcctcgtccggcggtgcgggtggcgacagggacgtcgacaaggtcggggagcgcctccagggcgtcgggatctccgacggctccagcagcgccgcangggatgcttccgcgtctaagcccgaagaagtcaaaacgcctgcctggtggtaagctcaagaaaaaggaaaagcaagaggttgtcatcgagaagattgtccgcaacaagcgcaaatgtgttacntgtggtgaagggacttgaanttgtttggtgtaaagctgagtgatgcttcnaagaactttgggaagaagtttgcaacccggtgcttctgttgttaagggcccgaccgagaaggaacagattgacgtgcaaggggaatatcatacgattattgtggagttcatacagatacatggcctgatgtaccc

SEQ ID NO: 70367 - DNA, 665 bp, Zea mays
  misc_feature: Ceres CLONE 1549889
  misc_feature (50)..(50): n is a, c, t, g, unknown, or other
  misc_feature (59)..(59): n is a, c, t, g, unknown, or other
  misc_feature (68)..(68): n is a, c, t, g, unknown, or other
  misc_feature (235)..(235): n is a, c, t, g, unknown, or other
  misc_feature (313)..(313): n is a, c, t, g, unknown, or other
  misc_feature (381)..(381): n is a, c, t, g, unknown, or other
aagctggactccccgcggtggcggccgctctagaactagtggatcccccngggctgcanggaattcgntctcacccctagaaaaaacagccgccgccatttcttcattctcccatctccatctccatctccatctccatcttcctcgcagcgccggcgatccatcttccgctgcctcccttcctcgcgctcgggctctcagtgacggcatcagcggtttcccctcccgcctctcngcagtcgcatcacgccctcgcctccggtccccacgcacacggccgggtgacctgcattacttgctaatcttttctganggcagatggccgttttcttttgcaaatgtcaacgccgaagcagggctgaaaaaacttgatgagtaccnctcactcgcaactaaatcactgggataccaagcttccaagatgaactggctggccacccttcatttttgccgggcccccccatccagatattcaagggaccaaggggggttaaaaccccttggagcccccccgaaaggtgaaaggaaattacccccaaaaggcccaagggtgtaagggttaaccccccaaaaaagtcccctccacctcaaaattttgagggggtcggaaaaggaaagggcccccactttggtaaaaaaaaaaaaaaaaaaaaaatttttccccc

SEQ ID NO: 70368 - DNA, 691 bp, Zea mays
  misc_feature: Ceres CLONE 1549890
  misc_feature: Encodes the peptide sequence at SEQ ID NO. 70369
aagctggagctcaccgcggtggcggccgctctagaactagtggatcccccgggctgcaggaattcgtctcacccctagaaaaacggaacccacctgctgcgcacctgtaagcctcgagtggagctcttccactgccgccgtggacatggcggcgaatctggaggacgtgccgtcactggatctgatgcacgagctgctccgccgcatgaagtgcagctccaagcccgaccagcgcctaatcctcatcggaccacctggctctggaaagggaactcaatctcctattatcaaagatgaatattgcttgtgccatttagccaccggtgatatgctgagggctgctgtggccgccaacacacctctacgtctcagagctaaacgagctatgcataaggtacagcttgcttccgacgatttgcgagtgggcattatcacgacgctatgaaaaaacctcattgcggaaagggttcattctgatgggcttcctagaactgccctcaaacaccaaaacctggagaaaatttttggaaaaacaagggggcccatgtgtaacacagcccggaactttggaatcgggaaagccgtttggaaaaaaggataattggcccttggatcctttcagcgggggggtaggattttcccacccaaaattttcccccccccaaagccccccaggagtgtgaggtttttc

SEQ ID NO: 70369 - protein, 99 aa, Zea mays
  misc_feature: Ceres CLONE 1549890
  misc_feature (33)..(99): Pfam Name: ADK Pfam Description: Adenylate kinase
  misc_feature: SWISSPROT Homolog: EC 2.7.4.3 Adenylate kinase
MAANLEDVPSLDLMHELLRRMKCSSKPDQRLILIGPPGSGKGTQSPIIKDEYCLCHLATGDMLRAAVAANTPLRLRAKRAMHKVQLASDDLRVGIITTL

SEQ ID NO: 70370 - DNA, 708 bp, Zea mays
  misc_feature: Ceres CLONE 1549891
  misc_feature: Encodes the peptide sequence at SEQ ID NO. 70371
  misc_feature (519)..(519): n is a, c, t, g, unknown, or other
  misc_feature (606)..(606): n is a, c, t, g, unknown, or other
tggagctccccgcggtggcggccgctctagaactagtggatcccccgggctgcaggaattcgtctcacccctagaaaaacaagagcagtgctcgctcctccgaatctccagctcccaccacccaaaccccatcgatatcccaagaaatcctcgcaagaaccaacttttagtgcccaatgcggccaagattgccaacgcctccgaaattccggttcctcgcatccccactagcacttccaaggccgcaatcctggcccggaaggccgcgctttggcgggacgcccttgtccccgttgccgccgccttcgcgtcctgtccgctcccttccctcgcggcggagggcgacgggaaagtgagcctcgagtccatcgtggtggcaatcgacgacttcaacaatcgcaaccctttcttcgtggctggggtcgtgttcgtgtggctagtggtgatcccgctcctgcaggagtacgtcttcaagaagtacaagcccgtgagcgccatcgacgcgttccgcaagcttcncgacgtgccggaggtgcagctgctggacatcaggccggggcaagagcgtgcggttcatggcgccaccgaagctgaacctaacgaccnaagcaccgtgcaggtccagttccacgaaagaggacaaaaagggtttgtcaaggaggggcctacgaaggttcccaaacccgggggaaacctttgtcttggttc

SEQ ID NO: 70371 - protein, 235 aa, Zea mays
  misc_feature: Ceres CLONE 1549891
  misc_feature (173)..(173): Xaa is any aa, unknown, or other
  misc_feature (202)..(202): Xaa is any aa, unknown, or other
GAPRGGGRSRTSGSPGLQEFVSPLEKQEQCSLLRISSSHHPNPIDIPRNPRKNQLLVPNAAKIANASEIPVPRIPTSTSKAAILARKAALWRDALVPVAAAFASCPLPSLAAEGDGKVSLESIVVAIDDFNNRNPFFVAGVVFVWLVVIPLLQEYVFKKYKPVSAIDAFRKLXDVPEVQLLDIRPGQERAVHGATEAEPNDXSTVQVQFHERGQKGFVKEGPTKVPKPGGNLCLG

SEQ ID NO: 70372 - DNA, 728 bp, Zea mays
  misc_feature: Ceres CLONE 1549894
  misc_feature: Encodes the peptide sequence at SEQ ID NO. 70373
aaagctggagctccccgtggtggcggctgctctacactaatggatcccccgggctgcaggatttttcctcacccctagaaaaaccagatcctgcggcgaattccttccaactccaggattgagagcacacgcagatggcgaggcacccccgcgcgccgctgctccggcgtctgctcctcctggcggccctcgcggcctcctgctcctactacctcctcttcctgcaggcgcaggcctccgtcccgccgcggtacgacgggttcgcctacggcggcggcgccgcgacggcctggaaggacgccgtccttgtcgaggcctttctcgacccgctctgccccgacagccgcgacgcctggcagccgctgaagctcgccgtcgagcgatacgcgccgcgggtctcactcatcgtcccaccgttcccactaccgtaagcacgggcgcttactgtgtctatatatcgagagaaatttttccatagcgttgaaagttttggtgggttttgatcagtggaaaattctccatagcccattaattggctaaataactgacccgtttcaccaataaaatggtgaatcaaaaaattcctccaacccaatttgggaaaacaaattacccttttcaaaaagggaaactccgggaaaaaccccccggttaagcggggattccccaaatccgggaaaggggcccctgggggccccccccccttagggggtttgagagggaaaaaa

SEQ ID NO: 70373 - protein, 98 aa, Zea mays
  misc_feature: Ceres CLONE 1549894
MARHPRAPLLRRLLLLAALAASCSYYLLFLQAQASVPPRYDGFAYGGGAATAWKDAVLVEAFLDPLCPDSRDAWQPLKLAVERYAPRVSLIVPPFPLP

SEQ ID NO: 70374 - DNA, 537 bp, Zea mays
  misc_feature: Ceres CLONE 1549896
  misc_feature: Encodes the peptide sequence at SEQ ID NO. 70375
  misc_feature (239)..(239): n is a, c, t, g, unknown, or other
  misc_feature (352)..(352): n is a, c, t, g, unknown, or other
tggagctccccgcggtggcggccgctctagaactagtggatcccccgggctgcaggaattcgtctcacccctagaaaataatgtacacgtggaactacggaagtgtactgaagtaccagagcgagatgcgcggcaagatatccctggacttcattcttgatctgggagccacacttggcaccgtaagagttccaggcattggactcgtgtacaacgagctggtccagggaatcccatcngatctttggccagctattagtcacacttccagcgatgcactctacaattgtctttgtttgataaagtatgttcctgtccctatgtccctctgaagaagggtctgtccgaaggntgggcagaagactacacatgttcgcagtgtgcacgctatgtacaggacgttagaaagagacatgcctctttgagcacttctggttgaaacctggaaaatttctcaaggagggagccccaagaaaattgcctggaagcaaacacaatggaggccaaactggtttacaatttcggtgtatccccaag

SEQ ID NO: 70375 - protein, 83 aa, Zea mays
  misc_feature: Ceres CLONE 1549896
MYTWNYGSVLKYQSEMRGKISLDFILDLGATLGTVRVPGIGLVYNELVQGIPSDLWPAISHTSSDALYNCLCLIKYVPVPMSL

SEQ ID NO: 70376 - DNA, 657 bp, Zea mays
  misc_feature: Ceres CLONE 1549899
  misc_feature: Encodes the peptide sequence at SEQ ID NO. 70377
  misc_feature (430)..(430): n is a, c, t, g, unknown, or other
gcggtggcggccgctctagaactagtggatcccccgggctgcaggaattcgtctcacccctagaaaaaaggagtgtatcactgagggaagaagtgaagcggaatatagacgccgtcgacaatgggagagagccgcggcagcatcgcctttttcgccacctaccggccaccagtgccgctagacatcttctccgtgcccatcccgccgtcttcgatccgcgacgaggtacacctcacggacggcgtctcctacaactacaactgccgccccatccccaaggacgcgctcaagtccctgctcaagcgccccaagctcgctgccgacggcggcgccaccgacgccgacgtcgacagcggccgcgtctccggccttctcttcgtctccgagcgggacgatggccttgagacgctccgcgtggccctgcatttcnaagactccggcgagcaggccctgcaggtgttctccctggctgacgtcttcggcgcccgcgacttcagcggcgtgcgcctcgaggatagcggctgcgtcggcggcggctacaaggtggggctctcgcaccgtgggacactcgctcatctacgtttccaccaagggagccgggtgcaagagcgaccccagcccgggggaaccgttcctgtacaaagaccaaccttaggg

SEQ ID NO: 70377 - protein, 179 aa, Zea mays
  misc_feature: Ceres CLONE 1549899
  misc_feature (104)..(104): Xaa is any aa, unknown, or other
MGESRGSIAFFATYRPPVPLDIFSVPIPPSSIRDEVHLTDGVSYNYNCRPIPKDALKSLLKRPKLAADGGATDADVDSGRVSGLLFVSERDDGLETLRVALHFXDSGEQALQVFSLADVFGARDFSGVRLEDSGCVGGGYKVGLSHRGTLAHLRFHQGSRVQERPQPGGTVPVQRPTLG

SEQ ID NO: 70378 - DNA, 713 bp, Zea mays
  misc_feature: Ceres CLONE 1549900
  misc_feature: Encodes the peptide sequence at SEQ ID NO. 70379
  misc_feature (429)..(429): n is a, c, t, g, unknown, or other
  misc_feature (475)..(475): n is a, c, t, g, unknown, or other
  misc_feature (510)..(510): n is a, c, t, g, unknown, or other
aaagctggagctccccgcggtggcggccgctctagaactagtggatcccccgggctgcaggaattcgtctcacccctagaaaaaaacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgcccgtctctctgcctccctccctttcgcctccccactcgtttcaggcgggtacgggacctgggcggcgacttcagtgtcgtccgcgggaaggttgagacggcgggggctggaggtggtgtgcgaggccacgactgggcggcggccggactcggttaagaagagggagcgccagaacgacnagcaccgcatccgaaatcacgcgcgcaaggccgagatgcgcactangatgaaaaaggtctaagagcttctgaaaaagctangaagaaaactgacgcgcagcctgaaaaaatattgagatagaagagctgatccctgaagcataacaagccatcgaacaaaacggggaaggtgggccccatgcataggaccacggcgaaaccatccgaaattcctacttggcaggaaagaaaaaggccacccaaaaacccccggggttgggaatgtcccaaaccctgtaacttgg

SEQ ID NO: 70379 - protein, 117 aa, Zea mays
  misc_feature: Ceres CLONE 1549900
  misc_feature (98)..(98): Xaa is any aa, unknown, or other
  misc_feature (113)..(113): Xaa is any aa, unknown, or other
MVTATTSPLFSLSSLRASLPSPTRFHTSLSLRALSPRARLSASLPFASPLVSGGYGTWAATSVSSAGRLRRRGLEVVCEATTGRRPDSVKKRERQNDXHRIRNHARKAEMRTXMKKV

SEQ ID NO: 70380 - DNA, 586 bp, Zea mays
  misc_feature: Ceres CLONE 1549902
  misc_feature: Encodes the peptide sequence at SEQ ID NO. 70381
caaagctggagctccccgcggtggcggccgctctagaactagtggatcccccgggctgcaggaattcgtctcacccctagaaaaaaacatctcctttgtatcggcctcggcaatcctgaccggatcaacaaagacgtagctaccccctcccgcgtccgtcgaattcgcctccgccgcctgctcgatccggtgggaattcgccgctgccgggttgttttcgctggggtgattaaggctcgggattcgagatctacgcgagtcgcgggcaagcagccatcgagcgaggtggttcgatggggctacgagccgccaattcctggcaaggtgcccccgccccctgtttctcccgaaaggcccctggcccccccccatgggaaaaaaaaacaaagctcccaaaccaacccgggtaaaaaacgaaaccttatacaaaagggcccggggcggggacctcacccaaattaggggttttgtccccacggaggggattaattttccccccccccccaaaggggccttaaaagagaccccccccccttttttggggtacccccggggagacccccccccggggagggggggagcaccc

SEQ ID NO: 70381 - protein, 72 aa, Zea mays
  misc_feature: Ceres CLONE 1549902
MGKKNKAPKPTRVKNETLYKRARGGDLTQIRGFVPTEGINFPPPPKGALKETPPPFLGYPRGDPPPGRGGAP

SEQ ID NO: 70382 - DNA, 676 bp, Zea mays
  misc_feature: Ceres CLONE 1549906
  misc_feature: Encodes the peptide sequence at SEQ ID NO. 70383
  misc_feature (214)..(214): n is a, c, t, g, unknown, or other
  misc_feature (273)..(273): n is a, c, t, g, unknown, or other
  misc_feature (311)..(311): n is a, c, t, g, unknown, or other
  misc_feature (407)..(407): n is a, c, t, g, unknown, or other
  misc_feature (408)..(408): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (444)..(444): n is a, c, t, g, unknown, or other
  misc_feature (454)..(454): n is a, c, t, g, unknown, or other
  misc_feature (460)..(460): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (480)..(480): n is a, c, t, g, unknown, or other
  misc_feature (481)..(481): n is a, c, t, g, unknown, or other
  misc_feature (501)..(501): n is a, c, t, g, unknown, or other
  misc_feature (506)..(506): n is a, c, t, g, unknown, or other
  misc_feature (521)..(521): n is a, c, t, g, unknown, or other
  misc_feature (540)..(540): n is a, c, t, g, unknown, or other
  misc_feature (547)..(547): n is a, c, t, g, unknown, or other
  misc_feature (558)..(558): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (583)..(583): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (615)..(615): n is a, c, t, g, unknown, or other
  misc_feature (616)..(616): n is a, c, t, g, unknown, or other
  misc_feature (628)..(628): n is a, c, t, g, unknown, or other
  misc_feature (648)..(648): n is a, c, t, g, unknown, or other
  misc_feature (649)..(649): n is a, c, t, g, unknown, or other
  misc_feature (664)..(664): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
tacccgcggtggcggccgctctagaactagtggatcccccgggctgcaggaattcgtctcacccctagaaaaagtcttgccttctcttctctacctgccgcacccgcacagccacagccaaccacacaccccacatcacaacagctccctctgcatctccgcctcgtcgccgtcgtctgcctgcacaaccttcttcttcatctctctctcttcntgtccgcttggccaaccccttccctagccaccggaaggggaaagagccaaaggcccccnccccaggaaatctccggtcccgttccccggggggggcnggcccttttcttttaaaaccccccaaaatttttttgggggtgtttcaaaagaggaaaaaaaaaaaaaaccccttttgggggagtaaaaaaaagtannaaaggcgnnnnnnnnnnnnnnnnntgnnnntgcggncggggcgccntggtgntcccttcgtgccgnnnnntnncagagggggggacagcgtancactngcgacgacacgcccntctcgcgggccgcgctacncgaaacncgcacgaccgnngnnnnnagagaaaaaggnnnccgncgccccnnnnntctatcttgctgcgggcgtgnngtgggaggggtntgaaaaagagagacaaaganntaaggacacaaaaangnnnnnacgccc

SEQ ID NO: 70383 - protein, 79 aa, Zea mays
  misc_feature: Ceres CLONE 1549906
TRGGGRSRTSGSPGLQEFVSPLEKVLPSLLYLPHPHSHSQPHTPHHNSSLCISASSPSSACTTFFFISLSSCPLGQPLP

SEQ ID NO: 70384 - DNA, 675 bp, Zea mays
  misc_feature: Ceres CLONE 1549907
  misc_feature (505)..(505): n is a, c, t, g, unknown, or other
  misc_feature (523)..(523): n is a, c, t, g, unknown, or other
tggagctccccgcggtggcggccgctctagaactagtggatcccccgggctgcaggaattcgtctcacccctagaaaaagaactagattttccaggcgaaaacacatgaaatcaataggtgctgtgtggtcttctcttcttcatcacaaggggcaagcagccgggtgggaagtcctcttttagtgatccggtccacatttcaagaacggttctttactgcaagccaaatggagagcttgcagcgaagaggagcccaggacttccaaattcgtttccatggagcaaagcggatggaactaaggaaaaatgtattgtaggccgactttgatagagtaactttcgttcctagtaagcctccaaacaagctgatcagcatcattctgcttcagcgagaaaccttcatcaagtctcataagcggagatattatgtaagaacctggacagagagctcctcttatgtcagctacccaacgatgggggtacatcactttgacgatccctctangaaatcccctagtgatcntttttttcaggttattgccaaatcttagctgtgttcttgtgactgtgaaaatatatctcccatgctgatacttgattcccctatctttgcttcattactacacacagtaattttgatcttgcattaggttactatggaacctcatttgaaac

SEQ ID NO: 70385 - DNA, 694 bp, Zea mays
  misc_feature: Ceres CLONE 1549909
  misc_feature: Encodes the peptide sequence at SEQ ID NO. 70386
  misc_feature (679)..(679): n is a, c, t, g, unknown, or other
gcggtggcggccgctctagaactagtggatcccccgggctgcaggaattcgtctcacccctagaaaaagtgctgccgccagatctaaccaaaccccgcgccctcctcaccgtccggcgagctacggactcagcagatcaccgtcgctcgagttgtacctgaaggcgcgcccgtggaaccggccgcgagataagggcggcgggaaggcgggcgacgatgccggtggcagcgtcggccatctacttcctcaaccttcgcggggacgtcctcatcaaccgcctctaccgtgatgatgttgggggaaatatggttgatgcgttcagaatgcctatcatggcaacaaaagaacttggcacatgccctgttcgtcaaataggaggctgctccttcctccccccgaggatcagtaatgtttcctttgtgatcctagttagcagcaaatgcaaatggtgcatttggttttcaaattggttgtcgaggcgggggcctctcttcaaagtcctaacttccgggggagccttttgatgaagaacgctatcgggaaacaactttgggttctgaaattatgaacctttcgtgagtgagaaccaggggatttttgggtgaatcccgccagaaccctgggcacccttgaagatttcccaaaactggttataataacccgcaggaatggggtggtncgggtgcaccccact

SEQ ID NO: 70386 - protein, 102 aa, Zea mays
  misc_feature: Ceres CLONE 1549909
MPVAASAIYFLNLRGDVLINRLYRDDVGGNMVDAFRMPIMATKELGTCPVRQIGGCSFLPPRISNVSFVILVSSKCKWCIWFSNWLSRRGPLFKVLTSGGAF

SEQ ID NO: 70387 - DNA, 642 bp, Zea mays
  misc_feature: Ceres CLONE 1549911
  misc_feature: Encodes the peptide sequence at SEQ ID NO. 70388
aagctggagctccccgcggtggcggccgctctagaactagtggatcccccgggctgcaggaattcgtctcacccctagaaaaaattaccgtccacgattccatatggcttcctgcaagatggctctcctccttggcttgctgctgctagtaatatcttcgcccgcaatcgctgaagacaactccggtatctactaccagatggttcttatgtggccaggagcatactgcgagcagaccagcgctgggtgctgcaaaccgaccacaggcgtctcgccggcgcgcgacttctacataacgggcttcacagtccttaacgcgactaccgacgctgcagtgacgggatgcatcaacaaagttctttaccaccctaacctgatgagcggtatccaaggactagatcattactggagcaacatcaggtgcctcagcaacaacgggcagagcagctggaagaacgcctgtaagaaggccggcgcctgctccggcctcagcgagaaagactacttcgagactgccctctccttcatagactgatcaacacactcgttcgactcaaagtccaacgtatcgaggcggacttcgggctctacggcctcaaggatatcaccagggtctttaagagaggatcaacgctacgccgg

SEQ ID NO: 70388 - protein, 143 aa, Zea mays
  misc_feature: Ceres CLONE 1549911
  misc_feature: SWISSPROT Homolog: EC 3.1.27.1 Ribonuclease T(2)
MASCKMALLLGLLLLVISSPAIAEDNSGIYYQMVLMWPGAYCEQTSAGCCKPTTGVSPARDFYITGFTVLNATTDAAVTGCINKVLYHPNLMSGIQGLDHYWSNIRCLSNNGQSSWKNACKKAGACSGLSEKDYFETALSFID

SEQ ID NO: 70389 - DNA, 666 bp, Zea mays
  misc_feature: Ceres CLONE 1549912
  misc_feature: Translation starting site: 248
  misc_feature (317)..(317): n is a, c, t, g, unknown, or other
  misc_feature (441)..(441): n is a, c, t, g, unknown, or other
ctggagctccccgcggtggcggccgctctagaactagtggatcccccgggctgcaggaattcgtctcacccctagaaaaaatcacacaccaccgccgctcaccaacaaccgagcaggagcagcctaccccatccacccaccccatcctctgcgctgcacggctgctgctggtgctggtccggccggtccggtccggtctcctctgttccagcgagctccctccgatccatcgggtaggacactccccatggcgtcgcacaacggcaccaagcacctggcgccgatggaggtgtcggtggaggccgggaacggcggcngcgccgagtggctggacgacgacgggcggccgcggcgcacgggcacgttctggacgggcagcgcgcacatcatcacggccgtcatcggctcgggagtcctgtccctggcctgggccatcgcgcnactgggcctgggtggccgggcccccccgcatgctgctcttcgccttcgtcacctactacaccgccacgtgcttcgccaagtgctaccgcacgggggaaccggaaacgggaaagcgcaactacccgtaaatgggacgccgggggcctccaacctcgggggggccaaaggtgcgccttcttggggcggccttccattaccccaaacctttgtggggtgtcccctttc

SEQ ID NO: 70390 - DNA, 663 bp, Zea mays
  misc_feature: Ceres CLONE 1549914
  misc_feature: Encodes the peptide sequence at SEQ ID NO. 70391
  misc_feature (477)..(477): n is a, c, t, g, unknown, or other
  misc_feature (491)..(491): n is a, c, t, g, unknown, or other
ctccccgcggtggcggccgctctagaactagtggatcccccgggctgcaggaattcgtctcacccctagaaaaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggccccctgcgacgccatcctcgtggcgagctccatcctgcacatgctcaccctcgcnaactgcccgaagangtgcagatcgcgcaccgccgccgcaacagcacttcaagaaaaggtgcttcccccgacgaaaggctccccccccaccgagtccgaacttcgaggagaccctcagccgcttcgtgttcgaaggtcgccaggtcccccaagggaggggttcaagggccctcaagacccggaacgc

SEQ ID NO: 70391 - protein, 171 aa, Zea mays
  misc_feature: Ceres CLONE 1549914
  misc_feature: SWISSPROT Homolog: EC 4.1.1.31 Phosphoenolpyruvate carboxylase
  misc_feature (114)..(114): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLAPCDAILVASSILHMLTLANCPKXCRSRTAAATALQEKVLPPTKGSPPTESELRGDPQPLRVRRSPGPPREGFKGPQDPER

SEQ ID NO: 70392 - DNA, 700 bp, Zea mays
  misc_feature: Ceres CLONE 1549915
  misc_feature: Encodes the peptide sequence at SEQ ID NO. 70393
  misc_feature (395)..(395): n is a, c, t, g, unknown, or other
  misc_feature (397)..(397): n is a, c, t, g, unknown, or other
  misc_feature (409)..(409): n is a, c, t, g, unknown, or other
atatctggagctccccgcggtggcggccgctctagaactagtggatcccccgggctgcaggaattcgtctcacccctagaaaaaaccaatagtggcaattattgttcggaggccatcgccgctggtgggcggtggcttccccttcccctgtattagcagcgaggaggcagcagctgaagctctcgtctctgcctctccggacctccggtgaactccaacagagaccacctcctccatccgtcggtcatccatctgtgattccttttgcgtgtgcaagttgttaaatcggcacacggcctccgcttttggagtggaaaggggcatatactgtttactggtgcgcccggggccgccgcttttctctctggcccctccccgggggggggggtggagcncncaaagctgggcngccccattttaaaaaaccaaactgcactccccctttaccggccccagggcacccccaccaagccccaccgccacgccacacgatctattaacgcgcaaggcaggccaaggaatcaaacccggccgggaccttgcctttctcccgttgggggttcctggctttgcccgcgggcccaagaaaaagaaattattggaatcggaattttgtgccccgggtttctttgggaaccaagtaggccccccaaaattgggtccacaggttgggggcaaaaaaattggcgtcttaacaccg

SEQ ID NO: 70393 - protein, 51 aa, Zea mays
  misc_feature: Ceres CLONE 1549915
ISGAPRGGGRSRTSGSPGLQEFVSPLEKTNSGNYCSEAIAAGGRWLPLPLY

SEQ ID NO: 70394 - DNA, 664 bp, Zea mays
  misc_feature: Ceres CLONE 1549917
ctggagctccccgcggtggcggccgctctagaactagtggatcccccgggctgcaggaattcgtctcacccctagaaaaaattgcattgtgcattgcattgcataaacctctcgtgggaagtgcaaacaccaaatccgcattctatctatctatcagccattcatgcctgcgggctgcagctctctccactgcacactagagcgagctgccacagacatgacactatgcctcccatacccaagagaggcgagcatctcctggtcctcctaattgtcgcatgcactgccaccgccgccaccgccgccggcaccgtccccttctacccgtccgcggagtccgccgccgccgcgcactgcgacggcactctgtacccagagctctgcctgtcgacactcacggacatcccggacctacactagatctcgctcccggacgtcatctgcgcggccgtgaaccgcaccgaggacgtggtggtcgccacatacagcagctgctcgtactacctgcaggactagcccttgtctgcacgggacagcctgtccatccacgactgtctggatctgccgtcctccacgatgggacgagctccgcgccaacaccgtcgacttggcttccccccccctgatgggggtcagcttctgcggaccctgtccccaggccccc

SEQ ID NO: 70395 - DNA, 668 bp, Zea mays
  misc_feature: Ceres CLONE 1549918
  misc_feature: Encodes the peptide sequence at SEQ ID NO. 70396
  misc_feature (128)..(128): n is a, c, t, g, unknown, or other
  misc_feature (138)..(138): n is a, c, t, g, unknown, or other
  misc_feature (139)..(139): n is a, c, t, g, unknown, or other
  misc_feature (248)..(248): n is a, c, t, g, unknown, or other
  misc_feature (259)..(259): n is a, c, t, g, unknown, or other
aaagctggagctccccgcggtggcggccgctctagaactagtggatcccccgggctgcaggaattcgtctcacccctagaaaaaacccactccagaaaacctcacaaaaaccctcgctccccacaacnccgccgccgnncccacgccgcccgcctgtaccagcggcgtcaagatgagtcggcaccctgaagtgaagtgggctcagaggatcgacaaggtttacatcactgtacagttacctgatgccnaggacgctaangtcaatttggaaccagatggtgtcttcacattctctggcagtgttggtacaaacttatatgaattttgaaactagatctggaatgaccaaagtaaaacgtttgaaggctaggcaaaaataaaatgggggggtggtccggtccattatttctgtattggaaaaaaagcttagggccaaatggtggaaagaaacttggttcaaaaagatcaaaggggccccccccttttgtgaaaatttatttgggaacaatggggttgcacaaaaatgaaaaaggggcccaaatgccacctggaggggggagggactttcccaaatttttggcgattggggggggattggggggccaagggggaaaaaccccgccctttggggcgcctttggccccccggggaaaaacgcggcttggggg

SEQ ID NO: 70396 - protein, 51 aa, Zea mays
  misc_feature: Ceres CLONE 1549918
  misc_feature (26)..(26): Xaa is any aa, unknown, or other
  misc_feature (29)..(29): Xaa is any aa, unknown, or other
MSRHPEVKWAQRIDKVYITVQLPDAXDAXVNLEPDGVFTFSGSVGTNLYEF

SEQ ID NO: 70397 - DNA, 667 bp, Zea mays
  misc_feature: Ceres CLONE 1549920
  misc_feature: Encodes the peptide sequence at SEQ ID NO. 70398
  misc_feature (547)..(547): n is a, c, t, g, unknown, or other
  misc_feature (600)..(600): n is a, c, t, g, unknown, or other
  misc_feature (663)..(663): n is a, c, t, g, unknown, or other
ccgcggtggcggccgctctagaactagtggatcccccgggctgcaggaattcgtctcacccctagaaaaagacatacacacaccagctgtgcttacgctacgcggtcgccaaccgctccccaccgccagccggatctcctgagaggcgacgccgcgactgcgcgacggcaaccctgctcctccgccggtgccctcccgcacgatgagccgcagcgggcctcgccgcggcatcttcgatggcctccccatcccggccgacaaatcctacctcaaggaaagcctgtcgcggatcgacgagagctgggctgccgcgcggttcgactcgctgccgcacgtcgtgcacatcctcacctccaaggaccgcgagggcgagatccagttcctcaaagagcagagcgacctcatcgaggacgtcgtggacgaggtcgtgcacgcctaccaccacggcttcaacaaggccatccagaactactcccagatcctgcggctgttcagcgagtctgcagagagcattaccggactcaagggggagatggaggaggcgaanaagctgcttggcaggaagaataagcacctcggccagttgtggtaccgctcccntcacactgcgcatgtgctatccctttttgatcaggtcgaggatgttggccaagtccctgctcngatt

SEQ ID NO: 70398 - protein, 155 aa, Zea mays
  misc_feature: Ceres CLONE 1549920
  misc_feature (2)..(155): Pfam Name: Sec8_exocyst Pfam Description: Sec8 exocyst complex component specific domain
  misc_feature (115)..(115): Xaa is any aa, unknown, or other
  misc_feature (133)..(133): Xaa is any aa, unknown, or other
  misc_feature (154)..(154): Xaa is any aa, unknown, or other
MSRSGPRRGIFDGLPIPADKSYLKESLSRIDESWAAARFDSLPHVVHILTSKDREGEIQFLKEQSDLIEDVVDEVVHAYHHGFNKAIQNYSQILRLFSESAESITGLKGEMEEAXKLLGRKNKHLGQLWYRSXHTAHVLSLFDQVEDVGQVPAXI

SEQ ID NO: 70399 - DNA, 682 bp, Zea mays
  misc_feature: Ceres CLONE 1549923
  misc_feature: Encodes the peptide sequence at SEQ ID NO. 70400
  misc_feature (399)..(399): n is a, c, t, g, unknown, or other
  misc_feature (402)..(402): n is a, c, t, g, unknown, or other
ggagctccccgcggtggcggccgctctagaactagtggatcccccgggctgcaggaattcgtctcacccctagaaaaaaggttgacctgctccaagcctccgttccgactccaaggagggggagagagagagagagaagtcggcacaagcaagccgtcgccacacacacggatcaaaaatcgaaacgagagctagcttttaattgacaccagaggcagcagttggagcggatcgagctagcagctagcagcaggccgcgcgcggagttgcgggagggagatggacgtgaagcggtcgcggagccctcgggctccgcccgacgacgacaggaagcgtgccggcggcggcggcgggtggcgtggctccggcggcgtccgcccggagatggtgctcgtcggnttnctcctcacgctacccctcctcttcctcgtcttcggcggccgctggggggagcagctccttccctcgtcgtcgtcggcggtcgtcgctacctcctctccgcccgtcgtccccaaagctaccccccgccgggtggacggggggggggggaaccgggggcggacccctcttagggccaaaaacccgggtgggctgaaaaaaggttttggcttgaaggggaaatttagggtccccgagaaaacttttaaggggagattgtgttgccccgggatttttacaaaac

SEQ ID NO: 70400 - protein, 134 aa, Zea mays
  misc_feature: Ceres CLONE 1549923
  misc_feature (41)..(41): Xaa is any aa, unknown, or other
MDVKRSRSPRAPPDDDRKRAGGGGGWRGSGGVRPEMVLVGXLLTLPLLFLVFGGRWGEQLLPSSSSAVVATSSPPVVPKATPRRVDGGGGNRGRTPLRAKNPGGLKKGFGLKGKFRVPEKTFKGRLCCPGIFTK

SEQ ID NO: 70401 - DNA, 618 bp, Zea mays
  misc_feature: Ceres CLONE 1549925
  misc_feature: Encodes the peptide sequence at SEQ ID NO. 70402
  misc_feature (286)..(286): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (392)..(392): n is a, c, t, g, unknown, or other
  misc_feature (505)..(505): n is a, c, t, g, unknown, or other
  misc_feature (506)..(506): n is a, c, t, g, unknown, or other
  misc_feature (581)..(581): n is a, c, t, g, unknown, or other
  misc_feature (582)..(582): n is a, c, t, g, unknown, or other
taaacctggagctccccgcggtggcggccgctctagaactagtggatcccccgggctgcaggaattcgtctcacccctagaaaaactcgcgattccaatccacgcacgccatctccgactccgcgtccgcctcgcgcaggacatatattcagtgatggaacacaaggaggccggctgccagcagccggaggggcccaatcctatgcatcaatactgtggttctttggagcgctgccacctgaacatgtgctccaagtgccacaagagatgaaatgaagcaggaccnggccccgttgcctgcctcctcctccatagcattgccatgggcgggaaaaagggaaaggaccctcaatttctccccccccagggggggggggggcccaannncaagnaaaaaatttcccccgggaccctaggtgtttcctaaaaccccggggggggggggtttatccaaaagccaaaaaagcccccaccggggccaaccctggaaaaaggttgtggtgtnncacgttttaccgcgcccgggggaaacccttttgggtttttcccctctctccccaaaaaaaaggggggcggttttnntaaaaaaaaagcggcgggggggacccccctccccaa

SEQ ID NO: 70402 - protein, 89 aa, Zea mays
  misc_feature: Ceres CLONE 1549925
KPGAPRGGGRSRTSGSPGLQEFVSPLEKLAIPIHARHLRLRVRLAQDIYSVMEHKEAGCQQPEGPNPMHQYCGSLERCHLNMCSKCHKR

SEQ ID NO: 70403 - DNA, 663 bp, Zea mays
  misc_feature: Ceres CLONE 1549929
  misc_feature: Encodes the peptide sequence at SEQ ID NO. 70404
  misc_feature (378)..(378): n is a, c, t, g, unknown, or other
  misc_feature (429)..(429): n is a, c, t, g, unknown, or other
ggagctccccgcggtggcggccgctctagaactagtggatcccccgggctgcaggaattcgtctcacccctagaaaaaatccgagtggctctccgtgtgctgtggcggcggcggcgcccggctctgctcggacggactccaccgaaggctcggctcccctcggactccacctgcgacggccggccctctgcctgcaccgacggtgcccggctccctcggcatccaccagcggtgcccgactccaagaaatgtacaagtcacggctgcaggagctgtgccagaagcggcgatgggcgccgccgttgtacgagcctacccgagagggtcctgcccacgcgcccctcttccgcgccactgtcgtcgtgaatggcgagaggntcagttcccgggatgaaggggagaatcactcaaggaggcgtacaacctcgncgcgaatgccgccttcgacaactcatcgcgctcccggccgcggccttgcccctgccccggctgctccagcgccgccctcatccaagacccagctttctttacagagtcaagtaccaatttatgctcagaagcgaaggaaactcccggccttcaaatcggcccaattctgggaagttccccttcctggccccctctttttaagtcaaaagtaacccttaaatgggccaacatttt

SEQ ID NO: 70404 - protein, 130 aa, Zea mays
  misc_feature: Ceres CLONE 1549929
  misc_feature (2)..(62): Pfam Name: dsrm Pfam Description: Double-stranded RNA binding motif
  misc_feature: SWISSPROT Homolog: EC 3.1.26.3 Ribonuclease III
  misc_feature (44)..(44): Xaa is any aa, unknown, or other
  misc_feature (61)..(61): Xaa is any aa, unknown, or other
MYKSRLQELCQKRRWAPPLYEPTREGPAHAPLFRATVVVNGERXSSRDEGENHSRRRTTSXRMPPSTTHRAPGRGLAPAPAAPAPPSSKTQLSLQSQVPIYAQKRRKLPAFKSAQFWEVPLPGPLFLSQK

SEQ ID NO: 70405 - DNA, 688 bp, Zea mays
  misc_feature: Ceres CLONE 1549931
  misc_feature: Encodes the peptide sequence at SEQ ID NO. 70406
  misc_feature (305)..(305): n is a, c, t, g, unknown, or other
  misc_feature (307)..(307): n is a, c, t, g, unknown, or other
gcggtggcggccgctctagaactagtggatcccccgggctgcaggaattcgtctcacccctagaaaaagacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcccgggtgctcgggaggccgatccgggtggcgccacccgccgcggcccggccgggcggtgcgtccncnggtagcatacgcgccgtctccgcgcctgcgaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaattttcatggaagctacccgcaaactgaccgagatgtccgtggggcagaagaattactccgtttatgctccgggaaaaaaacccctttgggggaaagttccaaaccaacttttatttagctatgggataccactagctgaaggagtttgggcatcggaaacactcccgcctggacaaaccaggcaagacctttccaggtggccccgggggttccc

SEQ ID NO: 70406 - protein, 139 aa, Zea mays
  misc_feature: Ceres CLONE 1549931
  misc_feature: SWISSPROT Homolog: EC 1.8.7.1 Sulfite reductase (ferredoxin)
  misc_feature (45)..(45): Xaa is any aa, unknown, or other
MSGAIGGAEVHGFRGAAAQLPRSRVLGRPIRVAPPAAARPGGASXGSIRAVSAPAKKDASEVKRSKVEIIKEKSNFLRYPLNEELVSEAPNINESAVQLINFHGSYPQTDRDVRGAEELLRLCSGKKTPLGESSKPTFI

SEQ ID NO: 70407 - DNA, 727 bp, Zea mays
  misc_feature: Ceres CLONE 1549936
  misc_feature: Encodes the peptide sequence at SEQ ID NO. 70408
  misc_feature (311)..(311): n is a, c, t, g, unknown, or other
  misc_feature (312)..(312): n is a, c, t, g, unknown, or other
  misc_feature (321)..(321): n is a, c, t, g, unknown, or other
  misc_feature (322)..(322): n is a, c, t, g, unknown, or other
  misc_feature (343)..(343): n is a, c, t, g, unknown, or other
  misc_feature (384)..(384): n is a, c, t, g, unknown, or other
  misc_feature (415)..(415): n is a, c, t, g, unknown, or other
aaagctggagctcaccgcggtggcggccgctctagaactagtggatcccccgggctgcaggaattcgtctcacccctagaaaaaccgcctatgttatcatgtgcaccttctcttccttcctctgcaagaagccaaatacaatttagaagcgcccctcctcctctcccccatccgtacccaatctaatcgacacccggccgagatgggccgcaagttcttcgttggtggcaactggaaatgcaatggaaccgcagatcaggttgagaagattgtcaaaaccctgaatgaaggaaatgttccctcttcagatnngtgtgaggnntgtgtcagtcctccttatgtngtcctcccggtgggtcagagccagctgcgccaagagttccnaagtgctgctcaaaactgctgggtgaagaanggaagtgcattcctggtggaaatagtgctgaaatgctcctcaacctgggcgtcccctggtcattcttgaccctctgaaagaaactctgcgggaaaatcaaatgattttgggggaaacaaggtgcttttgcccttccctcggacaaagggctttcctgggttgggaaacccttggggaaggggggggctggtcaccccggagtttgttttggccccaaaaaaaaaattttggaaaaaaaaagaggggggaccctttttttttcctcaaaaaaccctttggggtttgtagaagggaaaaacccccccccctttc

SEQ ID NO: 70408 - protein, 93 aa, Zea mays
  misc_feature: Ceres CLONE 1549936
  misc_feature: SWISSPROT Homolog: EC 5.3.1.1 Triose-phosphate isomerase
  misc_feature (37)..(37): Xaa is any aa, unknown, or other
  misc_feature (40)..(40): Xaa is any aa, unknown, or other
  misc_feature (61)..(61): Xaa is any aa, unknown, or other
  misc_feature (71)..(71): Xaa is any aa, unknown, or other
MGRKFFVGGNWKCNGTADQVEKIVKTLNEGNVPSSDXCEXCVSPPYVVLPVGQSQLRQEFXSAAQNCWVKXGSAFLVEIVLKCSSTWASPGHS

SEQ ID NO: 70409 - DNA, 723 bp, Zea mays
  misc_feature: Ceres CLONE 1549938
  misc_feature: Encodes the peptide sequence at SEQ ID NO. 70410
  misc_feature (1)..(1): n is a, c, t, g, unknown, or other
  misc_feature (388)..(388): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
  misc_feature (400)..(400): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (570)..(570): n is a, c, t, g, unknown, or other
  misc_feature (595)..(595): n is a, c, t, g, unknown, or other
  misc_feature (674)..(674): n is a, c, t, g, unknown, or other
  misc_feature (693)..(693): n is a, c, t, g, unknown, or other
  misc_feature (713)..(713): n is a, c, t, g, unknown, or other
  misc_feature (717)..(717): n is a, c, t, g, unknown, or other
nccccctcccctgcccgtcgggtccccgcgggccgggcgctctgcgtagtgcgtccccgggctgcaggcattcgtctaccctagaaaaaacgcgccgtccgcgaaaagactcacaccgctactacaccggccatcacccgccggcgcgccatggccgccgccaccgctaccggggactccgtcaaggagccgctcctcccacgcgcgtacccgtcccaggtcgcgtcggcctcctcgcccgcgctccccgtcgcgcccccggggtccgccggccgtcgctttcctgggccgctcgaaggcccaacctcaagaaggttgttttgtggacgcgcagctggttccgcgtcgaagtttttttttcccccccccccggagggggggggggggnaangnnannttnattnnnnncctcccaactctcccccaaaagaaactggtttttctggagccgggtggttggggtccccttccccggtccttgggcccgctagctcccctttcttttttaaccctttgaaaaaattcaaagtgcttttttttagacccagaaaagggtccccctgctcttgnttctccctccaacccgcactttctntcagattaagtggcgtaaaattttaatgtgccactctctttttcttgtcggttgaaagggtcaccactctatccctttntaaataaccgcgcgcgccncgccgctctttccccccccncttnccccct

SEQ ID NO: 70410 - protein, 156 aa, Zea mays
  misc_feature: Ceres CLONE 1549938
  misc_feature (80)..(80): Xaa is any aa, unknown, or other
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (140)..(140): Xaa is any aa, unknown, or other
  misc_feature (149)..(149): Xaa is any aa, unknown, or other
MAAATATGDSVKEPLLPRAYPSQVASASSPALPVAPPGSAGRRFPGPLEGPTSRRLFCGRAAGSASKFFFPPPPEGGGGXXXXXXXPPNSPPKETGFSGAGWLGSPSPVLGPASSPFFFNPLKKFKVLFFRPRKGSPCSXFSLQPALSXRLSGVKF

SEQ ID NO: 70411 - DNA, 563 bp, Zea mays
  misc_feature: Ceres CLONE 1549945
attgctggagctccccgcggtggcggccgctctagaactagtggatcccccgggctgcaggaattcgtctcacccctagaaaaagctccagctccgactctcacgcgactagggttctgtgcgtccacttccccgtcggcgcaatggagggtcgggggtcagaagtgaagccaggagccacggttcttgcaagttggtgatggcttggtatccactttcacagctgcactgggggatcaagaaagcagtgaaaagccatttggctgttaaattgaagaaagaaacattgctggaccctatcagtgaaaacatccccaaatccttggaacttggtttgaaagggtttgaccccccccattaaaaaaccgtaaggttttttccggggaaaaaacccccggtcccttttggaaccaattccgggaaaaattccccaaaaaatcttaaaccgccttttttcctttggaaaaaaaaaaaaaaaatttccgaaaaaagtcccccaaaaaaaaaaaaaaaaaaatttttttttttttccccggagaaaaaaaatttttttccgcgggagg

SEQ ID NO: 70412 - DNA, 682 bp, Zea mays
  misc_feature: Ceres CLONE 1549947
  misc_feature: Encodes the peptide sequence at SEQ ID NO. 70413
  misc_feature (399)..(399): n is a, c, t, g, unknown, or other
  misc_feature (406)..(406): n is a, c, t, g, unknown, or other
ctccccgcggtggcggccgctctagaactagtggatcccccgggctgcaggaattcgtctcacccctagaaaaagataaaatgcctcagggtttcgatacctcggttggcgagcatgggacacagctctctggtggacagaagcagaggatcgccatcgcaagggctattctgaaagatccaagaattctactgttagatgaagctacaagtgcgctggacgccgagtctgaaaggatcgtgcaggaagctcttgacagggtcatgtcgaataggacgactgtcatagtcgcacaccgtctgagcaccgttagaaacgctgacaccattgccgtcattcatcaaggaacactagttgaaaagggcccacacgatgagcttctgagagatccaaaaagancttacanccaactgataaagctacaggaagcaaaccagccgaacaaccggaagggtgatggcaatgctcgtctaggcaaacagatgtcgatgaaacagtcagctagcaagaaggtggccccgtgataacagaaccccccattctttctcgggggccgttcggtattgcctcttggggattaaaaattcaggaggggtccttccaaccaaactgtgcgcaccaagtgcccacaggaaatggcctcttaagccggggttgcggttttttaacaaagccaaaaaat

SEQ ID NO: 70413 - protein, 173 aa, Zea mays
  misc_feature: Ceres CLONE 1549947
  misc_feature (1)..(115): Pfam Name: ABC_tran Pfam Description: ABC transporter
  misc_feature: SWISSPROT Homolog: EC 3.6.3.44 Xenobiotic-transporting ATPase
  misc_feature (133)..(133): Xaa is any aa, unknown, or other
  misc_feature (135)..(135): Xaa is any aa, unknown, or other
PRGGGRSRTSGSPGLQEFVSPLEKDKMPQGFDTSVGEHGTQLSGGQKQRIAIARAILKDPRILLLDEATSALDAESERIVQEALDRVMSNRTTVIVAHRLSTVRNADTIAVIHQGTLVEKGPHDELLRDPKRXYXQLIKLQEANQPNNRKGDGNARLGKQMSMKQSASKKVAP

SEQ ID NO: 70414 - DNA, 617 bp, Zea mays
  misc_feature: Ceres CLONE 1549953
  misc_feature (424)..(424): n is a, c, t, g, unknown, or other
ctggagctccccgcggtggcggccgctctagaactagtggatcccccgggctgcaggaattcgtctcacccctagaaaaaaacacacacagacacaactcatccgcagaagctcggctgctgctccttcagtcagtctaacaacggttgaggcgttgctggtgctcctgccgcttaccctgccctgttcactgttctgttccgcgcatccacaggaagggaagggaaggaagcagcagcagcacacagctttgctctcgctctcggctccccgtccaccaaaggaggaaacgcgcagcccgcagcgctagccgtcgtctatctcgtctcctagtccaaggaaagaaaagagcgcttgacatgaagcgacctaccaagaatgagacgctgggctacccccggcacaagtagagcaagagccccangtacccgagcaacaggggaggaggactccaagggaaaaaatgggcaaactgccggcacccgggaaggaaaaagcccttctttcctttcgccacccccaaattttaaaacgccccccctttttttaaaaaaattcccgcccaaaaaaaaggccccttttgggaaatatggagaacccccccccccccccccctc

SEQ ID NO: 70415 - DNA, 645 bp, Zea mays
  misc_feature: Ceres CLONE 1549954
  misc_feature: Encodes the peptide sequence at SEQ ID NO. 70416
  misc_feature (585)..(585): n is a, c, t, g, unknown, or other
gcacagtgctagtggatcccccgggctgcaggaagtggcctcacccctagaaaaaatagcgtccactacctagctagccagcatcggtcatgtaggatggcgccgagaaggcgacgacaccggattcttcttcttcgcaagcggcaccgccagcgctgagcgcggtgtacgtgaacaggcccctcgtggcgggcaaccgcgccatggccgccgtccacgtcgcgctggtcgccacggtcatcgtccaacgcggcctggcgctgctctctgctggaaccggcagcgcgtcgcccgcgtcccggtccctgcaggtgcagcacgtggccatggcgctggccgacctgacgctgctgttcctgtgggcgctgtcgcagtcggggctgtggcgtcccgtgacgcgcgccgcgttcccgggccggctgctggcggcggtgccccgcggcgcgctcccgcgcgtggacgtgctggtggtgacggccgacccggacaaggagccgcctctcggggtggtgaacactgtggtgtcggcgatggcgctggactacccgggcggcaagctgagcgtgtacctgtcggacgacgccnggtcgccgctcacgctgctcgccgcccgtaaagcctacgccttcgctgcaagggcctgag

SEQ ID NO: 70416 - protein, 146 aa, Zea mays
  misc_feature: Ceres CLONE 1549954
  misc_feature: SWISSPROT Homolog: EC 2.4.1.12 Cellulose synthase (UDP-forming)
  misc_feature (128)..(128): Xaa is any aa, unknown, or other
MAAVHVALVATVIVQRGLALLSAGTGSASPASRSLQVQHVAMALADLTLLFLWALSQSGLWRPVTRAAFPGRLLAAVPRGALPRVDVLVVTADPDKEPPLGVVNTVVSAMALDYPGGKLSVYLSDDAXSPLTLLAARKAYAFAARA

SEQ ID NO: 70417 - DNA, 808 bp, Zea mays
  misc_feature: Ceres CLONE 1549954-R
  misc_feature: SWISSPROT Homolog: EC 2.4.1.12 Cellulose synthase (UDP-forming)
ttgggtactcgagcgtctcgtttttttttttttttttagagttgaagcaggccgtgcatctctcggttcatgttcacccaagcatggcggcaagcagcacggctgccaatgcgaccgagagtgcggtgatgcgtggcggaaccctcgcaggatcccgcctgaggaacatcccctccagcagcgggtagctgagcgccgcgccgtagcacatgaggaacagctgcggggcgaagtggaagccgccgctcgacgacgacgacgacgacatcttccaggtgccggcgacgatcgcagcggcgttgagcacggagagcgtggtagcagggagcagcagcgcggagcagcccgtgaagtcgaacacgccgtcctggtacaggctcccgtcgacggcagccttgctggtgaggtcgaagtccaaggcacgtgcgccgagcagctcctgggcggcgctgacgcagccgaagagctgggcggtgagggcgttgagcacccagaacctctgctcgttccaccacgtgcgcaggtccagcctcccccgcctggacacgcacacctccgccatgtgctgcagaagcgaggacgcgaacgccgccgcggtggcggcggggcaggtgaatagcgggacgccccggaggaggcagagctgcgggcagggtggcgtagcagagcacgggggacggcgcagagcgcggcgtagccctaagtaggcgtaggccatggcctgggagcaggtaaggtccggaggaacgggcggcagccaaaaccgggggagtggcgccctggagacgcccaaagggcaagcatgccc

SEQ ID NO: 70418 - DNA, 653 bp, Zea mays
  misc_feature: Ceres CLONE 1549957
  misc_feature: Encodes the peptide sequence at SEQ ID NO. 70419
  misc_feature (351)..(351): n is a, c, t, g, unknown, or other
  misc_feature (357)..(357): n is a, c, t, g, unknown, or other
  misc_feature (363)..(363): n is a, c, t, g, unknown, or other
  misc_feature (524)..(524): n is a, c, t, g, unknown, or other
acccgcggtggcggccgctctagaactagtggatcccccgggctgcaggaattcgtctcacccctagaaaaagaggcctcgaggccttagttccaccactagctgccaccgccgcgatgatctccctgcttcgacgcgccatcgccgcctcggcttcgtctccggcggccacgtaccggagactcctcgtcgtcgcgccactctctccgcccgcggcccctccaggcccatgccaggcgcccgcggcagggtcgccggagccgccgaggcgggcgttccactgttctacgcccaccctggggttcaggtccaccccggcgtcgtgggccggtccctgtccgggggagggcnagggcnagggcnagggcaaggacgtggatacgggggctgagaaggggctggagatcgcgaggctggggaccctcgccgcgatcgtgaagagctcgccgcgcggggcatcaccaggctcttccccatccaggtgctgcctctctcggtgagggctgttctgagccagcatgcanggaaagacatgattgggcgtgctcgaacagggactgggaagacctgggctttttgtattcctatcatggacaagatcctcagctacaccagaaggatgggaatggcaggatccctttagcataatctgg

SEQ ID NO: 70419 - protein, 53 aa, Zea mays
  misc_feature: Ceres CLONE 1549957
  misc_feature (41)..(41): Xaa is any aa, unknown, or other
  misc_feature (43)..(43): Xaa is any aa, unknown, or other
  misc_feature (45)..(45): Xaa is any aa, unknown, or other
MPGARGRVAGAAEAGVPLFYAHPGVQVHPGVVGRSLSGGGXGXGXGQGRGYGG

SEQ ID NO: 70420 - DNA, 734 bp, Zea mays
  misc_feature: Ceres CLONE 1549958
  misc_feature (734)..(734): n is a, c, t, g, unknown, or other
ctccccgcggtggcggccgctctagaactagtggatcccccgggctgcaggaattcgtctcacccctagaaaaagacgacgctgacgcggctgataatttccacgaacacatagatccgcatcgtcgatccatccgtcctcctcccgacggtacgccagcctgccagagtccgacgcccgcctagggctcctggacacagcagagcccacgccttgactcgctccgttcgagtggagcgcacaggcaccgggcggcgaccagagagggagcggatcgagggggctcggcttgattggaggagatgggaccccagggatgttggggattccgggcaaggggcatgtagttcccggcccccctgcctcccaacaaggaggcggttgaaggcccatggttgggggctttcccccccccccgggcccccacttggcctttggggaaagaattgcctggggcccttttttgcacccaagggtggaagggtggttcatcccccgggggagctttggaagcgttgaccattccgccctcccgcagaacaaataccaaggatttgaatccccaaagcctaaagtggttccgcctggaaggcggggaaatgcgaaaaccgttttcctcccttaaaaagcgtactccctgcgcaaaatttaggccgtgatgcgaaactttattagacgcggaacgacccctatatccggggaactgcggaagggtgcgtcccctcccacacaan

SEQ ID NO: 70421 - DNA, 621 bp, Zea mays
  misc_feature: Ceres CLONE 1549960
  misc_feature: Encodes the peptide sequence at SEQ ID NO. 70422
  misc_feature (368)..(368): n is a, c, t, g, unknown, or other
  misc_feature (412)..(412): n is a, c, t, g, unknown, or other
gctccccgcggtggcggccgctctagaactagtggatcccccgggctgcaggaattcgtctcacccctagaaaaaaagcagggagggagaagacgcgaggagagagagagagagaggaggtgcgcggcatggcgggtgcgacgtccctggcggcggccgctaatctggcgggcaagtcgagcgtgcgggtcgtcgtgatcggcgaccccggcaccggcaagtccagcctcatcgtcgccctcgccaccgagcagttccccgagaacgtaccacgcgtcattgccccccacccggcctcccccgccgactactttcccccgatcggcgtcccccatcactatcatcgacacgtcgtccagcccggaccnaaacccgaagttgatcgccgagttgcaggcacccgaatgcgtcntgctcacctacgcttggaaccggcccgccccctggagcggtctagttcttttttggtttccaaactcccgggaacttcatttggagggccccctttttccgggggggggggggaaacctgggaccccaagggaacaaaaaaacgggggtttacccctttaaaaaaggtttatgggccccccctatttgggagtccctttcccccgggaa

SEQ ID NO: 70422 - protein, 164 aa, Zea mays
  misc_feature: Ceres CLONE 1549960
  misc_feature (95)..(95): Xaa is any aa, unknown, or other
MAGATSLAAAANLAGKSSVRVVVIGDPGTGKSSLIVALATEQFPENVPRVIAPHPASPADYFPPIGVPHHYHRHVVQPGPKPEVDRRVAGTRMRXAHLRLEPARPLERSSSFLVSKLPGTSFGGPPFSGGGGETWDPKGTKKRGFTPLKKVYGPPLFGSPFPPG

SEQ ID NO: 70423 - DNA, 661 bp, Zea mays
  misc_feature: Ceres CLONE 1549962
  misc_feature: Encodes the peptide sequence at SEQ ID NO. 70424
  misc_feature (309)..(309): n is a, c, t, g, unknown, or other
  misc_feature (351)..(351): n is a, c, t, g, unknown, or other
  misc_feature (379)..(379): n is a, c, t, g, unknown, or other
  misc_feature (411)..(411): n is a, c, t, g, unknown, or other
  misc_feature (430)..(430): n is a, c, t, g, unknown, or other
  misc_feature (450)..(450): n is a, c, t, g, unknown, or other
  misc_feature (509)..(509): n is a, c, t, g, unknown, or other
acccgcggtggcggccgctctagaactagtggatcccccgggctgcaggaattcgtctcacccctagaaaaaacaactgtcctggcctgtccacggtccacacacgccttccttatatcggcgctcacggttctataaaaaaaacacagtacgagcagagcaaggcggccgtgagctgagctgagggaaggacgacgtacggcacagttgctagcccggccgccggagctctccgtgatctgggccgccagcaacagcatgggtgccgcgctcttggcttcttggccatgggacaacctcggcttctancagtacgtcctgtacgggccgctggtgggcaaggcggtggcntcacgggcgtgggaggcggcgagccccnaccgctggatcctcctcctgctccctctcttngggctccgcgcgctcaccntacagctctggagctccttncagcacatgctcttcgccacacgccgggcgccgcgtcgtccgcgacggcgtcaacttcnacagatcgacaagagtgggactgggacacttcctgatcctgaccccctgatgggggccggggcctgtgcccttcccttcgtggggattctccgggtggaaaggccgggggttcccctccgctcttccccaaggggggccccgaaccccttca

SEQ ID NO: 70424 - protein, 134 aa, Zea mays
  misc_feature: Ceres CLONE 1549962
  misc_feature (17)..(17): Xaa is any aa, unknown, or other
  misc_feature (41)..(41): Xaa is any aa, unknown, or other
  misc_feature (51)..(51): Xaa is any aa, unknown, or other
  misc_feature (58)..(58): Xaa is any aa, unknown, or other
  misc_feature (64)..(64): Xaa is any aa, unknown, or other
  misc_feature (84)..(84): Xaa is any aa, unknown, or other
MGAALLASWPWDNLGFXQYVLYGPLVGKAVASRAWEAASPXRWILLLLPLXGLRALTXQLWSSXQHMLFATRRAPRRPRRRQLXQIDKSGTGTLPDPDPLMGAGACALPFVGILRVERPGVPLRSSPRGAPNPF

SEQ ID NO: 70425 - DNA, 686 bp, Zea mays
  misc_feature: Ceres CLONE 1549964
agctccccgcggtggcggccgctctagaactagtggatcccccgggctgcaggaattcgtctcacccctagaaaaagctccacgcgctggcatagccgtctgttctcagcaaacccacccgtctgttctcgtcgtggcggccgccctgtccccattccccaatccctgtcgccgtgtccctaatccggctccgacaatcccacgcccagcagtccagctccagcaccaccagcgccgccctgccccacgcggccacacccaggacccagcggccagcactactaccaggctggcagcgcgcggaggtccagcgccagccgccagcaccaggcttccaggtctctagtgactcgatctcaaggtactcagcgcgctggcagccgatctaggtctctatgtgtcctttgagtcttctctccgtataaattcatcataaaagctcaagacctagatcggcttttcccccctgttcagcaaaggcgtttcgggatgtttatcatggatcgatcgatcatggcgggatggggagacatcggcggaggaaaaagagggaggtggacggggccaccagaggcgcaggaagttggaggagacaaagaaggaggcggacggggcccaccaaaggcccagggagttgggaaggacccccttggactcttctcagggaacaaaatttgcggccgcag

SEQ ID NO: 70426 - DNA, 652 bp, Zea mays
  misc_feature: Ceres CLONE 1549971
  misc_feature (362)..(362): n is a, c, t, g, unknown, or other
ctccccgcggtggcggccgctctagaactagtggatcccccgggctgcaggaattcgtctcacccctagaaaacacccccctcccctccacctcgtcacgctcacgccgcacgggcccggcccaaataccctcgcactcgcgcccccacctctcgccacaaaccctaacctgacctccccaccggctcgacgccgccgtcgccggtccgtcttcgtcgtcggcccactctgtgcgaggtagcagagttgcttgcgtgcgaaggccgcttggtctggagttaagcgcgtgttgtaatggaggggcgtgggaaccctccgcacaccaccactgatgctgtgatcaagaaagccaaggagcgtcncatccagggaagcgaagggtccacggagccacctccacgtatggaagtacaatggcatttgcccgccatcttggagccctcccccatgacgatgaacacgggccgttgggacctggggggaactctcggagggaaaaaagcctccccccttaaaatagccccctgaaaaaggaaaggggctccccttgggcttcactagggaaagccaaaccgtggcccccaaggaaaaaataaagggagggggatttgattaaaattccggggggggggccacaccctgtgaatggggg

SEQ ID NO: 70427 - DNA, 649 bp, Zea mays
  misc_feature: Ceres CLONE 1549973
  misc_feature: Encodes the peptide sequence at SEQ ID NO. 70428
ggagctccccgcggtggcggccgctctagaactagtggatcccccgggctgcaggaattcgtctcacccctagaaaaactctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctccccatcaccgtgcctgtgggcagggctaccctt

SEQ ID NO: 70428 - protein, 162 aa, Zea mays
  misc_feature: Ceres CLONE 1549973
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPSPCLWAGLP

SEQ ID NO: 70429 - DNA, 729 bp, Zea mays
  misc_feature: Ceres CLONE 1549975
  misc_feature: Encodes the peptide sequence at SEQ ID NO. 70430
tccccgcggtggcggccgctctagaactagtggatcccccgggctgcaggaattcgtctcacccctagaataaacgcccaccccacccgaccctggcacacaacacctattcttcttacttcttgagactgtctctgtccactccgccacctcacttgcgatgtgacctagagcaaagccctgaaatccttctccccctgcacacacctgcatgacctgctctctcgtgcgcatctccggtgcccctcactgtttagtggcgacgactgggcgattgttgtcgccgctgcgcagtaggggccgtgcccctggtctccatcttcggggcgctccgccccccaaatattaacagctgccacctcgattctgaggggcttcttttgatgacccgtggacaggtgcccccccccccctgaactttttttcgctttggtccccagggggtccactgtttgccaatgccttaacccggcttttggaccaaccgttttcgggagttggaaaaaaaacactcggggggcacctgaaagaggctccccctccgaatttggtcagggaaaaagtggccccatacttaagtggccaaggggcccgtttccccttgggggggacacgcccccccatttttgtgaaaaaccctttctcgaaaaaaaaactccccttttcaaaaaaaaaaagccctcctatttctccggaaacaacatcatcggggggagggctttttgcaga

SEQ ID NO: 70430 - protein, 45 aa, Zea mays
  misc_feature: Ceres CLONE 1549975
MTCSLVRISGAPHCLVATTGRLLSPLRSRGRAPGLHLRGAPPPKY

SEQ ID NO: 70431 - DNA, 648 bp, Zea mays
  misc_feature: Ceres CLONE 1549983
  misc_feature: Encodes the peptide sequence at SEQ ID NO. 70432
  misc_feature (397)..(397): n is a, c, t, g, unknown, or other
  misc_feature (405)..(405): n is a, c, t, g, unknown, or other
  misc_feature (432)..(432): n is a, c, t, g, unknown, or other
  misc_feature (574)..(574): n is a, c, t, g, unknown, or other
ggagctccccgcggtggcggccgctctagaactagtggatcccccgggctgcaggaattcgtctcacccctagaaaaaccatcgccacgatacctaaaaaaagatctacgcagcgaaaagggccgcggaaaaaacgagttgtacgcgtcggctccgcttcttgatcccaacaccgccacgataatataatactaaatctatcgtccgcaccagcagcgagtgaaggaggagcctgcccgcgcctgcgcctggttgtaattgtagctcacgctcacccttcagttgaccaccgctgcggcagcaatggcggcgagtcgccggcagcaccgccgcggcttcccgctggtcccgttgctgctgtcgctcctggcggccggcgcgtacggccgcctcatcntcgaaggnggggccgcccgcgcgctcctccgggtnatcgcctcgcggcggcgccgggcgaagccgagtgcgagcagacctacgggcttcctcccctgcaccaccaccgtgctccggaacctcttcctggtgctggcctacggcttcctcacgttaaaggcggccacgtcccttgtcngcggcaccaagctgcttcctaaaaaacatgggggcccgggcctcttgggggggccccctcctccccatcccaag

SEQ ID NO: 70432 - protein, 115 aa, Zea mays
  misc_feature: Ceres CLONE 1549983
  misc_feature (32)..(32): Xaa is any aa, unknown, or other
  misc_feature (91)..(91): Xaa is any aa, unknown, or other
MAASRRQHRRGFPLVPLLLSLLAAGAYGRLIXEGGAARALLRVIASRRRRAKPSASRPTGFLPCTTTVLRNLFLVLAYGFLTLKAATSLVXGTKLLPKKHGGPGLLGGPPPPHPK

SEQ ID NO: 70433 - DNA, 661 bp, Zea mays
  misc_feature: Ceres CLONE 1549986
  misc_feature: Translation starting site: 205
  misc_feature: SWISSPROT Homolog: EC 4.3.1.5 Phenylalanine ammonia-lyase
ctccccgcggtggcggccgctctagaactagtggatcccccgggctgcaggaattcgtctcacccctagaaaaaagaagagcacgcccactcctctccggctcctcttcttctccaccacaccacaggcaccggcaccagcaccgcctcctccctccctccctcttgccaccgcgcggccccccagccacagcacagcacagcaatggcgggcaacggcgccatcgtggagagcgacccgctgaactggggcgcggcggcggcggagctggcggggagccacctggacgaggtgaagcgcatggtggcgcaggcccggcagccggtcgtgaagatcgagggatccacgctccgcgtcggccaggtggccgccgtcgcgtccgccagggacgcgtccggcgtccccctcgagctcgacgaggaagcccgcccccgcgtcaaggcagcagcgagtggatcctcgactgcatcgcccacggcggcgacatatacggcgtcaccaccggcttcggcggcacctcccaccgccgcaccaagggacgggccccgcgcctcaaggtcgagctgctcaggcatctcaacgccggaatcttcggcactgggaacgatggccacacgctgccgtcggaagtcacccgggcggggatgctggggcgcatcaa

SEQ ID NO: 70434 - DNA, 696 bp, Zea mays
  misc_feature: Ceres CLONE 1549987
  misc_feature: Encodes the peptide sequence at SEQ ID NO. 70435
  misc_feature (260)..(260): n is a, c, t, g, unknown, or other
  misc_feature (696)..(696): n is a, c, t, g, unknown, or other
tggagctccccgcggtggcggccgctctagaactagtggatcccccgggctgcaggaattcgtctcacccctagaaaaatcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagcggtcgggcccnggacgcggctcgccggccttctcggtgcgcgtgcgccgcccgctgccggacttcctgcagtcggtgaacctcaagtacgtgcgcctcgggtaccactacctcatcacccacggcgtgtacctggccaccatccccgtcatcgtgctgggtgtgcggcgccgagcggggcagcctcagccgccaacaagctgtggcgcaagggggtggggggaagcccccctacgacctcgccaccgggggtcgcctttcctcgccggccttcgcctttcaccttctccgtttaaattagggcccgggcccagggccggggtacccccttccgaccttccagggtaaaaggccggccaaagagcctcaagggggtcccaggggggaattcctccacccctggggccgaaagcccgggaagtttccaacaagaacaaccctgggcttn

SEQ ID NO: 70435 - protein, 134 aa, Zea mays
  misc_feature: Ceres CLONE 1549987
  misc_feature: SWISSPROT Homolog: EC 2.3.1.119 Icosanoyl-CoA synthase
MAREEQALLSTEIVNRGVERSGPGRGSPAFSVRVRRPLPDFLQSVNLKYVRLGYHYLITHGVYLATIPVIVLGVRRRAGQPQPPTSCGARGWGEAPLRPRHRGSPFLAGLRLSPSPFKLGPGPRAGVPPSDLPG

SEQ ID NO: 70436 - DNA, 650 bp, Zea mays
  misc_feature: Ceres CLONE 1550147
  misc_feature: Encodes the peptide sequence at SEQ ID NO. 70437
  misc_feature (298)..(298): n is a, c, t, g, unknown, or other
tgggtaccgggccccccctcgagccctgcagtggtaaagggggctcgcaatcgcagcaacgatggggagatcgccgtgctgcgagaaggcgcacacgaacaagggcgcgtggaccaaggaggaggacgaccgtctggtggcgtacatcaaggcgcacggcgaggggtgctggcgctcccttcccaaggccgccggacttctgcgctgcggcaagagctgccgcctccggtggatcaactacctgcggcccgaccctcagcgcggcaacttcacggaggaggaggacgagctcatcatncagctccacagcctactcggcaacaaatggttcctgatcgctgaaagctgccgggcaggacgacaacgagatcaagactactggaaccccccattcggcggaactgctaaccgggggatcaaccggggaacaccggcccattaaaagccagttcaaataaacatttttttagaattgggcccgggaaagcctcaatgcccccaaccaaaatgggactttttataccccccctttaaaagaaaaaaaaaaaatctttttaaccccgaaaaaagggggaggggggtttttttttttaagagcgggggggctccccaaaggggggggggggggggccctctccccccccgcggcc

SEQ ID NO: 70437 - protein, 126 aa, Zea mays
  misc_feature: Ceres CLONE 1550147
  misc_feature (14)..(61): Pfam Name: Myb_DNA-binding Pfam Description: Myb-like DNA-binding domain
  misc_feature (79)..(79): Xaa is any aa, unknown, or other
MGRSPCCEKAHTNKGAWTKEEDDRLVAYIKAHGEGCWRSLPKAAGLLRCGKSCRLRWINYLRPDPQRGNFTEEEDELIXQLHSLLGNKWFLIAESCRAGRQRDQDYWNPPFGGTANRGINRGTPAH

SEQ ID NO: 70438 - DNA, 651 bp, Zea mays
  misc_feature: Ceres CLONE 1550151
  misc_feature: Encodes the peptide sequence at SEQ ID NO. 70439
acaattgggtaccgggccccccctcgagcactgcagtggtaaaggtttaactttacacgcagtggcaaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcattgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatctagtgcatattgaagtcatgtttcctgtcaaaaaaaaaaaaaaaaaccagagctctgggaa

SEQ ID NO: 70439 - protein, 114 aa, Zea mays
  misc_feature: Ceres CLONE 1550151
  misc_feature (13)..(78): Pfam Name: Complex1_LYR Pfam Description: Complex 1 protein (LYR family)
MASTAGYLARRAAQKERVRLLYRRALKDTLNWAVHRHLFYQDASDLRDKFEANRHVDNLDVVDRLIDDAEAQYRNFQHPDPYIVPWAPGGTKFTRNPPPPQGIEIIYNYGKEDQ

SEQ ID NO: 70440 - DNA, 664 bp, Zea mays
  misc_feature: Ceres CLONE 1550190
  misc_feature: Encodes the peptide sequence at SEQ ID NO. 70441
  misc_feature (415)..(415): n is a, c, t, g, unknown, or other
  misc_feature (451)..(451): n is a, c, t, g, unknown, or other
cgattgggtaccgggccccccctcgagccactgcagtggtaaagggggccagaaagcgacccgaccgtctctccgctccctccctcccccacaccacccacctgtgatctcccgcgcgggagatccgcccgccccatggcgccgtcgcgcccgctcatgcgggggatccgcccgccgtgcgtcttcccgacccgcggcggccgcgcctcgccgtacgctgtcgccctcacggccctgctcctcgtctccgccgccctcctcgcgctcatcgccttcggcgtcttctcgctccccgtgtcagcgccgaacgccgccgccaccaccacagccggaggggagaccgaatccgccgacacccgccccgcgcgcccccgcgcccgccgggacctgggggaggggctgggagagcgtcgcncgcagtggaccgaggtcatctcgtgggagccagggncattcgtctaccacaactttctgtctaaggaagagtgtgaatacctaattggattgcgccagcctcacatgggaaaaatcaacagtttgtcgaccgccactactgggtaaaagcaaggacaagcagggtccggaacaagttccgggccttgtttccttcaaagaaggaaggaacaagggttttttccagtatttgaaaaaagggatggccgaa

SEQ ID NO: 70441 - protein, 141 aa, Zea mays
  misc_feature: Ceres CLONE 1550190
  misc_feature (94)..(94): Xaa is any aa, unknown, or other
  misc_feature (106)..(106): Xaa is any aa, unknown, or other
MAPSRPLMRGIRPPCVFPTRGGRASPYAVALTALLLVSAALLALIAFGVFSLPVSAPNAAATTTAGGETESADTRPARPRARRDLGEGLGERRXQWTEVISWEPGXFVYHNFLSKEECEYLIGLRQPHMGKINSLSTATTG

SEQ ID NO: 70442 - DNA, 644 bp, Zea mays
  misc_feature: Ceres CLONE 1550191
  misc_feature: Encodes the peptide sequence at SEQ ID NO. 70443
cgattgggtacggggcccccctcgagccctgcagtggtaaagtcgtcgccgttgccccgccctctgggctggcgcggcgtggaggggacaactggagatccgcctgtctctgcttggattgcttcttcctcctctcgccgacagaactaccctactgctgcgtgaagacgatggagtggccaccaccgtcgacgtcaccatcgccgtcgctggtggtgcgcagccccaggcaaacagtcagcctgatccgcaaccggcgaccccatcgtgactgggccccctcatcgaggtctccctctttcgccgcccgtgaccatggccccaagccgtcggaggtgtacggcttcgttggatccatcaccaccgtcattgccaccgccgtgtacctcgcctgggcatacacgcccgagcccgtcctccagtcactcggcatcacctactaccctagcaagtactgggcactggcggtgccatcgttcgtggttgtgaccgtggtgctgtccatgggcatctacatgggcctcaacttcgctgccactcctcctccgacttccttcagtactatcttcgatgaaaagagtagggagcacacagccttttttcctgcaactgaggatgagaggcccatcgaacccatctcagaa

SEQ ID NO: 70443 - protein, 158 aa, Zea mays
  misc_feature: Ceres CLONE 1550191
  misc_feature (52)..(158): Pfam Name: PIG-P Pfam Description: PIG-P
  misc_feature: SWISSPROT Homolog: EC 2.4.1.198 Phosphatidylinositol N-acetylglucosaminyltransferase
MEWPPPSTSPSPSLVVRSPRQTVSLIRNRRPHRDWAPSSRSPSFAARDHGPKPSEVYGFVGSITTVIATAVYLAWAYTPEPVLQSLGITYYPSKYWALAVPSFVVVTVVLSMGIYMGLNFAATPPPTSFSTIFDEKSREHTAFFPATEDERPIEPISE

SEQ ID NO: 70444 - DNA, 642 bp, Zea mays
  misc_feature: Ceres CLONE 1550203
  misc_feature: Encodes the peptide sequence at SEQ ID NO. 70445
  misc_feature (604)..(604): n is a, c, t, g, unknown, or other
  misc_feature (642)..(642): n is a, c, t, g, unknown, or other
cgattgggtaccgggccccccctcgagccactgcagtggtaaaggcgagttgcgcctctcgccctcacccccacccccagtcccccgcaggcgcaccaccgaaactgctccgcctccacgcccgctcgccctgaccacggcgatggccgccgccgccctccgctcttccgcgcgccggctcctgcgcctcgccccggcagcctcgtcggctctgtccgctggttcccggcccagcgccggggctgcgccgctcacgcgccccatcgccgcgttctcaggtggcaacaatcctatctcatggaaactgaggcggttctacagttcaattgaaaaacacttgcccgcaatatctgatccagagatagaatctgcatttaaggatttgttggctgctagttggaatgaacttccagattctcttgtagcggaagcaaagaaagcagcatctaaagccaccgatgatagtgctggtcaagaggctttgaaaaatgtatttcgtgcagctgaggcatgtgaagaatttagtggaactttggttaccctaagaatggctcttgatgatctttgtggcctgactggcgaaaatgtgggtcccttacctggntatatgaagatgctgttaaagctgcatataatcgctan

SEQ ID NO: 70445 - protein, 166 aa, Zea mays
  misc_feature: Ceres CLONE 1550203
MAAAALRSSARRLLRLAPAASSALSAGSRPSAGAAPLTRPIAAFSGGNNPISWKLRRFYSSIEKHLPAISDPEIESAFKDLLAASWNELPDSLVAEAKKAASKATDDSAGQEALKNVFRAAEACEEFSGTLVTLRMALDDLCGLTGENVGPLPGYMKMLLKLHIIA

SEQ ID NO: 70446 - DNA, 644 bp, Zea mays
  misc_feature: Ceres CLONE 1550221
  misc_feature: Encodes the peptide sequence at SEQ ID NO. 70447
cgattgggtaccgggccccccctcgagccctgcagtggtaaaggattctgattggcacccgtaaatcatctgctttgtctacctcagcaggtttgcaacatttacgcgatccattgcattgcgacttgcagctgcagagccggtgatggcggaccggcggagcaatggtggttcgccccctaactggagcttcgcgtctcaaagcagccactaccacttggcggcgatgagaggaagctacgcggcacagagcctctggcgcccgacgccgatgccggtccgtggcgccgccctgtcctcgacgccgcacgttgtggcctcggcgcccgccgagaagaacttcgccgccgacttcctgctgggcggggtgtcgtcggcggtgtccaagaccgtggcggcgcctatcgagcgcgtcaagatgctgctgcagaaccaggacgagctgatccggaccggcaggctgtccgagccgtacaggggcatcggcgactgcttcggccgcaccgtcagggacgagggcttcctgtcgctgtggcgcgggaacaacaccaacgtcatccgctacttccccacgcaggccctcaacttcgcgttcaaggactacttcaagggcctcttcaacttcaacaaggacagggacggct

SEQ ID NO: 70447 - protein, 166 aa, Zea mays
  misc_feature: Ceres CLONE 1550221
  misc_feature (65)..(162): Pfam Name: Mito_carr Pfam Description: Mitochondrial carrier protein
MADRRSNGGSPPNWSFASQSSHYHLAAMRGSYAAQSLWRPTPMPVRGAALSSTPHVVASAPAEKNFAADFLLGGVSSAVSKTVAAPIERVKMLLQNQDELIRTGRLSEPYRGIGDCFGRTVRDEGFLSLWRGNNTNVIRYFPTQALNFAFKDYFKGLFNFNKDRDG

SEQ ID NO: 70448 - DNA, 643 bp, Zea mays
  misc_feature: Ceres CLONE 1550254
  misc_feature: Encodes the peptide sequence at SEQ ID NO. 70449
cgattgggtaccgggccccccctcgagccactgcagtggtaaaggtcgccctcgtaatcaatctccgcctccctgcctgcttaccccgaccccgtcggcatctcggagaatcgcggcggtcaaagcccagcctaccccacctcgcgccgcgtcgccgcggtttccgcgggccagtgctctcgggagtcgggagctcagatcaggagggacgggctaggtagggttcgcgagcgagcgagggtgctgccgtccggcgccggtgtccgagtagcaagaggagagatggacgcgttcctgcagaggctcaagcggttggacgcgtaccccaaggtgaacgaggacttctacaagcggacgctctccggcggcatcgtcacgctcgtcgccgccgtcgtcatgctgcttctcttcatctccgagaccaggtcatatttttattcagcaacagagactaagttagttgtggacacatcaagaggagaaaggctacgagtaaattttgatattacttttctgagcattccttgcaccctcctcagcgttgatacaatggatattagtggagaacagcaccaggacattaggcatgacatcgaaaagatacgattagatgcacatggtaatgttattgaagcaagaaaag

SEQ ID NO: 70449 - protein, 120 aa, Zea mays
  misc_feature: Ceres CLONE 1550254
MDAFLQRLKRLDAYPKVNEDFYKRTLSGGIVTLVAAVVMLLLFISETRSYFYSATETKLVVDTSRGERLRVNFDITFLSIPCTLLSVDTMDISGEQHQDIRHDIEKIRLDAHGNVIEARK

SEQ ID NO: 70450 - DNA, 655 bp, Zea mays
  misc_feature: Ceres CLONE 1550262
  misc_feature: Translation starting site: 147
cgattgggtaccgggccccccctcgagccactgcagtggtaaaggattctgattggcacccgtaaatcatctgctttgtctacctcagcaggtttgcaacatttacgcgatccattgcattgcgacttgcagctgcagagccggtgatggcggaccggcggagcaatggtggttcgccccctaactggagcttcgcgtctcaaagcagccactaccacttggcggcgatgagaggaagctacgcggcacagagcctctggcgcccgacgccgatgccggtccgtggcgccgccctgtcctcgacgccgcacgttgtggcctcggcgcccgccgagaagaacttcgccgccgacttcctgctgggcggggtgtcgtcggcggtgtccaagaccgtggcggcgcctatcgagcgcgtcaagatgctgctgcagaaccaggacgagctgatccggaccggcaggctgtccgagccgtacaggggcatcggcgactgcttcggccgcaccgtcagggacgagggcttcctgtcgctgtggcgcgggaacaacacaacgtcatccgctacttccccacgcaggccctcaacttcgcgttcaaggactacttcaagggccctcttcacttcaacaggacagggacggctacttggaggtgt

SEQ ID NO: 70451 - DNA, 624 bp, Zea mays
  misc_feature: Ceres CLONE 1550266
  misc_feature: Encodes the peptide sequence at SEQ ID NO. 70452
cgattgggtaccgggccccccctcgagccctgcagtggtaaaggtagcctgtccgaggcttctcatccgcgtcgcatggactcggggtctcgtgctgtcgcggtgtcgccagccagccgcctcccgcatcgcctccaaggctctccaaccggggcgcctgcctaaccggccgatttccttccttgcgtagctccattccactgcacaaacagcgcgccactttcccaattcccgtcgcgtggcctccttcaggtcctggccactttgtgcgtcctgtagcgagggggtgatcggcgatggactggggggacaggaccaaggccgccgccgccgctgcggcgccggacgagagggccgggggaggggaagggctcggaggatacgtcaaggtcatgaccgacgaacagatggaggtgctccgcaagcagatctccatctacgccaccatctgcgagcagcttgtcgagatgcatcgcgtccttaccgagcaccaggacaccattgcaggaatgaggtttagcaatgtgtactgtgaccctctaatcatccccgggcgtcacaagatcacggcaaaggcagcggtggcaacccacaccgatgcagctgcagaatctgaaaagctct

SEQ ID NO: 70452 - protein, 109 aa, Zea mays
  misc_feature: Ceres CLONE 1550266
MDWGDRTKAAAAAAAPDERAGGGEGLGGYVKVMTDEQMEVLRKQISIYATICEQLVEMHRVLTEHQDTIAGMRFSNVYCDPLIIPGRHKITAKAAVATHTDAAAESEKL

SEQ ID NO: 70453 - DNA, 656 bp, Zea mays
  misc_feature: Ceres CLONE 1550273
  misc_feature: Translation starting site: 155
cgattgggtaccgggccccccctcgagccactgcagtggtaaaggagaggaagtcagatccgtgttccgtgtccgcgtccagtgtgtccgctactccgctccccctcagtcctcagttcctcacctaggggtagggtgcgcgcgggagacgtagatggcggcttcggaggcggcagcggcggcggcaacaccggtgacgcccacctacgggacggtgatcgcgatccacagcctggaggagtggatcatccagatcgaggaggccaacaggcgccaagaagctggtggtgattgacttcactgcaacatggtgtcctcgcgtgccgcgccatggctcccatttttgctgatatggcctatacgtcccctaatgttgttttcctgatcagttgatgtcgatgatgtgaagaccattgctgagccattcaccgtagaggccatgcctgctttcctgttcttgagggagggcgacgtctaggacagggtcgttggcgcagcggaggtagagctggctaggaagcttgaactacacatggcctcgtagatcactgatgccgtaatgtagtattcgcctaagtaagaggacgcctcgccgtcactatgagataactagtgcttctgtgatggtaattcgtatgagataggcccccattggt

SEQ ID NO: 70454 - DNA, 651 bp, Zea mays
  misc_feature: Ceres CLONE 1550282
  misc_feature: Encodes the peptide sequence at SEQ ID NO. 70455
  misc_feature (651)..(651): n is a, c, t, g, unknown, or other
cgattgggtccgggccccccctcgaccctgcagtggtaaagggtgctcccgcgcgatggcggaggcggcagcggcgggatcgttgtcgaggcggcggatgcaggacgaggagggggcagcggcgattgaggctgatgcggggcacaggaggaggagcgaagcggaggaggcggaggatgatgtcgagagctccgactacatgtcggaggacgagggcaccgaggactaccgccgtggcggataccacgccgtccgcgtcggagactccttcaagcagggcacctacgtcgtgcagtctaagctcggatggggccacttctccaccgtctggcttgcctgggacaaagcccattccagatatgtggcgctgaaggtgcagaagagcgcccaacactacacagaagcagccatggatgagatcaagatcttgaaggaaattgctgatggtgatcctgacgactcaaaatgtgttgttaagcttcttgaccacttcaagcactcgggtcctaatggtaaccatgtgtgcatggtttttgaatttctcggcgataacctgttgaccctgataaagtacacagactaccgtggaattcccctttcaatggttaaggagatatgtcgccatgtgctcattggccttgactacctccn

SEQ ID NO: 70455 - protein, 198 aa, Zea mays
  misc_feature: Ceres CLONE 1550282
  misc_feature: SWISSPROT Homolog: EC 2.7.11.1 Non-specific serine/threonine protein kinase
MAEAAAAGSLSRRRMQDEEGAAAIEADAGHRRRSEAEEAEDDVESSDYMSEDEGTEDYRRGGYHAVRVGDSFKQGTYVVQSKLGWGHFSTVWLAWDKAHSRYVALKVQKSAQHYTEAAMDEIKILKEIADGDPDDSKCVVKLLDHFKHSGPNGNHVCMVFEFLGDNLLTLIKYTDYRGIPLSMVKEICRHVLIGLDYL

SEQ ID NO: 70456 - DNA, 656 bp, Zea mays
  misc_feature: Ceres CLONE 1550294
  misc_feature: Translation starting site: 129
  misc_feature: SWISSPROT Homolog: EC 2.4.1.207 Xyloglucan:xyloglucosyl transferase
cgattgggtaccgggccccccctcgagccctgcagtggtaaaggagctgaggaggccatcggacgcacaaggacagcaagcagagtgcagggccggagcgagcgaccgagagtgtgtgtgagagagagatggcgtccagcgcctcgtgtaccctgctgctgccaacgctctcgctcgcggtgatcctgctcgcgctgtgcgcccgcggcggcgaggccaggccgccgccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggcttcttcagcgccgccatcaagctgcccgccgactacgcggcgggcgtcgtcgtcgcgttctacctgtcgaacggcgacgtgtacgagaagacgcacgacgagctggacttcgagttcctgggcaacgtgcgcggccgcgagtggcgggtgcagaccaacgtgtacggcaacggcagcaccgacgccggccggggagagcgctacgacctcccccttcgaccccaccgacgacttccaccactactccatcctctggaccagcgaccg

SEQ ID NO: 70457 - DNA, 744 bp, Zea mays
  misc_feature: Ceres CLONE 1550299
  misc_feature: Encodes the peptide sequence at SEQ ID NO. 70458
aagctgtggagccgctccagcaggcgtccatatctagaactagtggatcccccgggctgcaggaattcgtctcacccctagaaaaaatgcaaaaaccctgtccgccggctgcgcctagcccatgaccgctgccacctcgacgtgggtctccttcacggcgactcaccagccagcgtgcctgctctcctcgcccgcgcacgggtctctgcaccgccggtacgtcgcagccatggtctccgcggcgccggccgtcgggaccgtcataacgtgactggacaaccacagctaggtcttcaacgaggagaaggtcgccctcgcaggccacgaacagtacatggtgagcggctccaggaacctgttcccacctcctacggaggcgttcaagggggtcaagcagatcagagtcacccaccccggctcaggtgggtctgcccatgcccataacctgagagttcactgactaatgccaaggcaaaaatggtgcgacgattggtctgcggaaaggataccaaactttttgaggaaacacgtccccttgaatgaacgaaataaagcggacccttgggcgatattttcggaaacatcctcccgcagcgaatttgtgttgcttttggaattccaatggccggggggggggaaactctatgtagaaaattttcccccccactgaaaccaaaaaggcacccctgggttaaggataacgggaaattattgcggggaaaatttagcaaatatcttaaaaat

SEQ ID NO: 70458 - protein, 41 aa, Zea mays
  misc_feature: Ceres CLONE 1550299
  misc_feature: SWISSPROT Homolog: EC 1.1.1.86 Ketol-acid reductoisomerase
MVSGSRNLFPPPTEAFKGVKQIRVTHPGSGGSAHAHNLRVH

SEQ ID NO: 70459 - DNA, 719 bp, Zea mays
  misc_feature: Ceres CLONE 1550302
  misc_feature: Encodes the peptide sequence at SEQ ID NO. 70460
  misc_feature (700)..(700): n is a, c, t, g, unknown, or other
ctccccgcggtggcggccgctctagaactagtggatcccccgggctgcaggaattcgtctcacccctagaaaaactcctcgttccctcgagaactgtaccatcacgcgccgcccgtccgcccttgattgagcagggactgggagagagggtgaaagggggcaagaaaacgcttcttgttgccgctgtgtcttctgcggatccacggtggctgcgcactcctgcagggtaagaggagtctctggcggctcgcctccagtctttcttcacctccgagctctccgggctcttcggccaggccgacgccgaggacgaggacgaagagatgcccacgcgcaaccacaacgctgccgcggatgccgctccgcagcatcaccatcacaaccgaggtggtgctcccgctcttgccaacagcaaagccgtgcccggacgagctgatgccatgaaccggcgagcccccctcggcgatattggcaacctcgtcagcgtccgcccagacgaacggaaacctcagctgctcgagcagatcaagcgccgcatcacgcgaagcttcggcgctcagctcgtgaagaacgtgcatgcgaatgcctcaatcaagaatgccgcaatcctacccgcgaggcatgctccgaggcaagaaaggaaggctcctgccaagcagtcgccttctgaggatgtcatagtactcagcttctactctgnacgacacatgacgcagatg

SEQ ID NO: 70460 - protein, 132 aa, Zea mays
  misc_feature: Ceres CLONE 1550302
  misc_feature (126)..(126): Xaa is any aa, unknown, or other
MPTRNHNAAADAAPQHHHHNRGGAPALANSKAVPGRADAMNRRAPLGDIGNLVSVRPDERKPQLLEQIKRRITRSFGAQLVKNVHANASIKNAAILPARHAPRQERKAPAKQSPSEDVIVLSFYSXRHMTQM

SEQ ID NO: 70461 - DNA, 681 bp, Zea mays
  misc_feature: Ceres CLONE 1550303
  misc_feature: Translation starting site: 352
  misc_feature (517)..(517): n is a, c, t, g, unknown, or other
ggagctccccgcggtggcggccgctctagaactagtggatcccccgggctgcaggaattcgtctcacccctagaaaaatccgctctcatcccacccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggtaagcgagagccctcctgcttggggcgtagatttccggcggccatggggggcgccgtgatggtcgccatcgcggcctctatcggcaacttgctgcacggctgggacaatgcgacaattgctggagccgtcctgtacataaagaacgaatcgacctgcagagcgagcctctgatcgaggggctcatcgtcggcatgtccctcataggggncacagtcatcacgacgttctctggggcagcggccgactgcgttaggatggaggcccatgctgagtcgcctcggcttgtcctctacttcgtcagggggcctggggaatgctcctggggcgccaagggtgttccatcttggctcctcctaaagctcccattgaagg

SEQ ID NO: 70462 - DNA, 717 bp, Zea mays
  misc_feature: Ceres CLONE 1550304
  misc_feature: Encodes the peptide sequence at SEQ ID NO. 70463
ggagctccccgcggtggcggccgctctagaactagtggatcccccgggctgcaggaattcgtctcacccctagaaaaaatctacatcctctcgcaattccccatcgtcttctacccttctgtcctccgatccccaccctccggttaactcctcaccaagaaaaaggaaccggccgtcctcgttcctgtcgtcgctgttctttcctcgccattaccggcgtataaaaccagccctcggcctgatcacacagcatccggccaagcgggactagtccctgtcgtctgtccaccaccctctgcgagtacgtctcctcctcccgtctgtctctctctgtgtgtcggtctgccgttcccgccgccgccgccgcagatgggcctgttcagctcgccggccaaggtgtacaagccggccgccgacgtggacctcggccccggcagcgacgagctctacatcagccccaatgtcaaagctcctcgggtcgccgggctcctggtgaagatcttcgtgtggatcctggagatgcccatcgtcgggcagatcgtgctctacatcctgaagaagacaacctcatcaacaagctggtgtccgacgccgacatcccggagccgccgctgttcacggcatcgcacagctgggaagacacccggagcagagcgtgcggctgaccaagcccgaactgtcggcggcggatcggggtcaggatgccgtgggctgccc

SEQ ID NO: 70463 - protein, 116 aa, Zea mays
  misc_feature: Ceres CLONE 1550304
MGLFSSPAKVYKPAADVDLGPGSDELYISPNVKAPRVAGLLVKIFVWILEMPIVGQIVLYILKKTTSSTSWCPTPTSRSRRCSRHRTAGKTPGAERAADQARTVGGGSGSGCRGLP

SEQ ID NO: 70464 - DNA, 711 bp, Zea mays
  misc_feature: Ceres CLONE 1550305
  misc_feature: Encodes the peptide sequence at SEQ ID NO. 70465
  misc_feature (711)..(711): n is a, c, t, g, unknown, or other
ctccccgcggtggcggccgctctagaactagtggatcccccgggctgcaggaattcgtctcacccctagaaaaaaaccgcgcccccacaccccgctcctctcgctcctcgctcccttttcaccttccccttcgcaggctccccctcccgtgccgtgctctctcaacaagggagaaggggaaaccaccaccaccaccacacttgataagaagggggccgcacgcgcctgcccgctcccgccgctacgccatggacgcctgggaggccaccaaggcggtgttcgaccgggtgcgggcgctggacccggacaacgcgtccaagatcatgggcctgctgctcatccaggacaacagcgacaaggagctcatccgcctcgccttcggccccgaccacctcctccacgccttcgtctccgccgcgcgcgccgacctcgccgccaagcccgcgtccccgccgtcgcccgtgctgggcccgctccaccagacctggggagcgccgccgcacccgagccctaccgctggctccgaacaccaacaccaggccccctttcgccgcgacctcgcgctcggctacgacttccacggcgccggcgccggcgctgacgctttcttcccgacgactacgactgctgggtcacggccggcgccgcccaccgccgcagcttctcccttcacgacgccgagggcaccggcggcggcccccgagggcctgn

SEQ ID NO: 70465 - protein, 154 aa, Zea mays
  misc_feature: Ceres CLONE 1550305
MDAWEATKAVFDRVRALDPDNASKIMGLLLIQDNSDKELIRLAFGPDHLLHAFVSAARADLAAKPASPPSPVLGPLHQTWGAPPHPSPTAGSEHQHQAPFRRDLALGYDFHGAGAGADAFFPTTTTAGSRPAPPTAAASPFTTPRAPAAAPEGL

SEQ ID NO: 70466 - DNA, 728 bp, Zea mays
  misc_feature: Ceres CLONE 1550307
  misc_feature: Encodes the peptide sequence at SEQ ID NO. 70467
  misc_feature (578)..(578): n is a, c, t, g, unknown, or other
agcaacagtcgccgcctcgcagccgtccaaccagtacttcattatcccccgggctgcaggaattcgtctcacccctagaaaaaaagttggactgggaagtttccagttaagaacaagcaaggacatagattttcagctgttgccaccaatactcctttctatgatgaagatggcagtttgatgggtttcatttgtgtttcaagtgattcccgccaattggagcagatattttgacagcctccgacctctgcgaggtcgcagtcagaatcatctatgacatcttgtgatgggagttgcagcaacactactcacacaatcaattccctgaatagaagttcttttgattctaatctacccctgcacagcactttaacatccaagataacgaatttggctaccaaggtcacatataaagtgcgttctcgggtcatgacagaccagaatggcaatcgcggcagtggtgagagccattgcttggatcgaggcgcaaaggacgagcctacatctagtggaacaagcacaccaagaggggatgcaccacatggtccctttgctacagatcagaactcacctgggangtcatcgtacccaagcagcgactaatcagagcgaaaagtacgtctgctcaagattttgggttctaaggcagaggcactagtgcacaagaaatggatatcatggtcgtgcacacggcgctagaatgagggacttgatgtaagagaccatgg

SEQ ID NO: 70467 - protein, 59 aa, Zea mays
  misc_feature: Ceres CLONE 1550307
ATVAASQPSNQYFIIPRAAGIRLTPRKKVGLGSFQLRTSKDIDFQLLPPILLSMMKMAV

SEQ ID NO: 70468 - DNA, 716 bp, Zea mays
  misc_feature: Ceres CLONE 1550309
  misc_feature: Encodes the peptide sequence at SEQ ID NO. 70469
ccccgcggtggcggccgctctattctagtggatcccccgggctgcaggaattcgtctcacccctagaaaactcttcgcttctaactccgctgggccaccagctttgaccgccgcctcccttcccctccgctactgctcctccccaccccactcccccgcaggagcggcggcggcggcggcgaggtcgtaccccacatcggcgagcggcggcggcaccgccggaggcaaaggcaagatgttcgggcgcgcgccgaagaagagcgacaacaccaagtactacgagatcctcggggtgcccaagtcggcgtcccaggacgatctcaagaaggcctaccgcaaggctgctatcaagaaccaccccgacaagggcggtgaccccgagaagttcaaggagctcgcacacccctatgaggttttgagtgatccagagaaacgtgagatttatgatcagtatggtgaagatgcccttaaggaaggaatgggcggtggaggatcccatgttgatccatttgacatcttctcatcattttttggaccctcttttggaggaggtggtgggaagcagcaggggaagaaaggcaagggaggggagaagatgtagttcacccacttaaagtttcccctggaagatctttacaatggcaccttcaaagaaagctctctcttttcgcgcgaatgtcttctgctcccaagtgcagggggcaagggcttcgaag

SEQ ID NO: 70469 - protein, 121 aa, Zea mays
  misc_feature: Ceres CLONE 1550309
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAHPYEVLSDPEKREIYDQYGEDALKEGMGGGGSHVDPFDIFSSFFGPSFGGGGGKQQGKKGKGGEKM

SEQ ID NO: 70470 - DNA, 713 bp, Zea mays
  misc_feature: Ceres CLONE 1550310
  misc_feature: Encodes the peptide sequence at SEQ ID NO. 70471
ctccccgcggtggcggccgctctagaactagtggatcccccgggctgcaggaattcgtctcacccctagaaaaagacgcagcacggcgcgccggcgcgggacgacggcatgacgacggcgtgcatctttgacaccatcgctgcctcgtctccctcccctccgcttccacgacctggacctcgtcccgtcgtctcatccatcaactcgcgaaacccacagtcctgtccctacatctgcgtccagtcttatcctcttccttcgcggttgccgccgtctgcgacgacgaggatgtcgtagtcggggattgcctcgtgttcgacgacgacgctctcgaggaaccggacctggacctcccctcgtccccgtggccgtcggctagtgcctcacgccacggccggaggtcggaggcaggcgagagcgactatctggtgccggatatgtggacgcatgccgacgacgagatcatcctgacgaagatggatagcgtcgcatcgcgcacgggctgcggttcaggagcccgctcgagcggcgggcgccaccagctggtgctgctcctgatgatttcgggcgtaccgcaagggatgctgagcgctgaacgtgacatggttctcaatgtaaccggggtccgctggaaaggactccccgccggaagtgaagaacttcaacgcccgaaccggaaccgggaacctgggggccccaagaaccccaggagg

SEQ ID NO: 70471 - protein, 92 aa, Zea mays
  misc_feature: Ceres CLONE 1550310
MWTHADDEIILTKMDSVASRTGCGSGARSSGGRHQLVLLLMISGVPQGMLSAERDMVLNVTGVRWKGLPAGSEELQRPNRNREPGGPKNPRR

SEQ ID NO: 70472 - DNA, 746 bp, Zea mays
  misc_feature: Ceres CLONE 1550312
  misc_feature: Encodes the peptide sequence at SEQ ID NO. 70473
  misc_feature (540)..(540): n is a, c, t, g, unknown, or other
aacctggagctcaccgcggtggcggccgctctagaactagtggatcccccgggctgcaggaattcgtctcacccctagaaaaaaaaaccaaatactctgtgtgcgtacgcgcggcagtgagcgacgaggcgcggtgcgcgcgcactggccatgagccggggccgcgcacgccggccggttccaggcagcgtgccccgccgcggccgtggaggcagaggcaggggacgaggaggcggtggactacggcgctgcgctgtccaagagcctgctctacttcgaggcgcagcggtcggggcggctgccgcacaaccagcgcgtgccgtggcggggccactcgggcctcaccgacgggctgcagcagggcgtggacctggtcggcggctactacgacgccgggaaccacgtcaagttcggcctgcccatggccttcaccgtcaccatgctctcctggggcggcatcgacttcgccgacgacgtcgcggcccgccggcgagtggggcccacccgctcgagggccctcaggtggggccccgactactncgtcaaaggcgcacccccgagccatttcgtctactgggcagaagggggggctacgggcaacccggaacccctttcttggttggcagggggcccggagggaacgttaccgaccgtcccgggcgggggttcccccctttcccaaaggggacggcccggggacaaaacttttctttggtgcgcccctctttgggcttgtgccctgcccg

SEQ ID NO: 70473 - protein, 108 aa, Zea mays
  misc_feature: Ceres CLONE 1550312
  misc_feature: SWISSPROT Homolog: EC 3.2.1.4 Cellulase
  misc_feature (40)..(40): Xaa is any aa, unknown, or other
MAFTVTMLSWGGIDFADDVAARRRVGPTRSRALRWGPDYXVKGAPPSHFVYWAEGGATGNPEPLSWLAGGPEGTLPTVPGGGSPLSQRGRPGDKTFLWCAPLWACALP

SEQ ID NO: 70474 - DNA, 717 bp, Zea mays
  misc_feature: Ceres CLONE 1550317
  misc_feature: Encodes the peptide sequence at SEQ ID NO. 70475
  misc_feature (327)..(327): n is a, c, t, g, unknown, or other
  misc_feature (409)..(409): n is a, c, t, g, unknown, or other
  misc_feature (452)..(452): n is a, c, t, g, unknown, or other
acgctggagctccccgcggtggcggccgctctagaactagtggatcccccgggctgcaggaattcgtctcacccctagaaaaaggactaggagtccagtagcctgctagctatctatcagtgatccctcgcgaacgatgtgggacgggctggagagcgcggcgaccgtggcgcagctggtcggtctcgacgtcggcggcctcatcaccatgatcgggcaggcggcgcggaaggctcggcagaacaccaaggactgcgagcacctagcccgccgcgtcggcatgctcgcggagctggtcccccacctgcaggacccggaatgcatgcnggcggtgcgcgggctcagagatgcgctcgtggaggactcacagctcatcgcatcctggcagaggagggcgctcacgtcccanctgttctcggcgtccaggcatgccgacagttcacgggacgtcnagcgcaagatcgaaacctgcgtcaccctcatccctgtcatccgctacatcggcataacaagacgcctcgatggttccgcaatcccgtccccaacctgtcggcgggaaggggcctgagatccgggatttcacgccggcggaaaatccccggggccaccaaaaatttggccgtcgtggctagaaagaccccaacctggggcccaggggttccaggggaaggcccctcgcaaaaggggccaagggggcccttaaaccccctaacccgc

SEQ ID NO: 70475 - protein, 143 aa, Zea mays
  misc_feature: Ceres CLONE 1550317
  misc_feature (64)..(64): Xaa is any aa, unknown, or other
  misc_feature (91)..(91): Xaa is any aa, unknown, or other
  misc_feature (106)..(106): Xaa is any aa, unknown, or other
MWDGLESAATVAQLVGLDVGGLITMIGQAARKARQNTKDCEHLARRVGMLAELVPHLQDPECMXAVRGLRDALVEDSQLIASWQRRALTSXLFSASRHADSSRDVXRKIETCVTLIPVIRYIGITRRLDGSAIPSPTCRREGA

SEQ ID NO: 70476 - DNA, 720 bp, Zea mays
  misc_feature: Ceres CLONE 1550321
  misc_feature: Encodes the peptide sequence at SEQ ID NO. 70477
ggagctgcccgcggtggcggccgctctagaactagtggatcccccgggctgcaggaattcgtctcacccctagagaaacccctagagaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgccgccgcaacagcaaactcaagaaaggtggcttcgccgacgaaggctccgccaccaccgagtccgacatcgaggagacgctcaagcgcctcgtgtccgaagtcggcaagtcccccgagggaggtgtcgaggcgctcaagaacagaccgtcgacctcgtcttcaccgcgcatcccacgcagtccgcccgcc

SEQ ID NO: 70477 - protein, 183 aa, Zea mays
  misc_feature: Ceres CLONE 1550321
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNSKLKKGGFADEGSATTESDIEETLKRLVSEVGKSPEGGVEALKNRPSTSSSPRIPRSPPA

SEQ ID NO: 70478 - DNA, 748 bp, Zea mays
  misc_feature: Ceres CLONE 1550325
  misc_feature: Encodes the peptide sequence at SEQ ID NO. 70479
  misc_feature (1)..(1): n is a, c, t, g, unknown, or other
  misc_feature (402)..(402): n is a, c, t, g, unknown, or other
naaggctggagtcaccgcggtggcggccgctctagactagtggatccccgggctgcaggaattcgtctcacccctagggaaacacaccaccgccgctcaccaacaaccgagcaggagcagcctaccccatccactcacccccatctctgcgctgcacggctgctgctggtgctggtccggccggtccggtccggtctcctctgttccagcgagctccctccgatccatcgggtaggacactccccatggcgtcgcacaacggcaccaagcacctggcgccgatggaggcgtcggtggaggccgggaacggcggcggccccaagtggctggacgacgacgggcggccccggctcacgtgcccctcctggacggcaggggggggggtgatcccggccttaaccncctccccccccctgtccctgggcttgggccttcccccacctgggctggggggggccggccccccccccatggcggctttcccctttggtgccctaattaccccccccccgtgttccccaagtggttcccgacggggggaccccgaaaccggggaaagaccgaaaaaccttttactggtaacacggggggcgccccaccctaggggggcccaagggagcctttttgatgggcgccttacgaacacccacagcgggagggcggggccatcatggggtcacccacctcggccaacacaaaaaatagattggtcagatatagggcgctgcgtgggaccctcagaatgggt

SEQ ID NO: 70479 - protein, 167 aa, Zea mays
  misc_feature: Ceres CLONE 1550325
  misc_feature (53)..(53): Xaa is any aa, unknown, or other
MASHNGTKHLAPMEASVEAGNGGGPKWLDDDGRPRLTCPSWTAGGGVIPALTXSPPLSLGLGLPPPGLGGAGPPPMAAFPFGALITPPPCSPSGSRRGDPETGERPKNLLLVTRGAPHPRGAQGSLFDGRLTNTHSGRAGPSWGHPPRPTQKIDWSDIGRCVGPSEW

SEQ ID NO: 70480 - DNA, 780 bp, Zea mays
  misc_feature: Ceres CLONE 1550326
  misc_feature (406)..(406): n is a, c, t, g, unknown, or other
  misc_feature (431)..(431): n is a, c, t, g, unknown, or other
  misc_feature (438)..(438): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (606)..(606): n is a, c, t, g, unknown, or other
  misc_feature (714)..(714): n is a, c, t, g, unknown, or other
  misc_feature (715)..(715): n is a, c, t, g, unknown, or other
  misc_feature (716)..(716): n is a, c, t, g, unknown, or other
  misc_feature (718)..(718): n is a, c, t, g, unknown, or other
  misc_feature (719)..(719): n is a, c, t, g, unknown, or other
  misc_feature (730)..(730): n is a, c, t, g, unknown, or other
  misc_feature (742)..(742): n is a, c, t, g, unknown, or other
gagctccccgcggtggcggccgctctagaactagtggatcccccgggctgcaggaattcgtctcacccctagaaaaactctccgctctgctccctccgccgtgcgctcgaacaaactccacacgaaattctccgcgtaaagttggggagcaactaacccgtagcgcgcgccccggatccctctacggggggcaatggcctcgtcggcgttcctgcccgagctgggcacgctggtggtggtgcccctcgcgcgcgtgctaggcagcggcgtcgcggtgttcccgggggtgctgggcgccagggggaagttttttctggcgaggctggtcggcgggcacgggtcctcccggtatttattcccccccccgccggggggggggggggggggctccaccaactaacaaatnaatcgcccccccccagcacgagccncccttgntgtagtcagtgccgcaaggtccgccaggccgtgtcacctgaatggcgccgaggggtgtttcagttcattannnactggtatcccgcggatcgcggctgcttcatttcagtgggacctttgctcgcgaaggcaggggtgcaatgcccctgtgccccgctgctttgatancgaggctttaaaggcagccagcaaccccactcttacactacccctgtctgttagcgcgcggggcccggcgcaacaaagcctcccgctacctaaccaccgcctcccacnnncnnatttccagtcnccttgtgcgttnccctcgaccgtgactagcggggtcccggcccaccttcc

SEQ ID NO: 70481 - DNA, 750 bp, Zea mays
  misc_feature: Ceres CLONE 1550327
  misc_feature: Encodes the peptide sequence at SEQ ID NO. 70482
  misc_feature (364)..(364): n is a, c, t, g, unknown, or other
  misc_feature (366)..(366): n is a, c, t, g, unknown, or other
ccactggagctcaccgcggtggcggccgctctagaactagtggatcccccgggctgcaggaattcgtctcacccctagaaaaaccaccggcgagccacatcgagaacacgatcgagcacacaagcacgaagactcgtttaggagaaaccacaaaccaccaagccgtgcaagcatcatggagtacggtcagcaggggcagcgcggccacggcgccacgggccatgtcgaccagtacggcaacccagtcggcggcgtcgagcacggcaccggcggcatgaggcacggcacgggaaccaccggcggcatgggccagctgggtgagcacggcggcgctggcatgggtggcgggcagttccagcctgcnanggaggagcacaagaccgggcgcatcctgcatcgctccccccccgccgggtccagttcgtcggaggacgacggcatgggcggaaggaggaagagggaatcaaggagaagattcaagagaagctgccccgaagccacaaggacgactagcccgcccccggcgacgaccgggcggcgcctatgggaagcagggaccacacgggcagcgccttacgggcagcagggacaccccggggggtgcccaagcccacccggcaccgagggcaccgggcaaaaaaaaagggctttttggacaagattcagggagaaacctgccggggaacgcccttgaccggcgcctctccttgggtggtgctggggcttgggcggggccgtttaatcccgttt

SEQ ID NO: 70482 - protein, 172 aa, Zea mays
  misc_feature: Ceres CLONE 1550327
  misc_feature (14)..(155): Pfam Name: Dehydrin Pfam Description: Dehydrin
  misc_feature (64)..(64): Xaa is any aa, unknown, or other
MEYGQQGQRGHGATGHVDQYGNPVGGVEHGTGGMRHGTGTTGGMGQLGEHGGAGMGGGQFQPAXEEHKTGRILHRSPPAGSSSSEDDGMGGRRKRESRRRFKRSCPEATRTTSPPPATTGRRLWEAGTTRAAPYGQQGHPGGCPSPPGTEGTGQKKRAFWTRFREKPAGERP

SEQ ID NO: 70483 - DNA, 719 bp, Zea mays
  misc_feature: Ceres CLONE 1550330
  misc_feature: Encodes the peptide sequence at SEQ ID NO. 70484
  misc_feature (554)..(554): n is a, c, t, g, unknown, or other
  misc_feature (578)..(578): n is a, c, t, g, unknown, or other
tccccgcggtggcggccgctctagaactagtggatcccccgggctgcaggaattcgtctcacccctagaaaaaggacgcttcgctctagtcggaaggtttcgaggaactcccgggctcgaggagatcgggacgatgatgggagggcgcgctctgctgctgctcctggtctcggcgctgctcgttcagatccgcgcctctgacccgctgctgtacgagccgtttgatgaggacttcgagggtagatggatcgtctccaagaaggatgaataccaaggtgtatggaagcatgccaagagtgatgggcatgaggactatggcctccttgttagtgacaaggcaaggaaatacgccataatcaaggagcttgatgagccagttaccttaaatgatgggacagtggtcctgcagtttgaagtgagacttcagaatggccttgaatgtggaggtgcctacattaagtacatccgccctcaggatgctggatgggatgccaaggagtttgataatgagactccatacactattatgtttggtccagataaatgtgggtcanccaacaaggttcatttcatccttnagcacaagaatccctagactggaaagtatgttgagcatcacctcaaattcccactttctgtcccatacgacaagctctctcatgtctacacagctatcttggaagcagacaatgaagtcagatttttgatcgatggggaaa

SEQ ID NO: 70484 - protein, 153 aa, Zea mays
  misc_feature: Ceres CLONE 1550330
  misc_feature (24)..(154): Pfam Name: Calreticulin Pfam Description: Calreticulin family
  misc_feature (141)..(141): Xaa is any aa, unknown, or other
  misc_feature (149)..(149): Xaa is any aa, unknown, or other
MMGGRALLLLLVSALLVQIRASDPLLYEPFDEDFEGRWIVSKKDEYQGVWKHAKSDGHEDYGLLVSDKARKYAIIKELDEPVTLNDGTVVLQFEVRLQNGLECGGAYIKYIRPQDAGWDAKEFDNETPYTIMFGPDKCGSXNKVHFILXHKNP

SEQ ID NO: 70485 - DNA, 706 bp, Zea mays
  misc_feature: Ceres CLONE 1550332
  misc_feature: Encodes the peptide sequence at SEQ ID NO. 70486
  misc_feature (25)..(25): n is a, c, t, g, unknown, or other
ctccccgcggtgggggccggtctanaactagtggatcccccgggctgcaggaattcgtctcgcccctagaaaaaagccgcccgtcgataactaaccgcgcagcggcggacgacgagagcacaggcatgagagcctacgcggcgaccccggccgccgtggccacgctgccgtcggccgcgccgccgctcacacccgacgccgctgccgtgctgtcccgcgccgcggccgacgcgtccaggcgccgccacgcgcacaccacgccgctccacgcggcggccgcgctgctgtccggccccgcgccgctgctccgtgacgcctgcgtcgcgggcctcgcgtccccgcacccgctccgctgccgcgctctcgacctctgcttctccgtcgccctcgaccgcctccccacgtccacggagctccagcaccacgaaggcggcgccttccaccacgcatccgccgcgcctccgctctccaacgcgctcgccgcggcgctcaagcgcgcctacgcgcaccaccgccgcatcgggagcggcggcgtcgagaccgacgaccaccgcgtcggggtgccgcacctcgtgctcgccatcctcgacgacccgtccgtggcgcgcgtcatgcgcgaggcgtccttctccagcacggccgtcaaggccgccatgctcaggtccctctgcgacccggcggcacccgacgccgccgcgtacgtcag

SEQ ID NO: 70486 - protein, 193 aa, Zea mays
  misc_feature: Ceres CLONE 1550332
MRAYAATPAAVATLPSAAPPLTPDAAAVLSRAAADASRRRHAHTTPLHAAAALLSGPAPLLRDACVAGLASPHPLRCRALDLCFSVALDRLPTSTELQHHEGGAFHHASAAPPLSNALAAALKRAYAHHRRIGSGGVETDDHRVGVPHLVLAILDDPSVARVMREASFSSTAVKAAMLRSLCDPAAPDAAAYV

SEQ ID NO: 70487 - DNA, 710 bp, Zea mays
  misc_feature: Ceres CLONE 1550335
  misc_feature: Encodes the peptide sequence at SEQ ID NO. 70488
agctccccgcggtggcggccgctctagaactagtggatcccccgggctgcaggaattcgtctcacccctagaaaaaactactttgagctgcaaggtccgaactaaaaagcacaagaaatggcggccgccttctcctccaccgtcggagctccggcctccaccccgaccaggagcagcttcctcgggaagaagctcaacaagccgcaggtgtccgcggccgtgacctaccatggcaagagctccagcagcaacagcaggttcaaggcgatggctgccaaggaggtggacgagacgaagcagaccgacgaggacaggtggaagggcctggcctacgacatctcggacgaccagcaggacatcaccaggggcaagggcctcgtcgacaacctcttccaggcgcctatgggggacggcacccacgtcgccgtgctcagctcctacgactacatcagccagggccaaaagtcttacaactttcgacacatgatggatgggctctacatagccaagggcttcatggacaagctcgtcgtccacctctccaagaacttcatgaccctgccaaacatcgaggttcccctcatcctgggtatctggggaggcaaagggcagggaaaatcgttccaatggggagctggttcttccccaaaatgggcatcacccccttcatgaataagcccccggcaacctggaaaaacggcaccccccgt

SEQ ID NO: 70488 - protein, 184 aa, Zea mays
  misc_feature: Ceres CLONE 1550335
MAAAFSSTVGAPASTPTRSSFLGKKLNKPQVSAAVTYHGKSSSSNSRFKAMAAKEVDETKQTDEDRWKGLAYDISDDQQDITRGKGLVDNLFQAPMGDGTHVAVLSSYDYISQGQKSYNFRHMMDGLYIAKGFMDKLVVHLSKNFMTLPNIEVPLILGIWGGKGQGKSFQWGAGSSPKWASPPS

SEQ ID NO: 70489 - DNA, 624 bp, Zea mays
  misc_feature: Ceres CLONE 1550342
  misc_feature: Encodes the peptide sequence at SEQ ID NO. 70490
  misc_feature (435)..(435): n is a, c, t, g, unknown, or other
  misc_feature (614)..(614): n is a, c, t, g, unknown, or other
ctccccgcggtggcggccgctctagaactagtggatcccccgggctgcaggaattcgtctcacccctagaaaaagcctaccccgtccctccccaagcgcgccgtctagggtttcacagccgtgccccgatccattcgagcgccccgcaccgccgccatggagtttgacgaatacgagtacttggagaaggcggtagagcccgctcccccacaggccaatggttccggctccggctccggcgagaaggaccgcggctcgcgccgccgcgagggcggcgaggaccgcatatcgaagcgctctcgctcgggggaggaccgcgaccgggacaggcaccgcagcggccgggagcacccgtgaccggggaacaagggtttaacccttttaggggggggggggggggcccccccaaaaaaacccccccccggtgaaaaaaanggggtgttgggggggggggggggaaaaaacccgcaggaaaagagaagggggggggggggttccccccccccccccccctccctttttaaaaaaaaaagggagggggtggtgttttttgggggcgcggggagcagaagattagggggagggagggggggttccttcttttgtgtgggggntcgcggcgcc

SEQ ID NO: 70490 - protein, 66 aa, Zea mays
  misc_feature: Ceres CLONE 1550342
MEFDEYEYLEKAVEPAPPQANGSGSGSGEKDRGSRRREGGEDRISKRSRSGEDRDRDRHRSGREHP

SEQ ID NO: 70491 - DNA, 833 bp, Zea mays
  misc_feature: Ceres CLONE 1550342-R
tggggtactcgagcgtctcgtttttttttttttttttggtcccgcatcattttttatatatatacatggtaacagacagtaggcacgacagccagtccacgtggcatggcagggtaactgctgagacgcacacgctccacatactagatagttcatcgacaccgcagacacgacagatataaggaagaaacctaacacgaagagttcaccataagcaagctctgagacgcaccagggctgcaccgcagtggcacagccgtctcattatttacgaatatatacttagatagcacacgatcttcacttgtccttcttctccctggcaatgagctccatcacagctcgcttgatgcttccctcattcttcgcaagcagctccttgttcatctctgtggcatcaatcccatctcttccagctctggaaggagaggatcccattcattgacgccacataggtcatcgacagactgctccaaaattggaattggtctgcccgaagatttcccctgggttgaaatcagaccctggcctaaaaaccccatttccctccagctcccctcaggaaatttccccctcattgggggaaactcccggttctgaaaagctccggggccccccggcccttaacggggggggggggacccccaaaagggcccccggatgaaagccccggggggaatttggggggaaacaaaaaacgggggggctgaaaaaagggggtttagttggggagggcaaaaaaagggggtaaaaaggggggaagggggtgttttaattttttaacccaccttctctggcgccttgggggccccttttatacgaaggggggaaaa

SEQ ID NO: 70492 - DNA, 819 bp, Zea mays
  misc_feature: Ceres CLONE 1550344
  misc_feature: Encodes the peptide sequence at SEQ ID NO. 70493
  misc_feature (787)..(787): n is a, c, t, g, unknown, or other
tggagctcaccgcggtggcggccgctctagaactagtggatcccccgggctgcaggaattcgtctcacccctagaaaaaagctcagcactgcacgactcctcccccatctaccactacctgtatacctacccagcccatcgatcacccctcgcaacgcaatggcgctggccaccaactccgccgctgccgcagcagctgccgtatccggcggcgcggcatcccagccgcaccgcgcggccacgttcctcccgctgaagaggcgcaccatctccgccatccacgccgccgacccgtctaagaacaacgggcccgccgtccccgcggccgccgccgctaagtcatctgcctctgcggtggccacgccgggagaagaatccggcggcgcccggtaaagtggccccccccccacccccgaagtcgaaaaaaggggcctgcagcttcccagaagtaccccgaaaccagggaagaagctgggaccccggggcctcaaaaacccatcgaagacgtttccccccccgggggggggtttccccccggaaaaaggccgcggccccccttccaaggatacgccatgggccctaatggccgcccaatgggtcccgggccccttcattacccccacaggggagggtgaactgcgaccgctaataccttttcgagggatgtttccaggccccaaaagaaaaatcccggggaaccccccttcccagtttcccgtgcttcccaaagtggagcacctcggtgcccacttttctccgagggtgttacccgacgatctgctacccncaattgtcgtgccaaagaattctactctccac

SEQ ID NO: 70493 - protein, 77 aa, Zea mays
  misc_feature: Ceres CLONE 1550344
  misc_feature: SWISSPROT Homolog: EC 2.5.1.54 3-deoxy-7-phosphoheptulonate synthase
MALATNSAAAAAAAVSGGAASQPHRAATFLPLKRRTISAIHAADPSKNNGPAVPAAAAAKSSASAVATPGEESGGAR

SEQ ID NO: 70494 - DNA, 597 bp, Zea mays
  misc_feature: Ceres CLONE 1550346
  misc_feature: Encodes the peptide sequence at SEQ ID NO. 70495
  misc_feature (508)..(508): n is a, c, t, g, unknown, or other
  misc_feature (531)..(531): n is a, c, t, g, unknown, or other
ctccccgcggtggcggccgctctagaactagtggatcccccgggctgcaggaattcgtctcacccctagaaaaaagacacgcttccgcggcgccaccaccttccgccctccgctgcccgctcgcctccgcgcccgaaaggcaaagcctcctcgctcctgccccgccccctcctcgcggcgtcggtcaaaccctagcacaccgtacgcgcaggcccgcccgctcccattccccacctccacccatggcggcgctctccgcgcccctccgcgccgtcgccgccggatcccgcgtcgccgcgtccgaccccgtcaaggtctcgtgcgtgaggagcactggctcagctcacttcggctgcgccttcccctacatcagggcctcctcttcggctgcgaggaacctcgagccgctgagggcgatagccacgcaggcgccccctgccatgccacaatattcgagtggggagaagacaaagattggcatcaacgggtttggggcggattggcaggnttggtcctgcgaatttgcaccangcagagatgatatttgaagttgtgggctgtgaaatgacccctttcatttgatggctagtacatggc

SEQ ID NO: 70495 - protein, 101 aa, Zea mays
  misc_feature: Ceres CLONE 1550346
  misc_feature (89)..(89): Xaa is any aa, unknown, or other
  misc_feature (97)..(97): Xaa is any aa, unknown, or other
MAALSAPLRAVAAGSRVAASDPVKVSCVRSTGSAHFGCAFPYIRASSSAARNLEPLRAIATQAPPAMPQYSSGEKTKIGINGFGADWQXWSCEFAPXRDDI

SEQ ID NO: 70496 - DNA, 648 bp, Zea mays
  misc_feature: Ceres CLONE 1550347
  misc_feature: Translation starting site: 385
  misc_feature (545)..(545): n is a, c, t, g, unknown, or other
  misc_feature (546)..(546): n is a, c, t, g, unknown, or other
  misc_feature (585)..(585): n is a, c, t, g, unknown, or other
  misc_feature (606)..(606): n is a, c, t, g, unknown, or other
  misc_feature (607)..(607): n is a, c, t, g, unknown, or other
  misc_feature (630)..(630): n is a, c, t, g, unknown, or other
  misc_feature (631)..(631): n is a, c, t, g, unknown, or other
tggagctccccgcggtggcggccgctctagaactagtggatcccccgggctgcaggaattcgtctcacccctagaaaaagccagcatctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggaacacgtgtcggcggcgcacgcggccggggcggggctcgtcgacgggggccttcgtcggcgcccacgccggcgaggccaagnnagcacacgtcttcaccttcggcacgctccgggactgccnggtccctgtgcctgtccggtnncagctgtggtggatgacccaacnngaatgggcgtctccggc

SEQ ID NO: 70497 - DNA, 669 bp, Zea mays
  misc_feature: Ceres CLONE 1550349
tacccgcggtggcggccgctctagaactagtggatcccccgggctgcaggaattcgtctcacccctagaaaaaaaaaaaaaaaaaaaaaaaaaaaaaaaaaaaatcaccggagacgtagcggaccagcagccggacggccgtataaaacataccaaggccgcctcgctcgctcagcatacggaggcagccgccggtaagccgcgcgcgcgtgcagtcacccatccgtccgtccgtccgtccgtcgtccgccgtccaccgccagcgcgcgctcgccaccgcacccagctagcagcacaagaaaagtctggtggcgtcggcggcggcggcggcggccggcttgccacagtccaatccttggaccggccaaaaagcagttgaaggcgcgagcgagcaagctagcgcgcccttcgtcgctacgagcctacgacgcgcgatcgagccgggcattgctgatacaccgtgagtaggcgtgatggtgcttgataccccgttttcgtgcagcttgttgctaattcgttttagtttgagggatcaagaaccaccttgttctttctttctttctttcttggaacaattatgatgaatcattgcaaatctcttgaatatatttttcactgtaaaatactgccttgcctttgagctccttggttcacgtgcaatgtttcttt

SEQ ID NO: 70498 - DNA, 624 bp, Zea mays
  misc_feature: Ceres CLONE 1550350
  misc_feature: Encodes the peptide sequence at SEQ ID NO. 70499
  misc_feature (571)..(571): n is a, c, t, g, unknown, or other
agctccccgcggtggcggccgctctagaactagtggatcccccgggctgcaggaattcgtctcacccctagaaaaactctcgtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttgggatgctgcgagagcattggaagtgctgaaacttgctgctnctaacaacaagcctatccgggtgatggtatcaaacggtgatccaagcagccgc

SEQ ID NO: 70499 - protein, 99 aa, Zea mays
  misc_feature: Ceres CLONE 1550350
  misc_feature (36)..(101): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLGCCESIGSAETCC

SEQ ID NO: 70500 - DNA, 602 bp, Zea mays
  misc_feature: Ceres CLONE 1550351
  misc_feature: Encodes the peptide sequence at SEQ ID NO. 70501
tccccgcggtggcggccgctctagaactagtggatcccccgggctgcaggaattcgtctcacccctagaaaaacccgtcagccactcctctatcggtgacgcacgcaccccccacctctgatctgatctctccccctggatctcgacctccgcctggctgctccgctctgcgtcgctcgccatggcgtcctcgacggggagcttggagcacggcgggttcacgttcacgccgccgcccttcatcacctcgttcacggagctgctctctggggcagcagcggacatggtaggagccgcgggcgccgatcatcaggagcggtcgccgagggggctgttccaccgcggcgccaccaggggcggcggcgtaggcgtgcccaagttcaagtccgcgcagccgcccagcctgcccatctcgccgccgccgatgtcgccctcctcctacttctccatcccgcccgggctcagccccgccgagttgctggactcgcccgtcctgctccactcttcctcgaacttcttcgcgtcgcccaccaccggcgccatcccggcgcagaggttcgactggaagcaggcccgccgacctgatcgcgtctcaatctcag

SEQ ID NO: 70501 - protein, 140 aa, Zea mays
  misc_feature: Ceres CLONE 1550351
MASSTGSLEHGGFTFTPPPFITSFTELLSGAAADMVGAAGADHQERSPRGLFHRGATRGGGVGVPKFKSAQPPSLPISPPPMSPSSYFSIPPGLSPAELLDSPVLLHSSSNFFASPTTGAIPAQRFDWKQARRPDRVSIS

SEQ ID NO: 70502 - DNA, 620 bp, Zea mays
  misc_feature: Ceres CLONE 1550352
  misc_feature: Translation starting site: 123
  misc_feature: Pfam Name: RimM Pfam Description: RimM N-terminal domain
  misc_feature (429)..(429): n is a, c, t, g, unknown, or other
  misc_feature (555)..(555): n is a, c, t, g, unknown, or other
  misc_feature (562)..(562): n is a, c, t, g, unknown, or other
ggagctccccgcggtggcggccgctctagaactagtggatcccccgggctgcaggaattcgtctcacccctagaaaaagtctcgcgttcctctcgtcggctcgtcgctctccgagccgcgaaatggcgcctcctacctctgcatcggcgcggccgctatccctccccctcaccgtccctctctcctgtcaccgctcccacttgctccccgcgcccaacgctcgcctcctcacccggcgccgcgtcgcgctcgcgccgacccggcctggcgccacgctcctatccagcctcagtgacgcccgggaggaggacgaggatgaaagtggtttctatgaggaggatgagcaacaggaattcgaggatgaggaggaacaggggtacgacggggagaacgaggagctggtcgaggtgggatacgtgtcggcgcgcnacacggggtgccgcggcgacgtcctcgtcacgccacgcaccgactttccggagctccgccttgccacgccggggacgagatggctgaaggctcgagctgctgggaagcagcaggtcagggaattcnagcttgntcggggaaggcgcacacggggaagaaaagttggatcgtcacttttgatgcctcaccac

SEQ ID NO: 70503 - DNA, 681 bp, Zea mays
  misc_feature: Ceres CLONE 1550354
  misc_feature: Encodes the peptide sequence at SEQ ID NO. 70504
  misc_feature (290)..(290): n is a, c, t, g, unknown, or other
  misc_feature (291)..(291): n is a, c, t, g, unknown, or other
aagctggagctccccgcggtggcggccgctctagaactagtggatcccccgggctgcaggaattcgtctcacccctagaaaaagcagtttactagttgtacacccataatgacccattctaccgtcatatacatacaccgttggcacgccatctaatcagcgaagaggagacgacgactgctctgcctttcttccctacaggaacaggacgaatcaatcaatcattcccctctgcagccgccggccctcagcaagcaagcaagggacagaacgcggcggggatgggcagnncggggtccgggcgctgatgcgccggaagcaggtagactccgagcggacgcgcgccgccggcagcgcccaccagctccgcaaggagctctccgtcacccagctcgtcgccatcggtgttgggtcgacgattggagctggcgtctacgtccttgttggcacagttgcgcgggagcattccgggccggcattgacgctttcatttctgatagccggaatagcagctgcgctttcagccttctgctatgcggagctgggctagccgttgcccttcggcaggaagcgcctatcattattcgtacatctgcgttgggcaaagagttgccatggttgatttggctgggctttgatactgaataccgaaattggtgggatcagcccgttgcccgtggc

SEQ ID NO: 70504 - protein, 80 aa, Zea mays
  misc_feature: Ceres CLONE 1550354
MRRKQVDSERTRAAGSAHQLRKELSVTQLVAIGVGSTIGAGVYVLVGTVAREHSGPALTLSFLIAGIAAALSAFCYAELG

SEQ ID NO: 70505 - DNA, 568 bp, Zea mays
  misc_feature: Ceres CLONE 1550357
  misc_feature (126)..(126): n is a, c, t, g, unknown, or other
  misc_feature (127)..(127): n is a, c, t, g, unknown, or other
  misc_feature (153)..(153): n is a, c, t, g, unknown, or other
  misc_feature (168)..(168): n is a, c, t, g, unknown, or other
  misc_feature (174)..(174): n is a, c, t, g, unknown, or other
  misc_feature (175)..(175): n is a, c, t, g, unknown, or other
  misc_feature (371)..(371): n is a, c, t, g, unknown, or other
  misc_feature (388)..(388): n is a, c, t, g, unknown, or other
  misc_feature (389)..(389): n is a, c, t, g, unknown, or other
  misc_feature (412)..(412): n is a, c, t, g, unknown, or other
ggagctccccgcggtggcggccgctctagaactagtggatcccccgggctgcaggaattcgtctcacccctagaaaaaagatcaggattagccgaccacccgccgaaggccagagagaaatatctnncatcttctctccaccggatcggttcnaatcgagagcgaggngagaannagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctncttgtaaactggcgctnncgccttttgcgtggttcgtgggntccttttttgcgctttttctccgtccccttcttttcccccccaaaatcccccccccttttttttttttttcccctcccccgggaaaaacccggggggggggggtgtggttcccccaggggcgcccaaaaaaaggggggggggcgtttttttctccc

SEQ ID NO: 70506 - DNA, 632 bp, Zea mays
  misc_feature: Ceres CLONE 1550359
  misc_feature (325)..(325): n is a, c, t, g, unknown, or other
  misc_feature (349)..(349): n is a, c, t, g, unknown, or other
ggagctccccgcggtggcggccgctctagaatagtggatcccccgggctgcaggaattcgtctcacccctagaaaaaagcggccggaagagcaccgcacatcgcgcggtgtccggtgcgcccccggcggcccttgaaaatccggaggaccgaattccgtccacgcccggtcgtactcataaccgcatcaggtctccaaggtgaacagcctctggccaatggaaacatgtaggcaagggaagtcggcaaaacggatccggtaaacttcggggaaaaaggattgggctctgagggtttgggcttcgggggtccccggcccgaacccntcggctggctggcggaatgcctcnagctgctcccgccgccagagcgggcccccccgtgccggcgggggacgggaacccggaaacggccccctcgggggcttttccccggggcgtcgaaaaccgatttcaaaatggtccgaaaaaggggaatcccaccttttatttaaaacaaaattttgcaccggccccccgggatgctaaccccatttggtttttctccccgggcccttaatgtccaaggggaaaaattcccccccccgcggtaaaacggggggaaaaaaaaaacccctctttaggggcccaaagc

SEQ ID NO: 70507 - DNA, 660 bp, Zea mays
  misc_feature: Ceres CLONE 1550362
  misc_feature: Encodes the peptide sequence at SEQ ID NO. 70508
ccgctggagctcaccgcggtggcggccgctctagaactagtggatcccccgggctgcaggaattcgtctcacccctagaaaaaacagcaaaggcggcactgctcaaaccacctctttggccacacacacgcatactgccaccgctactgcttcatcagcagctagcagcaagcggccggtggtgcagcgctgcgcctgcgccgggtaatcgaacacatggctcagatgatctcaaccatgcccatgctagacgccgccccggcctcgtcagccattatgcccaagctgccgcccgccgcctgcctggacgcgccgccggcctcgggcatcaccgtcgtgtcgaggcagcacgttcgcccggacgccgcgtcggcggtcggcggactcacgctgtccgtctccaacctgcccatgctgtcgtgccactaattccagaagggggttctttctccccgggaccccgacctggccaagcccccgggcgggtcgctgctcggtcctcgcttgcgcggggcgccccctttttcccgggccttgcgggccgtttattaaggttgccgaaaaaccgaattttattcggtggaaaaaacgggggtggaatatctccccgcgcgtgcacccgggggggtgatttggaaaattttttgccccggaacccaa

SEQ ID NO: 70508 - protein, 70 aa, Zea mays
  misc_feature: Ceres CLONE 1550362
MAQMISTMPMLDAAPASSAIMPKLPPAACLDAPPASGITVVSRQHVRPDAASAVGGLTLSVSNLPMLSCH

SEQ ID NO: 70509 - DNA, 660 bp, Zea mays
  misc_feature: Ceres CLONE 1550365
  misc_feature: Encodes the peptide sequence at SEQ ID NO. 70510
ctccccgcggtggcggccgctctagaactagtggatcccccgggctgcaggaattcgtctcacccctagaaaaagcctctcctcgaaaccgtctctctgtgcgtccggagtccggggagagggtggcggcggcggagatggagagccagcaggtcaccgacagccgcctcaccgcgctcgactccgccatgcgccccatccaggtgaggacgcacgccgttcggaccgcgcacgagaacatcgaccgcacgctgcgctccgcggatgtgatcctcacccagttcgacaggacccgagaggcagagcgtgaaatacagaaggggccgcatgagaaccttcaaggtttcctagatgcagttgatcgcttgagaagtattgagcgtttctttagttcaaatcggagttaccgtagtagcgatggggtgctcaaccacgtaaacgcgctcctttctaaggcccttgtcaggatggagggtgaattccagaatcaattatcccagcgcagcaaaccgatggagcctgatcgtctttttgattgtcttccaagtacacttcgaccatcgtctgaatctcagcccgaaggtgggaaaaacccatccgagaatcagcaaaacccagaggctgttgtatatagtcctcctgctcttattgagccaaagt

SEQ ID NO: 70510 - protein, 174 aa, Zea mays
  misc_feature: Ceres CLONE 1550365
MESQQVTDSRLTALDSAMRPIQVRTHAVRTAHENIDRTLRSADVILTQFDRTREAEREIQKGPHENLQGFLDAVDRLRSIERFFSSNRSYRSSDGVLNHVNALLSKALVRMEGEFQNQLSQRSKPMEPDRLFDCLPSTLRPSSESQPEGGKNPSENQQNPEAVVYSPPALIEPK

SEQ ID NO: 70511 - DNA, 1023 bp, Zea mays
  misc_feature: Ceres CLONE 1550366-R
  misc_feature (1023)..(1023): n is a, c, t, g, unknown, or other
ttccaaatgagacctcgagcgtctcgtttttttttttttttttcaccacctaaatgatttgtggcataaatatcaaaaccatatccgggtgcatacaaaatgtcaatgtaaatatcttgccatgtgcgatatccgaaagggttgtccacctcgcctatagcacctctatacaaagccactctacgggcgtgtcttcatggtaccatggaggcatgcagttgctgcaacttgactttctgaatggcagcaaatcctggaatattcacatcgtaccactattggccccgattgcctttctatacaggtgagggatggagggtagtgccctcaacctctcgatgatatgacctctcctgtggccaaagtgggcagtgaactacaacgatcaatgatacgttgcaatccttgtgcccctcagtcaagcctgccccgataaatagcccaaaacaaaggtgggcccttcattggctagcatcaggaggtctatgccaccatcgagttctgaaaaaagcgggagaaaatgcacaattgggggggccaaaaaagattcaaaccccaccaaaaactttccaaaaatttggggctttccctcctaattaacaaagccttttaaatttatccaccttggggggcccaaaaggttttaaaaaaaacctgtttgggttttaggggcgattatcttgtatcctcgtactacaccacgcgaactttaagaaaacgtcaccatgagggcacatatattactcatcgcccaagggaacattagaaaaaaatcggccacgccttcgtatgacatattttctccttatgtatatttctcgtgtagttagctgcggcccgcgtagctataaaacaccgccccctgtatttatttagccagcatttttctccccaccgccacaagaatatttgcgacccgctttaacgtgtacttcccataatgatggggtttacgaaagtactccggggttatactcccgggcccctttctcgccaagcgcgcgtatttttatgtccgccggn

SEQ ID NO: 70512 - DNA, 616 bp, Zea mays
  misc_feature: Ceres CLONE 1550371-R
  misc_feature (1)..(1): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (315)..(315): n is a, c, t, g, unknown, or other
  misc_feature (394)..(394): n is a, c, t, g, unknown, or other
  misc_feature (395)..(395): n is a, c, t, g, unknown, or other
  misc_feature (414)..(414): n is a, c, t, g, unknown, or other
  misc_feature (456)..(456): n is a, c, t, g, unknown, or other
  misc_feature (462)..(462): n is a, c, t, g, unknown, or other
  misc_feature (463)..(463): n is a, c, t, g, unknown, or other
  misc_feature (574)..(574): n is a, c, t, g, unknown, or other
naatggtctgggccgtgtttnnnnnnnnnnnnnnnnnnccaattggtactcgaggtccgtttttttttttttttttgtgtcataatacagacttggtttatcataagattacagcagaaatagtacaagttttcaacagcaacaagcatcggtcctggaattacacaccaaaacaggagataatttttttggtcctttgggggaaaaactccagaacatttttaaacaatgggccgcgtacccaaaataaaggaagggccaggcaaaactaatcaatcccagggggaaaggtccccattcttttcccgccaaaancaagggcttttcaaaaacaaaggggggtcccccccaaaaaacccccccaggggaaaacaaacaatttttttcccccctnnttcccccccgcccccctcnccctccgccggcggggtatattcccccctttggggggggcgncctttnnccccccagaagaacacccccccccccttttttttttttggcgccccccccgggggggagagaaaccccccccccccccggggggggaaatttttttttttttgaggagganaaaaaaacccccccccccccctccccgcgcgggaaagggggg

SEQ ID NO: 70513 - DNA, 672 bp, Zea mays
  misc_feature: Ceres CLONE 1550371
  misc_feature: Encodes the peptide sequence at SEQ ID NO. 70514
tccccgcggtggcggccgctctagaactagtggatcccccgggctgcaggaattcgtctcacccctagaaaaatcccgcccgcctccctccgtccactcggatccggaaaaccctaaccctagacgtcgcccggccgccgccatggaccccgacggcgacccggccttccaccgcaacgaggccatctccgcggtccaggatgtcgaccagtactatggcgacgacgacgacttcgacgacctctacaacgacgtcaacgtcggggacggcttcctccacgcctcccaccaggcgccgccgccgctgccgctgccgccgccacctccgactcagcaggccccaccgccgcagaagcaccagctccctccgccgtcccagcagctgccgccgccccagcagcatccacctgcccacgtcctcccgccaccgccgccacaggccccaccgccgcagcagcaggtaagcatcccgggggtggccgtccctgctcctggcagacctcccgcccagaccaacctccctccgccgcctcagccaccggccgctcccgcgccgccgccgccgcctcagcaccaccatattcagcaagacgggaatcaacggccctggagggaacatcgccgggtggccccatcgtggtgcgggaaaggtgggccctgctgggcgggggg

SEQ ID NO: 70514 - protein, 176 aa, Zea mays
  misc_feature: Ceres CLONE 1550371
MDPDGDPAFHRNEAISAVQDVDQYYGDDDDFDDLYNDVNVGDGFLHASHQAPPPLPLPPPPPTQQAPPPQKHQLPPPSQQLPPPQQHPPAHVLPPPPPQAPPPQQQVSIPGVAVPAPGRPPAQTNLPPPPQPPAAPAPPPPPQHHHIQQDGNQRPWREHRRVAPSWCGKGGPCWAG

SEQ ID NO: 70515 - DNA, 893 bp, Zea mays
  misc_feature: Ceres CLONE 1550375-R
  misc_feature: Encodes the peptide sequence at SEQ ID NO. 70516
  misc_feature (1)..(1): n is a, c, t, g, unknown, or other
  misc_feature (2)..(2): n is a, c, t, g, unknown, or other
nnccaattgggtacctcgagcgtctcgtttttttttttttttttgtcaaacccatcaagttgaagaaaagtaacacaccattaagtggaccctaattaagttgcactaggtcaaagaatccagcggcacaaagtaccatttgtactcttctcctaaaaaaatactatacggttccactcaagatagacatacatgtggtcacattacatacagtagttttctacaaaattgaaacgaacagaaggttgaaaacatcgtgaataatcttgtgatgtgtaaggtagcgcgctgtgaaccgaccttccaccctgcactccctcatcataaaggctatcttgtttgattcacgatgaagttatccatctctactgctcggagttaactactggattgttcatagatattcgctaccgcttgcattttgccttcgccattttcttcctcttcttcttctcagcttttgggatcttggtcttgcgggcctccctcttctcttccttcactttcttcttgttttccttccgagcagccttcctttcctcaggtcccaccttaggatcatccgagtgccacgaatcatcttcctcagaactcaagcaagattcgctctcatcttcttccacctcaactgtgtttcgggccgggtggtcctgcctccttttcaaggggttggggtttttagccccacaaaacctaaaaaatgggtgggccataaaagcttatctggttgtgggcccaaagcccggaggaatgaacgttggcctccttgaaatggttggacaataatttgccctccaacatgggttcacggtagatccaaacggctttccaccctgaaattgtttgggaacaaattttctactcaccttttgggaaaccctccaccccccgtt

SEQ ID NO: 70516 - protein, 30 aa, Zea mays
  misc_feature: Ceres CLONE 1550375-R
PIGYLERLVFFFFFVKPIKLKKSNTPLSGP

SEQ ID NO: 70517 - DNA, 1055 bp, Zea mays
  misc_feature: Ceres CLONE 1550375-R2
agggtgacacaccattaggtggaccctaattaagttgcactaggtcaaagaatccagcggcacaaagtaccattatgtacttcttctcctaaaaaaatactatcatggttccactcaagatagacatacatgtgggtcacattacatacagtagttgttctacaaaattgaaacgaacagaaggttgaaaacatcgtgaataatcttgtgatgtgtaaggtagcgcgctgtgaaccgaccttccaccctgcactccctcatcataaaggctatcttgtttgattcacgataaacttatccatctctactgctcggagttaactactggattgttcatagatgttcggtaccgcttggatatagccttcggcattttcttcctattcttcaccccaccttttagggatcttgggtctagcaagaccaccccccgtcgcttccctacaatataattacttcgggttgcctacgagaagcaaaacctgccctattgagacaaggaaccaccattagcgatcaattggggattggtctagggaatcttttcgtagtctcataaagcccagaaggcgatgtaatttccccctcgcccaccttttttctcaagccgcgcaggatggatttttatcgcggcgcggagttagagacgtggttgctccccctcgcgttcgagaggacaagaggtgaggaaaggaatgtggctcaggggatactgatgtcgctgcgccaaccccacacaagcgatgggagggtaggagaaaggagtatgcggagagagtagatcagcgagagaatacgcgcgcgttcaggtgcgcacaggaaacggcgttaatggtttggcatgtatgggtgtgttgttgcgcagatttgagggccgttaccaccccgcgggtggataatgaatagtacgggtggcgggttggcgctacgcggaaaatgtggggccagcacgatgtttgggtagagccgtcagaacaaacgtacgatgctgggaatttgttccccccgcacgcgcacgagatatgatgtccggatatagaacgacgcgaatgaat

SEQ ID NO: 70518 - DNA, 665 bp, Zea mays
  misc_feature: Ceres CLONE 1550377
  misc_feature: Encodes the peptide sequence at SEQ ID NO. 70519
cccgcggtggcggccgctctagaactagtggatcccccgggctgcaggaattcgtctcacccctagaaaaactctttccagccacctcactcttcactagcctgctgctcctctgaaatggcggcggcgacttcctcttccacctacctcgccatcggccgcaaaaccctaaaccccgccccctccgtagccacagccgccacctccgtctccttccccgccacgcagcacccatgcctcgtcgccgcctccgcggaccgccgccgcgccgtggctgcgaaggtctcgtcgccgtcggtcatcggcaccaccatgccgtcgctcgacttcgagacctccgtcttcaagaaggaaaaggtgtgcctggccggccatgaggagtatattgtgaggggtggcagggatctgttcccgctctcaccgcaggccttgaacggaatggaacagatcgctgtcatcagctgcggctcggcaggacctgcgcaagctccgaacttgagagacacacgtgttgaggaaaagtcggatattgggggcaagagtgggctccggagaagggtctaaatcttttcaagaaacccggagaaaagggttccccgggagagaaggggacccccgggtggaaatgctgggaaaattggtaacaaaccgctggtccctgaagt

SEQ ID NO: 70519 - protein, 83 aa, Zea mays
  misc_feature: Ceres CLONE 1550377
  misc_feature: SWISSPROT Homolog: EC 1.1.1.86 Ketol-acid reductoisomerase
MPSLDFETSVFKKEKVCLAGHEEYIVRGGRDLFPLSPQALNGMEQIAVISCGSAGPAQAPNLRDTRVEEKSDIGGKSGLRRRV

SEQ ID NO: 70520 - DNA, 631 bp, Zea mays
  misc_feature: Ceres CLONE 1550378
  misc_feature: Encodes the peptide sequence at SEQ ID NO. 70521
  misc_feature (601)..(601): n is a, c, t, g, unknown, or other
ggagctccccgcggtggcggccgctctagaactagtggatcccccgggctgcaggaattcgtctcacccctagaaaaaaaaccgaaaaggaggacaaaatttctcctctcgaagaaccctagcggcaaaacctttgctccgtcccgccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccaggcctttgcaggctgcaagcattccaggactccttgggatttttcagaacgagtgggatgctctcatgctttctaattttgctttggagcagcagcttcacacagcaagacaagaacttagtcatgcactctaccagcatgacgctngcctgccgtgttatagccagattaaagaag

SEQ ID NO: 70521 - protein, 120 aa, Zea mays
  misc_feature: Ceres CLONE 1550378
  misc_feature (64)..(116): Pfam Name: Prp19 Pfam Description: Prp19/Pso4-like
  misc_feature (111)..(111): Xaa is any aa, unknown, or other
MICAISGEVPDEPVVSKKSGLLFERRLIERYIEDHGKCPATKEDLTMDDIVPVKTNTIVKPRPLQAASIPGLLGIFQNEWDALMLSNFALEQQLHTARQELSHALYQHDAXLPCYSQIKE

SEQ ID NO: 70522 - DNA, 674 bp, Zea mays
  misc_feature: Ceres CLONE 1550386
  misc_feature (549)..(549): n is a, c, t, g, unknown, or other
tggagctccccgcggtggcggccgctctagaactagtggatcccccgggctgcaggaattcgtctcacccctagaaaaaccccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttcgagtgcgagcagtgtactactactagtcgttaggttggtagccaagagaggttctttttccacacctcccttgcgcaagtgagtcctgtcctgagcggatctacccaccactgccatctgttttttactgtggctgttggggttccgccagtttcttcgtttggtcctggtttgctngagagaggaaaaaccaaaaaaccaaaaaacccgcctagagggctgctgctatagatctggcaggggaggagcttataaaagccctccagccttttttccgggatgcctctgctcaggggtccagt

SEQ ID NO: 70523 - DNA, 650 bp, Zea mays
  misc_feature: Ceres CLONE 1550390
  misc_feature (475)..(475): n is a, c, t, g, unknown, or other
  misc_feature (521)..(521): n is a, c, t, g, unknown, or other
ctccccgcggtggcggccgctctagaactagtggatcccccgggctgcaggaattcgtctcacccctagaaaacccgccagcatctccctccgagtccagggggcatgggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaaggaagaaatgacggtgacgccacggatcacgggtgagcgacgggcggctgacggtgcgcggccgtacggtgctcaccggcgtgccggaacacgtgtcngcggcgcacgcggccggggcggggctcgtcgacggggccttcgtcngcgcccacgccggcgaggcaagagccacacgtctttcactttcggacgctccgggactgccgttcctggtgcctgttcggtttaaactttgggggatgaaccaaccgaaagggcgttcccggccgaaat

SEQ ID NO: 70524 - DNA, 671 bp, Zea mays
  misc_feature: Ceres CLONE 1550394
  misc_feature: Encodes the peptide sequence at SEQ ID NO. 70525
aaagctggagctccccgcggtggcggccgctctagaactagtggatcccccgggctgcaggaattcgtctcacccctagaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctccatggtcctcatcaagatgaaggagattgctgaagcctacctgggttccaccatcaagaacgcagtggtgacagtgccggcctatttcaacgactcgc

SEQ ID NO: 70525 - protein, 156 aa, Zea mays
  misc_feature: Ceres CLONE 1550394
  misc_feature (8)..(156): Pfam Name: HSP70 Pfam Description: Hsp70 protein
MAKSEGPAIGIDLGTTYSCVGVWQHDRVEIIANDQGNRTTPSYVGFTDTERLIGDAAKNQVAMNPTNTVFDAKRLIGRRFSDPSVQSDMKLWPFKVIPGPGDKPMIVVNYKGEEKQFAAEEISSMVLIKMKEIAEAYLGSTIKNAVVTVPAYFNDS

SEQ ID NO: 70526 - DNA, 845 bp, Zea mays
  misc_feature: Ceres CLONE 1550396
  misc_feature (17)..(17): n is a, c, t, g, unknown, or other
  misc_feature (19)..(19): n is a, c, t, g, unknown, or other
  misc_feature (20)..(20): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (51)..(51): n is a, c, t, g, unknown, or other
  misc_feature (52)..(52): n is a, c, t, g, unknown, or other
  misc_feature (54)..(54): n is a, c, t, g, unknown, or other
  misc_feature (55)..(55): n is a, c, t, g, unknown, or other
ccccccccccccccccncnnaggggcggggaggtgggagcgcnnngngggnngnnttgggggttaccgcggtggcggccgctctagaactagtggatcccccgggctgcaggagttcgtctcacccctagaaaaaactcgggcttttgtccatcaatccctctctttcccatcgccagatcacctggacggccttctcctgctatggatgctaccatggcgttcacctccggaagccctacccccacgcgcttctactcttcagctttgctatcgatgtgcaccccctagagcctctctgtctacggtccatggtgatggactgggcgtgggtggcccctcctcgcgctcgggcatcggtcccaggcccaggctgccgcagcggtcgctggggctgtttaagcttcccacctcaatgttcttccccctgggactctggaatcggaggggcttgcaagtagggggggcgacctccctattccgcactgtccgctggccgcttgccatgcccccctaattctggtccgctccacttgcctcctaggtgctctacaaccgccggccgcggcgcagggtgatggcgattctggaatggtgtcccacaccggaactgccccgggggaaatgcacaatccttttgggatctttggctcccttcccccgaaaaggaagtttaacttgctggggaatggcagctttggctgaattcttctgtctcaacctttttgatggtgtatacggggtggttatctcccccgggagtaaaaatgtgtaccttggacttgaggaacagtgcgtttctccccgtcccgcctgtggaaaaacttctcagctatgaaactttgg

SEQ ID NO: 70527 - DNA, 530 bp, Zea mays
  misc_feature: Ceres CLONE 1550400
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (127)..(127): n is a, c, t, g, unknown, or other
  misc_feature (128)..(128): n is a, c, t, g, unknown, or other
  misc_feature (276)..(276): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnccccnnnnnaaatttttgggagctccccgcggtggcggccgctctagaactagnntggatccccccgggctgcaggaattcgtctcacccctagaaaaaactacgagctagcaggctagcagcaccaggaccaggagcctcttcccacacttccgctctccctctctctctttcctctcgagaatgggtgtgtaggcggggcncaggaagggaaaggaaaaaaaaaaggggaaaccctagcctagggggtttttggggtccccccccccttttttgtttccccccttagggctctttaaaaaccccccccccggggcccaaaggggggggggggggggggaaaaaaaaaaaggggccccccccccaaaaggggggggggaaaaaaaaaatcttccccccccccccgggggggggaaaaaaaaaaaaaaaggggggggggaggaaaacaaaacccccc

SEQ ID NO: 70528 - DNA, 610 bp, Zea mays
  misc_feature: Ceres CLONE 1550401
  misc_feature (359)..(359): n is a, c, t, g, unknown, or other
tggagctccccgcggtggcggccgctctagaactagtggatcccccgggctgcaggaattcgtctcacccctagaaaaagattcggttttcttcgtgaattcgcccccagcgagccgagctagaattggaattggaactggacttgcggctgctgcgttcggcgggggctggaattctcgccgcatccccgtgtggtggtgagaggccgtggctcgtgttgcggtcgacgcgcgaggagggtcgacggcctcgcgccattggggtacgaagccggccgagactgagcggccgctgatcctggtttgagcgcctcgggttcctcttggatttggttggcgtttttatgggcgggtagatncgtccggtgattttctcagctgctatcgggtgcgatggggcagctgacttccaggcatggggggtttccccagggggatcaccggctctctgtacaacatcacatgctctcgttcagtccacagcgaactcggcatcgggggcggcgacaacctaccggtggatggccatgccccgggaattgtaaggggggcattgaaaccccgggcttttccttcccaaaacaggggtctcgcaacccacgggggttcc

SEQ ID NO: 70529 - DNA, 663 bp, Zea mays
  misc_feature: Ceres CLONE 1550403
  misc_feature: Encodes the peptide sequence at SEQ ID NO. 70530
  misc_feature (314)..(314): n is a, c, t, g, unknown, or other
  misc_feature (359)..(359): n is a, c, t, g, unknown, or other
  misc_feature (403)..(403): n is a, c, t, g, unknown, or other
ggagctccccgcggtggcggccgctctagaactagtggatcccccgggctgcaggaattcgtctcacccctagaaaaaccacgcccccgctcctctcgtctctatcttcgcctcttccatcgcaggattcagcggccatgggcggcggcaacgcccagaagtccaagatggcgcgcgagaggaacgccgagaagaacaagggcggcaaaggcagccagctggaggccaacaagaaggccatgaacatccagtgcaagatctgcatgcagaccttcatctgcaccacctccgaagcccagtgcaaagaacatgcngaagcgaagcatccccaggacgacctcttacagtgcttcccccanctctaggacttagtagccgcagaagcctatgctctgctcagctnaaagacaaagtgctcctatatatatatatacgcctgtgtgtcaaattaaagggttctaagcttctgctgataccgctgcctccctcgcggtttccccgtctgattttgtaccgtgaaccctttggctgtcaccctggtctgctaaaaaccttgggtttgtgtgtgtttaaaaaattccccgggagagaaacccccgccagagagagagagaaagagggggaccacacagcgctctcctcccaattggacagggcccaagc

SEQ ID NO: 70530 - protein, 75 aa, Zea mays
  misc_feature: Ceres CLONE 1550403
  misc_feature (4)..(73): Pfam Name: DUF1909 Pfam Description: Domain of unknown function (DUF1909)
  misc_feature (74)..(74): Xaa is any aa, unknown, or other
MGGGNAQKSKMARERNAEKNKGGKGSQLEANKKAMNIQCKICMQTFICTTSEAQCKEHAEAKHPQDDLLQCFPXL

SEQ ID NO: 70531 - DNA, 656 bp, Zea mays
  misc_feature: Ceres CLONE 1550409
  misc_feature: Encodes the peptide sequence at SEQ ID NO. 70532
  misc_feature (369)..(369): n is a, c, t, g, unknown, or other
  misc_feature (390)..(390): n is a, c, t, g, unknown, or other
ctccccgcggtggcggccgctctagaactagtggatcccccgggctgcaggaattcgtctcacccctagaaaaaagcactctagctgcttctctcggttctcgcgactcccaaacggcaaaacgccaaaaccctagccgcggccattccggaattggccatggaggcgagggcgtcgccgcgtccgtcgtctccatcggtggcggcggcggcttcggagctgggcggggtgacggcagcgccttctcgtttctctcaaaggggtggcgcgaggtgcgggattccgccaccgccgacctgcgcctcatgcgcgcgagggctgattccctccgcacgctcgcggaccgcgagctcgagcacctcctcgcgntcgcctccactgggctgaccntcgcgcccgccgcgccgctcgcgggggggcggccatagccgagttcgaggtcgtgcgcacacggatccagcccaagatctccgaactgcggcgccggtacgtgtcacaggagcgggagctcggccgcagggtgctcaagggttgggcgcccccccggggcgggaaaacccgccccgcgccgtgtcgacctctctgggaaccccgccctccgcaacgccctcgtctttaaaatggatggcggggaagccctggaagccccctggtgt

SEQ ID NO: 70532 - protein, 141 aa, Zea mays
  misc_feature: Ceres CLONE 1550409
  misc_feature: SWISSPROT Homolog: EC 2.4.1.241 Digalactosyldiacylglycerol synthase
  misc_feature (123)..(123): Xaa is any aa, unknown, or other
  misc_feature (130)..(130): Xaa is any aa, unknown, or other
PRGGGRSRTSGSPGLQEFVSPLEKSTLAASLGSRDSQTAKRQNPSRGHSGIGHGGEGVAASVVSIGGGGGFGAGRGDGSAFSFLSKGWREVRDSATADLRLMRARADSLRTLADRELEHLLAXASTGLTXAPAAPLAGGRP

SEQ ID NO: 70533 - DNA, 728 bp, Zea mays
  misc_feature: Ceres CLONE 1550420
  misc_feature: Encodes the peptide sequence at SEQ ID NO. 70534
  misc_feature (60)..(60): n is a, c, t, g, unknown, or other
  misc_feature (67)..(67): n is a, c, t, g, unknown, or other
  misc_feature (358)..(358): n is a, c, t, g, unknown, or other
agacctggatctccgcgcggttgcagccgctctagaagaggggatgcccgcgggctacangaattcntctcacccctagaaaaaaaattcccagtcccaccaccacttgtctcaccgccgccatggcgtcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggctccaccccccgccgcatccgcatcctcccgtcgcggtatcacccccgtacccgcctccgcctccgccgccgnggctccagcccccgatccaatggcggggcgaggatggggtttaatgccgggtcccaccaccggtcccctcttcgaaaaacacccgcggctgttgggcgcgggccatccaggccccctccagggcctcgatcggcaactgggcgtccctcatcctggttcatcccccccccccgctcggaggggcccccccaaggagttggccaccctcctaaccctccctcccccctccacccattggcctgtgattcattaatccaatccccttaccccctcgcgttcggttcactcccccccacgaccctttgagcacccccggggtctccagccgccacccccctacatttcgggctccgccactctctccggacac

SEQ ID NO: 70534 - protein, 162 aa, Zea mays
  misc_feature: Ceres CLONE 1550420
  misc_feature (79)..(79): Xaa is any aa, unknown, or other
MASSTAASPLTCHHLGSVGARPRLPSLSISLRRRSSSSSKPTSLSHSLPSKHSLAPPPAASASSRRGITPVPASASAAXAPAPDPMAGRGWGLMPGPTTGPLFEKHPRLLGAGHPGPLQGLDRQLGVPHPGSSPPPARRGPPKELATLLTLPPPSTHWPVIH

SEQ ID NO: 70535 - DNA, 886 bp, Zea mays
  misc_feature: Ceres CLONE 1550421
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (886)..(886): n is a, c, t, g, unknown, or other
nnnccccnnnngggggggttttggcttgtggtttannncccctnnnnnnnncgctctttaactccccgcggtggcggccgctctagaactagtggatcccccgggctgcaggaattcttctcacccctagaaaaaaagtgccaggcccaccaccgcgtgtctcaccgccgccttgggggcctccaccgcggcctcgccgctcacctgccaccacctcggcagcgttggtgcccgccctcgcctcccgtccctctccatctccctccgccgccgctcctcctcttcctctaagcccacctccctttcccactccctcccctccaagcactcgctggccttaccccccgtcgcatcggtatcctcactgtcgcggtctcaccctgggtcggggtctccgtctccgaccgccgggtgctccagccccccgatccacttgccgggttgcctgccccgcggtccatgttgtttgtttaaaccaccggttctccccgaccgcaaggatgccccgcggctgcggggggggggggccttttctaggccacttttccttggggtcctcctcttcccggacttgggccgtccctctcatcaatgggccttcattcgttggcgcccccccggtctcgtgttttcgcctccatccaatcgagcggtgcctaggttccctatagcccatttttttccctctgccgaccagtgtgttctcccgccttctattctctcccctgtcctgtgttggctctccttccatctcttcggggtttggcccctacccacgtggtgcttcgtgtttcccgttcttgctgccttctgggcctggcttgggggttttcgtggttctgcaccgggcgagtctcttcttgccacttcctttccattgcgaacn

SEQ ID NO: 70536 - DNA, 680 bp, Zea mays
  misc_feature: Ceres CLONE 1550423
  misc_feature: Encodes the peptide sequence at SEQ ID NO. 70537
  misc_feature (415)..(415): n is a, c, t, g, unknown, or other
  misc_feature (416)..(416): n is a, c, t, g, unknown, or other
acccgcggtggcggccgctctagaactagtggatcccccgggctgcaggaattcgtctcacccctagaaaaaagttttctcatctcagctcagctagctttcccctcccttgcaactgcaagcttgcccaacccaataagctaagcaagcacgcaccatacacactctctagtagctagctaagctagccggccgcccctcctcgcacgcgtgcgcgcaccagcatctatcatcagagctagccacgaaacggatcggagcagcagatctcgatcggcggcccacatgggggatcacgctgagatgttgcatgccgctccggccatgtacaacggcgctggcgctgcccctcatggcgggtggtggaatacggcggtgcccgcgacgacgtgctcgacgacggagctggctgggnntcacacgtggtcgtccgccctggctgctagctacgacctggcggccgagggggacaaaggccaagagccgccccggcctcttcggaatccccccgggaacaacagctccgtgactttcaaagaaccggcctgcgtcacgaatcctcccggggttgaaccccccgggtggcaatgggaaaaaccccttggccccgggtttcccccaatggaaaactcccttattagaggggggggccccaaccattttgaaggggtttccaaaaa

SEQ ID NO: 70537 - protein, 131 aa, Zea mays
  misc_feature: Ceres CLONE 1550423
  misc_feature (44)..(44): Xaa is any aa, unknown, or other
MGDHAEMLHAAPAMYNGAGAAPHGGWWNTAVPATTCSTTELAGXHTWSSALAASYDLAAEGDKGQEPPRPLRNPPGNNSSVTFKEPACVTNPPGVEPPGWQWEKPLGPGFPPMENSLIRGGGPNHFEGVSK

SEQ ID NO: 70538 - DNA, 680 bp, Zea mays
  misc_feature: Ceres CLONE 1550424
  misc_feature: Encodes the peptide sequence at SEQ ID NO. 70539
  misc_feature (372)..(372): n is a, c, t, g, unknown, or other
  misc_feature (494)..(494): n is a, c, t, g, unknown, or other
  misc_feature (495)..(495): n is a, c, t, g, unknown, or other
  misc_feature (517)..(517): n is a, c, t, g, unknown, or other
  misc_feature (518)..(518): n is a, c, t, g, unknown, or other
  misc_feature (680)..(680): n is a, c, t, g, unknown, or other
gagctccccgcggtggcggccgctctagaactagtggatcccccgggctgcaggaattcgtctcacccctagaaaaacttctgtcagctaagctaccccgtccccgtggcgactggggacatcgtttccgtctccgggctcggcagccgcaatgctggcgcagctgctgctcgtgcacctcctcctcctccccgccgcgtcctcggccgaccaccaccgccattaccggggcagaagggcgctgcacgagccgctgttccctctggagagcacgcccacgctgccgccgccaccgcccgcgccgttcttcccgttcctaccaggcgccgcggcgccgccgacgccggtggcgacgccggagggtgggctccngctcacgccagccgacacggcgcgggtgacgcgtcgtcgtcgccgcacccgacgggcgcgggcaacatttcgtccctgcaccgctgcccgtcttccacggggcgcggctccggggctttctnntaatcccacgcctcctcaacgnnctggtcttggtcgtccccgttggtggcggccttgctcacgggccgccttcgtttaaatcctccgccccgcccccaaaatttttccttcacccaaaggaagaaaccttccattgtaaccaaaaaccccttcctccctttggaccggggcaaaccccgggggcn

SEQ ID NO: 70539 - protein, 140 aa, Zea mays
  misc_feature: Ceres CLONE 1550424
  misc_feature (74)..(74): Xaa is any aa, unknown, or other
  misc_feature (115)..(115): Xaa is any aa, unknown, or other
  misc_feature (123)..(123): Xaa is any aa, unknown, or other
MLAQLLLVHLLLLPAASSADHHRHYRGRRALHEPLFPLESTPTLPPPPPAPFFPFLPGAAAPPTPVATPEGGLXLTPADTARVTRRRRRTRRARATFRPCTAARLPRGAAPGLSXNPTPPQRXGLGRPRWWRPCSRAAFV

SEQ ID NO: 70540 - DNA, 660 bp, Zea mays
  misc_feature: Ceres CLONE 1550427
  misc_feature: Encodes the peptide sequence at SEQ ID NO. 70541
ctccccgcggtggcggccgctctagaactagtggatcccccgggctgcaggaattcgtctcacccctagaaaaaacgccgcccaccgctgccgcgtcatccgcccgtcgtcgcctgccccgcggcttctgcccccattcgccgccgaagcacgccgagccccgtcccagatcgccgcggcgcttcctgccgccgccggcgaagcgcagggttggaaatctgtttgacggaccactcagtgagtggcttcatgttaaatccatttctggtttcaagatgcttcaccaatgacatctggaaactgtaatagtatgtgctgatcttctatgcttcaccacctgatcatcaatgggctctttcctgaggaaacagcctagctacctcttcattttgataattctgcaccttgttgctcatgaggcaagaacactgagttcagatggcgaagcacttcttgccttcaaaaaggcagttacaaattcagatggagtcttcctaaattggcgtgagcaagatgcagacccctgcaattggaagggtggttagatgtgatagtcatagcaagagagtgattaatctgattcttgcataccacagattagttgggcccataccaccagaaaattggaaggttaaatcagttgcaaaccttgtcattgca

SEQ ID NO: 70541 - protein, 65 aa, Zea mays
  misc_feature: Ceres CLONE 1550427
  misc_feature (28)..(64): Pfam Name: LRRNT_2 Pfam Description: Leucine rich repeat N-terminal domain
MGSFLRKQPSYLFILIILHLVAHEARTLSSDGEALLAFKKAVTNSDGVFLNWREQDADPCNWKGG

SEQ ID NO: 70542 - DNA, 662 bp, Zea mays
  misc_feature: Ceres CLONE 1550434
  misc_feature: Encodes the peptide sequence at SEQ ID NO. 70543
  misc_feature (1)..(1): n is a, c, t, g, unknown, or other
  misc_feature (548)..(548): n is a, c, t, g, unknown, or other
  misc_feature (567)..(567): n is a, c, t, g, unknown, or other
ncccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgccgccgcaacacaaacccaaagaaaaggtggcttcngccgacgaaggctccgccnaccaccgagtccgacatcgaggagacgctcaagccgccctcgtgtccgaggtcggcaagtccccccgaggaggtgttcgaggcgctcaagaacca

SEQ ID NO: 70543 - protein, 169 aa, Zea mays
  misc_feature: Ceres CLONE 1550434
  misc_feature: SWISSPROT Homolog: EC 4.1.1.31 Phosphoenolpyruvate carboxylase
  misc_feature (132)..(132): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNTNPKKRWLXPTKAPPTTESDIEETLKPPSCPRSASPPEEVFEALKN

SEQ ID NO: 70544 - DNA, 715 bp, Zea mays
  misc_feature: Ceres CLONE 1550444
  misc_feature: Encodes the peptide sequence at SEQ ID NO. 70545
aaagctggagctcaccgcggtggcggccgctctagaactagtggatcccccgggctgcaggaattcgtctcacccctagaaaaatcgtctcgtctcgcccccttccggcttaaccctcaagatttctccctccctcctcctccttcccgcttgggcgggcgcgggcgcggcaccttccggtttccggggcctcgggcctcggcctcctatatatatacacgcgcgcggccgtctcctctctatactccctagcatgctcggctcgctccccggattgatcgagctcgctcgttgcagagatggacccggtgcctgccccctcctcttctcgccgggccgccgctgctcccggcccctgctgccgctttgacgcgctgcggcgggcgtgcgccgggaacgccgccgccgcccgcgcggccgccgggtgggcgatcggcgcgctgctcacctgcatcttcgccgtcgtgggctcactcgtcggaatcttcattggtgcccttcctggggatgtctaccgaaaacggcatgttccgccggggctggggttggaacaatttctgggaccatcctcctcaaagaggctgttaagtcctggcaccaaaatttgggaggcccagcccttcaggaaaaaaaaacattccccttggggctgggcaacaacttgaaccctctccaccggaaaaattgtgtgggaaaaaaccaatccaccccctac

SEQ ID NO: 70545 - protein, 121 aa, Zea mays
  misc_feature: Ceres CLONE 1550444
MDPVPAPSSSRRAAAAPGPCCRFDALRRACAGNAAAARAAAGWAIGALLTCIFAVVGSLVGIFIGALPGDVYRKRHVPPGLGLEQFLGPSSSKRLLSPGTKIWEAQPFRKKKHSPWGWATT

SEQ ID NO: 70546 - DNA, 657 bp, Zea mays
  misc_feature: Ceres CLONE 1550451
  misc_feature: Encodes the peptide sequence at SEQ ID NO. 70547
ctccccgcggtggcggccgctctagaactagtggatcccccgggctgcaggaattcgtctcacccctagaaaaactcacaaaaccctagctttccctcctcccctgttttgcggcgcgccacgaactcgcgacgctctcgagagatccatggatcggcgcaagggcggcaaccgcgacaccaacggcagcctggtcgaggccacggcgtcgcggctgagggtcgaatccgacgaggaggcggaagaggtggggatggagggtggaagagagcttcgacgcgggggtggaagacgagcaggcggcggcggaggtgattggaagcgaaaagaccagcgccgactactacttcgactcctactcccacttcggtattcatgaagtaagtggttcttcaagaaaccttacatgtggtggtagcttattagcaccacgttttacaagcatctaatatctcattaatttgaaatatttgaagtcagtatgcctatgcagtggagatgccaattatttgcatgtgctgactgcaggaatgctaaaagatgtcgttcggacaaaacatatcaaaatgtttcacccagagtagctttctatcaagaacaagtagtcctggaggttgggctggaactggaatctttctctttctgtgcaaagcagga

SEQ ID NO: 70547 - protein, 76 aa, Zea mays
  misc_feature: Ceres CLONE 1550451
MDRRKGGNRDTNGSLVEATASRLRVESDEEAEEVGMEGGRELRRGGGRRAGGGGGDWKRKDQRRLLLRLLLPLRYS

SEQ ID NO: 70548 - DNA, 683 bp, Zea mays
  misc_feature: Ceres CLONE 1550452
  misc_feature: Encodes the peptide sequence at SEQ ID NO. 70549
  misc_feature (367)..(367): n is a, c, t, g, unknown, or other
acccgcggtggcggccgctctagaactagtggatcccccgggctgcaggaattcgtctcacccctagaaaaaaacctgcagacttgcagtcgcagcgcaaaacggccaaagggccccatttctcccatcacctctcccaaattcaaattcccgcacgctcctcctcctctcccccaatctcacctcctcgccgaaaccctatcagcctccgccgccatggggggctcgcacagccgcgaggacctcgacctatccgactccgactccgacgatgcccagtcccgggcctcccgacattcctccgactacggcacgcctaccccggcatccgcctcctccagttggccagcggcgcaggggcggcggncacgcccgccctcatcgacgccatcgaccgccacctccgccagctccacctcagtacaacgagcccatctccccgaaccctagccccggggccaaccttaggggccacccccgccgggttcaaagccgtaaagttttacctcccatttgggggggtccctcccctccccccaatgggatggttttccaaaagccttcccccccccccccttttttaacacacgggggaaaaaaaaaggaaaaaaaaaacccccccccggggggggcggtggggccccccccgggggcctccaaaaccccgggccggggggcgggcc

SEQ ID NO: 70549 - protein, 77 aa, Zea mays
  misc_feature: Ceres CLONE 1550452
  misc_feature (51)..(51): Xaa is any aa, unknown, or other
MGGSHSREDLDLSDSDSDDAQSRASRHSSDYGTPTPASASSSWPAAQGRRXRPPSSTPSTATSASSTSVQRAHLPEP

SEQ ID NO: 70550 - DNA, 903 bp, Zea mays
  misc_feature: Ceres CLONE 1550452-R
  misc_feature: Pfam Name: VID27 Pfam Description: VID27 cytoplasmic protein
  misc_feature (641)..(641): n is a, c, t, g, unknown, or other
tccgacagttatgatgagattatcatatatagtccaccaagaaaaggaacaaaacaagattcatctattagtatgatgttacaccccaacattagaagcaatcaacagaccctagcaatcatgctgagaagttagcagcacggagccagtgactgcttgatatgctgaaggaggttgagcttcataggcgcagcacagagctagtgaccgcttgatatgctgaaggaggtgaccatcataggggtagccaccaccagtggagcctccggggagtcgctgaccgaatacctgtcgtgcataaagcggctggccacaatcgactcgtccttggggatcaccttgtagcaatagcaggtcttaagtccctcctggtactggtagcactcgtggtggctgttcttcacctgcaagaagttccacaccacgctgtacttccccaccgtggccactagatgccgctcctgcttcccgttctccgtcacccatgagaatcttccctccctgaacctgctgtttgctcctgctagatgagaatccagtgggttgagcttcagcagccttggagcagcaattcggttccccagtctcccactaaaacccggtcctctcctttccatctttgtcaatgaagatgtgcatantagaatcaggtatgtatctgttggtcccagaactccacttcccatcatatgtcacgtcgactgggggaatgggtgaccccaaacccagaaaggctgtctttgccatcctccataaaggtcttaaaaaacaaggggatcttcccttccatggacccaacacaatcgaaccatccccaagtggaagcgaacccctgggaagtttgccccccgggaaaaactgaagccccctggagccattggaataccgggggaacccatttgg

SEQ ID NO: 70551 - DNA, 680 bp, Zea mays
  misc_feature: Ceres CLONE 1550455
  misc_feature (252)..(252): n is a, c, t, g, unknown, or other
  misc_feature (291)..(291): n is a, c, t, g, unknown, or other
  misc_feature (313)..(313): n is a, c, t, g, unknown, or other
  misc_feature (314)..(314): n is a, c, t, g, unknown, or other
  misc_feature (315)..(315): n is a, c, t, g, unknown, or other
aaagctggagctcaccgcggtggcggccgctctagaactagtggatcccccgggctgcaggaattcgtctcacccctagaaaaaagtccctccccgctcaccaccagtcaccaacgcccaccgggcctcgtccctcgtggcggcaactgggcggccgtcgctgccgccctacgccaggtgccgaggcgaccttcaggcccttggctggcgacgagcaccagtgcaccaccaatactctgagcctggctgccngaagtgccttttgggggtcttttgtatcttgtacattangatttcatttttgatgacttcnnntcagaagcagagccagagcagaaagtaggagccgcaatcgcagcaagagcaagagccgcactcctcggcgaaaagattggttgcgcaatgaacgtgcaccccaccccaatcttatcccgagccccaaaccataacgtttcaaaagaaacacatggtcacacgggattttgcatgcgagaactgcccgagacctcggcacttccctaaagagagtccccctgcgcccatgtggccataactgggacccttccccgccacttttgcgcgcaatgcgcccttcaaaatgttttgctgggacttcaaaaaatctcggcccattgccccggagatgcaaaaaacaaggcctatttgccgcgctgggaaaa

SEQ ID NO: 70552 - DNA, 725 bp, Zea mays
  misc_feature: Ceres CLONE 1550459
  misc_feature: Translation starting site: 286
  misc_feature: SWISSPROT Homolog: EC 2.4.2.7 Adenine phosphoribosyltransferase
  misc_feature (376)..(376): n is a, c, t, g, unknown, or other
  misc_feature (463)..(463): n is a, c, t, g, unknown, or other
  misc_feature (476)..(476): n is a, c, t, g, unknown, or other
aagctggagctccccgcggtggcggccgctctagaactagtggatcccccgggctgcaggaattcgtctcacccctagaaaaactgccagtcttgcatcccgtccccgtccgcgccggccgacgccgccttttcgtccccgcgtcagcgtcgcggctccactgagcgtgcgtgtcaccggcgggaggcaagggcaggcggtggtggcgatggcgtccgctgacgcgcgcttggcggggatcgcctcctccatctgcgtcatccccgactttcccaagcagggatcatgttccaggacatcacgacgttgctgctcgatcccaaggcgttccgtgacaccatcgacctctttgtcgagcggtacaaggaccaagggnatcacgtggttgctggtgttgaaagctagagggtcatttttggtcctcctatcgctttagccatggcgcaaaatttgtgcctttgangaaagcgaagaangtgccaggcgaggtgatctcagaagagtattctttggaatatggaactgacaagatagaaatgcatgtcggagctgtacaggccaacgaccgggctcttgtagtaatgatcctattgctacgggtggaacactatgtgcagctgtcaaactaattgaacgtgtggaacaaagggttgttgaatgggcctgggtcattgaattgccagaactgaagggcaaaacaagctgggggaaaggccagttttttt

SEQ ID NO: 70553 - DNA, 670 bp, Zea mays
  misc_feature: Ceres CLONE 1550460
  misc_feature: Encodes the peptide sequence at SEQ ID NO. 70554
  misc_feature (390)..(390): n is a, c, t, g, unknown, or other
ctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcntgtcctcccggtccggctcccggcggcacgtgcggctgccgaggatcagctgcagcgccaccgaaggagtcagcgggcccgtgtcctccgtcaccgtggagaggatgctcacggtgaacggcctcggtgggaggcctcccccggccatcgggcagatgtactttccagcgcgcccttcgaacaacatccggcaaccttccctcggaaagcaccctgcttgctcgaacctcgtcaactcccaaacctcgaccccaaaaggcgggcgggtggaaaaagaacg

SEQ ID NO: 70554 - protein, 134 aa, Zea mays
  misc_feature: Ceres CLONE 1550460
  misc_feature (42)..(42): Xaa is any aa, unknown, or other
MMNLNLKQPLVLPAHHSNVVGSRLSSSSPSAAAASRRTGGGXSSRSGSRRHVRLPRISCSATEGVSGPVSSVTVERMLTVNGLGGRPPPAIGQMYFPARPSNNIRQPSLGKHPACSNLVNSQTSTPKGGRVEKE

SEQ ID NO: 70555 - DNA, 725 bp, Zea mays
  misc_feature: Ceres CLONE 1550464
  misc_feature: Encodes the peptide sequence at SEQ ID NO. 70556
  misc_feature (1)..(1): n is a, c, t, g, unknown, or other
  misc_feature (448)..(448): n is a, c, t, g, unknown, or other
  misc_feature (602)..(602): n is a, c, t, g, unknown, or other
  misc_feature (619)..(619): n is a, c, t, g, unknown, or other
  misc_feature (640)..(640): n is a, c, t, g, unknown, or other
naaagctggagctccccgcggtggcggccgctctagaactagtggatcccccgggctgcaggaattcgtctcacccctagaaaaactactgggtgaccgccgcctctgccgccctacgccaggttccaggtcttcgtcactccctttcattatcttcgtcgtctcattcgccggcgacgagcacccaccagaaatcatagctgctttgggtatggaggcgctgtttgggagcaataaccatggcggccacaaggccgctgatttggcctcgcttataattacccaggttgccttggaggtgccaaggttacttgggctccttgccatgattctgcataatgaaatctttacatctggtggagaccagaatttgattactaggattctgggcaaaagcgaagatgacactaatcctgagaacaaagatgatggagagtccgatgatgantatgatgatgaaggagacgatgatgatgctgaaaacgaagaggaagatgatggtggtgatgagggatcagatgacaatgagaatgaggaagatgacgatggagatgatgatgatcctgcagccaatggcgaagggggaagcgatgaccaccaanatgatgggtgaagaggnatgaaaaggatgatgacaacnacaaccatgatggggacaattgccattggaggaagaggaggaagatcctgaaaagatgatgattattttgaagtcccccaacccc

SEQ ID NO: 70556 - protein, 133 aa, Zea mays
  misc_feature: Ceres CLONE 1550464
  misc_feature (79)..(79): Xaa is any aa, unknown, or other
  misc_feature (131)..(131): Xaa is any aa, unknown, or other
MEALFGSNNHGGHKAADLASLIITQVALEVPRLLGLLAMILHNEIFTSGGDQNLITRILGKSEDDTNPENKDDGESDDXYDDEGDDDDAENEEEDDGGDEGSDDNENEEDDDGDDDDPAANGEGGSDDHQXDG

SEQ ID NO: 70557 - DNA, 666 bp, Zea mays
  misc_feature: Ceres CLONE 1550465
  misc_feature: Encodes the peptide sequence at SEQ ID NO. 70558
acccgcggtggcggccgctctagaactagtggatcccccgggctgcaggaattcgtctcacccctagaaaaaaaagacgcaaccagtttctctttccctcccgattttctgtttttcttctcttggattgggctcaccctgctcaaaacttcggcggcagcggcagcggtagcggtggcggcgccggctttctccatgaacacggtggctttgttgtccttggcgccgcagctgctcattaagccctccctcacctgtttctccagaaagggcgttggccgctatggcggaatcaaggtgtacgccgtgctcagagacgacggagctgagtttgccaagaacaacacctggaggccctgttccatggggatgacccccggcccaagggtccccatcaaaaaagcgcagttcccgggacgtgaacaagctcctcgagggggcccgtttttgactcccaatactggcaactggggggccccggctttattctccccaccctcctgggtcccccccaaaaaaggggggagaagggcccccaccccccctaacgggggaatttcaaggccatgggggaccttgaagaaaaaactttggcccaactccccgggggacttgggaaaaacttcacaactcggggtctcccctgggaaacacaagaacctctct

SEQ ID NO: 70558 - protein, 157 aa, Zea mays
  misc_feature: Ceres CLONE 1550465
  misc_feature: SWISSPROT Homolog: EC 1.13.12.14 Chlorophyllide-a oxygenase
MNTVALLSLAPQLLIKPSLTCFSRKGVGRYGGIKVYAVLRDDGAEFAKNNTWRPCSMGMTPGPRVPIKKAQFPGREQAPRGGPFLTPNTGNWGAPALFSPPSWVPPKKGGRRAPTPPNGGISRPWGTLKKKLWPNSPGDLGKTSQLGVSPGKHKNLS

SEQ ID NO: 70559 - DNA, 720 bp, Zea mays
  misc_feature: Ceres CLONE 1550466
  misc_feature: Encodes the peptide sequence at SEQ ID NO. 70560
  misc_feature (307)..(307): n is a, c, t, g, unknown, or other
  misc_feature (316)..(316): n is a, c, t, g, unknown, or other
aaactggagctccccgcggtggcggccgctctagaactagtggatcccccgggctgcaggaattcgtctcacccctagaaaaacctcactcctttgtctcctcgcctcgtgctcgctcgctcccctcgccctggcgaggagggcagcagaaaccctagcggctcaggccgggcgggggttagatgctccaaggttcgagagggaagggtaggttagtggtgcgccatcgactatgggctgcgtcttcggccgggcggctgcgtcgtcctctgcagcgcccaagaatatgtggggcaaggggaggtcntccccgcanccccaagcggggtcgccctccgcagtcgccgccaccgacgggtactgtaggccccccccgcgggggggggggggaatatcttcaggaacccacccatggtttgctcccccccggatagccgaggaggaacaactcggccgcggggtggccaccctggcctcttccaaatttccctgggaaggcccctccccggggtgggcgcccgcgtctccgtcgaaattgtttcgaaaaattttaataagaaaaggatcggggcccttatccgcacacgggtccccaggtgaaaggacaccgcctcctggccctgtccgtcccctcccacaagaggccccgctcccaaagcccttgggccagaaaagcctcccagtttgtggggcccgcaaaatacccgtcctaaacacacc

SEQ ID NO: 70560 - protein, 162 aa, Zea mays
  misc_feature: Ceres CLONE 1550466
  misc_feature (28)..(28): Xaa is any aa, unknown, or other
MGCVFGRAAASSSAAPKNMWGKGRSSPXPQAGSPSAVAATDGYCRPPPRGGGGISSGTHPWFAPPRIAEEEQLGRGVATLASSKFPWEGPSPGWAPASPSKLFRKILIRKGSGPLSAHGSPGERTPPPGPVRPLPQEAPLPKPLGQKSLPVCGARKIPVLNT

SEQ ID NO: 70561 - DNA, 688 bp, Zea mays
  misc_feature: Ceres CLONE 1550467
  misc_feature: Encodes the peptide sequence at SEQ ID NO. 70562
  misc_feature (514)..(514): n is a, c, t, g, unknown, or other
aaagctggagctcaccgcggtggcggccgctctagaactagtggatcccccgggctgcaggaattcgtctcacccctagaaaaaactggaacacacgaaaaaagagatgtgaacgagctagccttcctatctatcctgctggtgtacgtaatcaatcttcaaatgaagaccagcaattgtctggtgatttgaacggtggcgagaacatgtccaatgatcttctatccggaaacagcctttgtctaccagattttaacaatgacagtttccttgcgaaactgcaggctttaccaccacagctgccagctgtttcaataagcaatttgctcggccaaagctttgcatcaaaaggttgtagcttcatggatcaggtagaccaagcagggatgctgaaacaatctggcagtgcgcttcctacattgagcgatgccattgacgatgtgatttcctcggttgatcaattttcaaatgactctgagaagctcatgcagactttaggtttttgttatctcantgaaagccacgctaccagcaagagtattgtgcctttcggggttgcacttactggcagccatgcccctttaaatggtatttctctgcttctaggctcacaaatggtccttcaaagatggagcccccttcattccaaaatacaggctcaagtaacctggggatcctgcattgcagc

SEQ ID NO: 70562 - protein, 160 aa, Zea mays
  misc_feature: Ceres CLONE 1550467
  misc_feature (103)..(103): Xaa is any aa, unknown, or other
MSNDLLSGNSLCLPDFNNDSFLAKLQALPPQLPAVSISNLLGQSFASKGCSFMDQVDQAGMLKQSGSALPTLSDAIDDVISSVDQFSNDSEKLMQTLGFCYLXESHATSKSIVPFGVALTGSHAPLNGISLLLGSQMVLQRWSPLHSKIQAQVTWGSCIA

SEQ ID NO: 70563 - DNA, 703 bp, Zea mays
  misc_feature: Ceres CLONE 1550468
  misc_feature: Translation starting site: 116
aaagctggagctccccgcggtggcggccgctctagaactagtggatcccccgggctgcaggaattcgtctcacccctagaaaaactatgatgccttgatcagctgtacaccagaaatggttgacgttctcgttgacagtgtgaggaatccagcattcctcgattgcgaggtcaaagaacatctccagaatatagaatctgacatagctgatgcttctgctaatcgtcacggtctacttctggatgcccttcattcggttggatattccggggcactgcacaaacctttgatggcttcagaatctgatgtaaaccagttggatgttagcatcttggaggaatttgttgctgaacattacactgctgccatgatggttcttgcgagatcacgacttgatcatgatgcgctgatctcatatgtaacaccacgtctgtatgaacttccgtgcctgaacagtctgaatagcaatatctgtgtacgatggaagagactattccctgcgagaagattctcccaacccccacttccagttgttttttgagttgcccggaggttggaaccaaaacaacctgggagggtatgtaacatgtcccaaatgtcctcgggggggacgggaggtctctttccccctggagggccccggaaaaagaaatccattccgagtggaaaaacgggtttcttaacaaattccgacaaagtgaaa

SEQ ID NO: 70564 - DNA, 693 bp, Zea mays
  misc_feature: Ceres CLONE 1550470
  misc_feature: Encodes the peptide sequence at SEQ ID NO. 70565
aagctggagctccccgcggtggcggccgctctagaactagtggatcccccgggctgcaggaattcgtctcacccctagaaaaaacggctcagtcaccaacccactcatcactcctcactcactcactcaaaacgaaagccagctcagctcagctctgctcagctcatctgctcacacctcacacccacaggccggccgccacagcaccgcggatagcagagcggcagctaggtcggtcgtcgtcgtcgtcgtcagccatgagcaaggacaagcaccacaagcacgagcaccacctgcggcgttgctgcgggtgcatggcgtcgtgcctcctggcgctggtcctcatcgtggccttcgtctcgctggtggtgtacctggcgctgcgcccctcgaagccgtccttctacctgcaggacctgcagctgcgcaggcccatctcgctgggcgacccgtcgctgacggcgtcggcgcaggtgacgctggcctcccgcaaccccaacgaccgcgtgggcatcttctacaagcgcctggacgtgttcgtcacctaccgcgacgaggccgtgacggtgcccgtgtctctgccgccgcagtaccagggccaccgcgacttcaccgtctggtcccccgtgctgtcggccgagtccgtgcccgtggccgcctacgtcgccgacgccatgaagcaggacgtcgccg

SEQ ID NO: 70565 - protein, 145 aa, Zea mays
  misc_feature: Ceres CLONE 1550470
  misc_feature (39)..(144): Pfam Name: Hin1 Pfam Description: Harpin-induced protein 1 (Hin1)
MSKDKHHKHEHHLRRCCGCMASCLLALVLIVAFVSLVVYLALRPSKPSFYLQDLQLRRPISLGDPSLTASAQVTLASRNPNDRVGIFYKRLDVFVTYRDEAVTVPVSLPPQYQGHRDFTVWSPVLSAESVPVAAYVADAMKQDVA

SEQ ID NO: 70566 - DNA, 669 bp, Zea mays
  misc_feature: Ceres CLONE 1550472
  misc_feature (559)..(559): n is a, c, t, g, unknown, or other
  misc_feature (669)..(669): n is a, c, t, g, unknown, or other
ctccccgcggtggcggccgctctagaactagtggatcccccgggctgcaggaattcgtctcacccctagaaaaagcccctcccactcaccgctggacacttccatcaatctctttcccccttcccttggattcgtttcagctactgaaactgaacgcgggcagtggcaggcaggatcagccgagccgagttccatttccgccaccgtcccttccccctctgcccctcgttcctcgtcttctctatttgcttggcttggcttgcttttggttcaacttccacaccattcattcatttcttggatttctttggtggcgtccgcaagtcaagtcccttcccccttccgcccctcgtcaaagcaagcaagcaaaagtggtgcggtgccatcagagtaagcaagctccccattttccctattcctatactactactagtagctgcagcagcatccaccggatggccatgtccagcgacaccgccggcccgacggggacatgcaccaagcccaaccccaaccaccgccttccactctcaatagcctgattgattcatggccttcngccccaacaaccggcttttctccggtaccggggtcctcgggggcccactgccacaccgcccgaaaccggttccacgcccccgccccttaacctttccggaacccgcggtn

SEQ ID NO: 70567 - DNA, 726 bp, Zea mays
  misc_feature: Ceres CLONE 1550473
  misc_feature: Translation starting site: 248
  misc_feature (352)..(352): n is a, c, t, g, unknown, or other
  misc_feature (356)..(356): n is a, c, t, g, unknown, or other
  misc_feature (357)..(357): n is a, c, t, g, unknown, or other
  misc_feature (469)..(469): n is a, c, t, g, unknown, or other
  misc_feature (473)..(473): n is a, c, t, g, unknown, or other
  misc_feature (475)..(475): n is a, c, t, g, unknown, or other
  misc_feature (476)..(476): n is a, c, t, g, unknown, or other
  misc_feature (558)..(558): n is a, c, t, g, unknown, or other
aaagctggagctccccgcggtggcggccgctctagaactagtggatcccccgggctgcaggaattcgtctcacccctagaaaaaacagccctatcaactctcctcgcctgccgtcgccgcctcgcgctctccgatcccgcgcatattctccaccagtcctctgctccgccacacccaccactgctagggcgctgcgccgcaggcccggcagccccctaatccccgagtgctgatcacgcggaaaccgatggcgctcctcgcgccgagcccgcgcgcgctccgcgtgcgggagaccgcggcggcggcggctctcccgcactcatcggcgaccgctgcatgctcgaccgtcggncgcnngggcgccaggcgggcgctgtggctgtgggacaacggcgcgggaccgggacggggaggaagaaggagcaccgggagagagtccggcccgagcgtactgctgggacgtgtccangccngnntgagatggagagatcgacagcatggagaagctcgacgacgcgctcaggtgggtcgtcgagaaacaccaggcggtcgtcatcnactggatggcaaggtggtgtccgaaatgcatctacctgaatgccaaaatggaaaagatggcaggagaatatcctaaggtcaggttttcctcatcgatgtcaataaagtccacaggccgtggtgaaaaaggaattgaactaaaatgcccctattcactttgagggatgg

SEQ ID NO: 70568 - DNA, 726 bp, Zea mays
  misc_feature: Ceres CLONE 1550478
  misc_feature: Encodes the peptide sequence at SEQ ID NO. 70569
  misc_feature (369)..(369): n is a, c, t, g, unknown, or other
ggagctcaccgcggtggcggccgctctagaactagtggatcccccgggctgcaggaattcgtctcacccctagaaaaaacccgactagtcggactcgcagctccgccccaagtccaggtccaagcatggaagtcgcggcggcgtcggcgaggcccgtcctgcgcgtggctgccatctgcggctccctccgcaaggcctccttcaaccgcggcctcctccgcgccgccgcggaggtgtgcgaggactccatcccggggctccgcatcgacgagctcgacatctccgacctgcccatcatcaacaccgaccttgagaccggcagcggcagcggcaccgtcttcccgcccgccgtcgaagccttccgcgccnaggttctgcaggccgactgcttcctcttcggcgcgcccgagtacaactactccatcgccccccccctgaagaacgcgcttgactgggcctctagaggaaagaactgttggggaaacaaacctgctgcaatcctaattgcagggcgccggctttggaagaaggaaggcccattcccctctccccccaggccggggttttcccggaatccctttccccaacaaccaaaaattgggggtccacccttcccagggccccccaatttgaaacagaaggaaaatctggcgcaagctaaaaaaaaaaggggcccaagaaaagggtcctttccctttggggctttccccttaggtgttaaaagag

SEQ ID NO: 70569 - protein, 200 aa, Zea mays
  misc_feature: Ceres CLONE 1550478
  misc_feature (12)..(184): Pfam Name: FMN_red Pfam Description: NADPH-dependent FMN reductase
  misc_feature: SWISSPROT Homolog: EC 1.6.5.2 NAD(P)H dehydrogenase (quinone)
  misc_feature (82)..(82): Xaa is any aa, unknown, or other
MEVAAASARPVLRVAAICGSLRKASFNRGLLRAAAEVCEDSIPGLRIDELDISDLPIINTDLETGSGSGTVFPPAVEAFRAXVLQADCFLFGAPEYNYSIAPPLKNALDWASRGKNCWGNKPAAILIAGRRLWKKEGPFPSPPRPGFSRNPFPQQPKIGGPPFPGPPNLKQKENLAQAKKKRGPRKGSFPFGAFPLGVKR

SEQ ID NO: 70570 - DNA, 734 bp, Zea mays
  misc_feature: Ceres CLONE 1550479
  misc_feature: Encodes the peptide sequence at SEQ ID NO. 70571
  misc_feature (425)..(425): n is a, c, t, g, unknown, or other
  misc_feature (435)..(435): n is a, c, t, g, unknown, or other
  misc_feature (440)..(440): n is a, c, t, g, unknown, or other
aaagctggagctcaccgcggtggcggccgctctagaactagtggatcccccgggctgcaggaattcgtctcacccctagaaaaaatcgcttcagctcggcgtcttcacaaacgccggcgcaaactctcgcccgagcccgacagatcttcaattccccattccgcccaccgatcgaccttcacgccagtctcggtctcttccgaaggcgtcgcgcgcggttgtttgagaggagaggaggaagatgagggagtgcatctccgtccacatcgggcaggccggcatccaagtcggcaacgcgtgctgggaactttactgcctcgagcacggcatccagcctgatggccaagtgcctggagataagaccgcgggacatcacgatgatgccttcagcaccttctttcagcagactggtgctgggaagcacngtccccgtgncatcnttcgtgatctagaacccactgtgatcgatgaagtgcgcactggcacgtaccgccagctcttccaccctgagcagctcatcagtgggcaggaggatgccggctacaatttcgcccgtggcccactacccaattggcaaggaaaattggtgaactgggccctggaccgtattccgcaagctggctgaacattggacccgggcttcagggggttcctggcctttcaaggcccttggggggggggcccggcccctggccttgtttccccctcccctaaacccctggcttgggaaaacc

SEQ ID NO: 70571 - protein, 127 aa, Zea mays
  misc_feature: Ceres CLONE 1550479
  misc_feature (62)..(62): Xaa is any aa, unknown, or other
  misc_feature (65)..(65): Xaa is any aa, unknown, or other
  misc_feature (67)..(67): Xaa is any aa, unknown, or other
MRECISVHIGQAGIQVGNACWELYCLEHGIQPDGQVPGDKTAGHHDDAFSTFFQQTGAGKHXPRXIXRDLEPTVIDEVRTGTYRQLFHPEQLISGQEDAGYNFARGPLPNWQGKLVNWALDRIPQAG

SEQ ID NO: 70572 - DNA, 779 bp, Zea mays
  misc_feature: Ceres CLONE 1550481
  misc_feature: Encodes the peptide sequence at SEQ ID NO. 70573
cgcgcggtggcggccgctctggaactagtggatcccccgggctgcaggaattcgtctcacccctagaaaaagtcttccggccgtccaccgtttccagcacacagggtaaaggcaagcaaacgagcggcgggacggctagcccgcaatacaaaatccggaggaactcccaggaggcgaaaagcagatccgtctcccccgaccggcgatcgctatcgacttgtagcggaagccatggcgtcggcagcgctaatctgcggcacggagcagtggaaggtcctccaggcgcacgtcggcgcgattcagaaaacgcacctgcgcgacctgatggccgacgccgaccgaatgcatggcaatgaccgctggaatttgaggggatcttttctggattacttcgagacagcaggcccactgggtgaaaacattggaagaagctcccttaaaccgggcttgacgcctcccgatatcttcagggagcacgattgcccaagatgtgttcaaacgggggaaaaggaataaattcgccccggaagaaaccgggggaggtgctttctcttgggtgccgtcggcgaggggccccaagggacgatgcaggcccgataaacacatggaagggggggagaaatgggagccccccctggaggacctaggcatatgctctaaacactacaatatcttgcggcgtctctttccgaaaacatttttgttaaaatggcgtgcgacccccgggggtctcgggcagccgacttgtgagataaaccctcgttgagacaatcgcggcc

SEQ ID NO: 70573 - protein, 94 aa, Zea mays
  misc_feature: Ceres CLONE 1550481
  misc_feature: SWISSPROT Homolog: EC 5.3.1.9 Glucose-6-phosphate isomerase
MASAALICGTEQWKVLQAHVGAIQKTHLRDLMADADRMHGNDRWNLRGSFLDYFETAGPLGENIGRSSLKPGLTPPDIFREHDCPRCVQTGEKE

SEQ ID NO: 70574 - DNA, 713 bp, Zea mays
  misc_feature: Ceres CLONE 1550482
  misc_feature: Translation starting site: 468
caaagctggagctcaccgcggtggcggccgctctagaactagtggatcccccgggctgcaggaattcctctcacccctagaaaaagccgccactcagcgccgcgcttgcgtttccttctctccgcttccaaaatgtctaagcgagggcatgcacgttcggctggtaacaagttccggatgtcactggatctaccagtggcagctactgtgaactgtgccgataacactggagccaataacctgtacatcatttctgtgaacggaatcaagggtcgacttaacaggcttccttctgcctgtgttggatgacatggttatggcaaccgcgaacaaaggaaagcctgaccttaaaaagaaggtgatgccagctgttattgtgaccgcatcgcaagccatggcgccgaaaggatggtgtctacatgtactttcaagacaatgctggagtgattgtgaacccaaagggatagatgaaaggttctgccatcactgggcccttcggaaaggagtgtgctgatctctggcccatgattgctagcgcgacaaatgcgatcgtctaaaagaagcactctgacgaactttcatttaaaatggggacttgagaacggagttcttagttacacgagcttttcattgccctgaatgagtttcaccggctaatgcttgtgctgctggaccgctgctgatagctttgcttacatgacatcctcgccgtt

SEQ ID NO: 70575 - DNA, 698 bp, Zea mays
  misc_feature: Ceres CLONE 1550483
  misc_feature: Encodes the peptide sequence at SEQ ID NO. 70576
  misc_feature (506)..(506): n is a, c, t, g, unknown, or other
ggagctccccgcggtggcggccgctctagaactagtggatcccccgggctgcaggaattcgtctcacccctagaaaaaactcagacgccacctgttcttccttcctctcctctctgcaacgcgtcgggaagcagctgccagccatggcaatggcgtcgtcgtcgagcgggctgaggagctgcagcgcattgggcgtgcccagcctgctggcgccgtcgacgtcgtcgtcgtcccggtccggccgcctgccgttctgcgcccacgccaccacctccggccgcgtcaccatgtccgcggagtggatgcccgggcagccccgccccgcccacctcgacggctcctcgccaggtgacttcggcttcgaccccctgggcctggccacggtgccggagaacttcgagcggttcaaggagtcggaggtgtaccactgccggtgggccatgctggccgtgccgggggtgctggtgccggaggcgctggggctgggcaactgggtgaaggcgcangagtgggcggccgtccccggcgggcaggccacgtacctgggcgccccggtgccgtggggcacgctgccgaccatcctgggcgtcgagttcgtggccatcgcctttcgcgaagcacagcgcaccatgggagatgaccccgagtatgataagtaccccggcggcgccttcgacccgctcggctcctcagggacc

SEQ ID NO: 70576 - protein, 185 aa, Zea mays
  misc_feature: Ceres CLONE 1550483
  misc_feature (58)..(184): Pfam Name: Chloroa_b-bind Pfam Description: Chlorophyll A-B binding protein
  misc_feature (121)..(121): Xaa is any aa, unknown, or other
MAMASSSSGLRSCSALGVPSLLAPSTSSSSRSGRLPFCAHATTSGRVTMSAEWMPGQPRPAHLDGSSPGDFGFDPLGLATVPENFERFKESEVYHCRWAMLAVPGVLVPEALGLGNWVKAXEWAAVPGGQATYLGAPVPWGTLPTILGVEFVAIAFREAQRTMGDDPEYDKYPGGAFDPLGSSGT

SEQ ID NO: 70577 - DNA, 665 bp, Zea mays
  misc_feature: Ceres CLONE 1550488
  misc_feature: Encodes the peptide sequence at SEQ ID NO. 70578
  misc_feature (407)..(407): n is a, c, t, g, unknown, or other
  misc_feature (413)..(413): n is a, c, t, g, unknown, or other
  misc_feature (448)..(448): n is a, c, t, g, unknown, or other
agctccccgcggtggcggccgctctagaactagtggatcccccgggctgcaggaattcgtctcacccctagaaaaagtacccgggctttataccaggcttgcgtgttcattcgttgtgtcctcttcttctttctgttctccccgcgtgctctgtctctctcttcctctctgcctctctctctctctctcagcggcgactagggacagccgctgcctccctacgcctggtgcccaggtatcctttgccggcgacgagcacccggggtatgggaatggaggtcgttggtgctgaagcagcaccagcagaggtcaaaatatccgatggagaagtgaatctattccaagagaaggaaagcaaagcaactgcaaaagaacgtgaggaggcagctgtttttggttcagagacnactgcnaatgtcactgatctggcacctccaaggatgcgaangatgagtggcctgaacccgaccaaacttatgtcttctacttcatcaagaatcccctcatttgaggatcctaaactgaggggaaaactccggcaggcttgacaaagatttccaaaaaaaaatcccacctcctttctaaacttttttgggggctttaaaccccaaaaggggcaaacccttccctttttttcccccaaattttaaaccttttggggtcca

SEQ ID NO: 70578 - protein, 93 aa, Zea mays
  misc_feature: Ceres CLONE 1550488
  misc_feature (61)..(61): Xaa is any aa, unknown, or other
MGMEVVGAEAAPAEVKISDGEVNLFQEKESKATAKEREEAAVFGSETTANVTDLAPPRMRXMSGLNPTKLMSSTSSRIPSFEDPKLRGKLRQA

SEQ ID NO: 70579 - DNA, 621 bp, Zea mays
  misc_feature: Ceres CLONE 1550492
  misc_feature: Translation starting site: 153
  misc_feature: SWISSPROT Homolog: EC 1.4.1.2 Glutamate dehydrogenase
  misc_feature (314)..(314): n is a, c, t, g, unknown, or other
  misc_feature (373)..(373): n is a, c, t, g, unknown, or other
gcgcggtggcggccgctctagaactagtggatcccccgggctgcaggaattcgtctcacccctagaaaaactcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatncgagatgcggcccaagaaccaggtcgccatgaaccccatcaacaccgtctttgatgccnagcgtctcatcggcagggagttcagtgatgcgtctgtccagagtgatatcaaggtgtggcccttcaaggtcattttctgggcctgggggagaaccaattgattgttggccagcccaagggttgaggaaaaaccattttgccccctaaaaaaaactccccctttgggtcctatcaaaatgccggaaaattcgtaaacctttcccttgggagccccgaaaaaaaaaggctgggggcacccgtccccggcc

SEQ ID NO: 70580 - DNA, 693 bp, Zea mays
  misc_feature: Ceres CLONE 1550493
  misc_feature: Encodes the peptide sequence at SEQ ID NO. 70581
  misc_feature (511)..(511): n is a, c, t, g, unknown, or other
  misc_feature (590)..(590): n is a, c, t, g, unknown, or other
  misc_feature (612)..(612): n is a, c, t, g, unknown, or other
aaagctggagctcaccgcggtggcggccgctctagaactagtggatcccccgggctgcaggaattcgtctcacccctagaaaaaggcagtgcaagcccaggcagcctcatcccatcccctcaggcctcagtcgtcagtccctcacacactcactatacactgctctgctgcagcaagaaggaagaagctagcgcctccctagctctcgttgtcagcaatggccaccaccgccgcgtccagcctcctcaagtcctccttcgcgggctcccggctcccttcggccacgcgcaccaccaccccgtcgtccgtggccgtggccaccccgcgcgccggcggcggccccatccgcgcgtccatctcctcctcccccaccccgccctacgacctgacgtccttccggttcagccccatcaaggagtccatcgtgtcccgcgagatgacccggcgctacatgacggacatgatcacccacgccgacaccgacgtggtgatcgtgggcgccgggtccgcnggcctgtcctgcgcgtacgagctgtccaagggaccctccgtgaggcgtcgcatcgtggagcagtccgtgtccccgggcngcgcccctggctgggcggccanctgttctcggccatgtggttgcccaggccgggccactgttccctgaacaacttgggctgggctacaacaaggcgaggaata

SEQ ID NO: 70581 - protein, 146 aa, Zea mays
  misc_feature: Ceres CLONE 1550493
  misc_feature (125)..(125): Xaa is any aa, unknown, or other
  misc_feature (132)..(132): Xaa is any aa, unknown, or other
MATTAASSLLKSSFAGSRLPSATRTTTPSSVAVATPRAGGGPIRASISSSPTPPYDLTSFRFSPIKESIVSREMTRRYMTDMITHADTDVVIVGAGSAGLSCAYELSKGPSVRRRIVEQSVSPGXAPGWAAXCSRPCGCPGRATVP

SEQ ID NO: 70582 - DNA, 718 bp, Zea mays
  misc_feature: Ceres CLONE 1550495
  misc_feature: Encodes the peptide sequence at SEQ ID NO. 70583
  misc_feature (389)..(389): n is a, c, t, g, unknown, or other
  misc_feature (529)..(529): n is a, c, t, g, unknown, or other
aaagctggagctccccgcggtggcggccgctctagaactagtggatcccccgggctgcaggaattcgtctcacccctagaaaaagacgcaccccttcctcgtttcgccgcctccgccgacaccgactgcctacctcagctgccgtcgccatgggcagaaggcctgctagatgctatcgccagatcaagaacaagccataccctaagtccaggtactgccgtggtgtccctgaccccaagatcaggatctacgatgttgggatgaagaggaagggtgttgatgagttcccctattgtgtgcaccttgtctcttgggagaaggagaatgtctccagtgaggcgcttgaggctgcccgcattgcctgcaacaagtacatgaccaagtctgcnagaaaggatgctttccaccttagggtccgggttcacccgttccatgtcctccgtatcaacaagatgctttcgtgtgctggggctgataggctccagactggaatgaggggtgctttggcaagcctcagggcactgtgctnaggtggacattgttcaagtcctcctttccgtgcgatgcaagaacacaatgctgcccatggcagcgaaactctgcttcccgctaagtccagtttccctggcgcccaaaaatcatggaaagccaaaagtggggtttcccaagttccacccccctactacctgaagtaaagaaccaggcaaaatttttccga

SEQ ID NO: 70583 - protein, 181 aa, Zea mays
  misc_feature: Ceres CLONE 1550495
  misc_feature (5)..(160): Pfam Name: Ribosomal_L16 Pfam Description: Ribosomal protein L16
  misc_feature (127)..(127): Xaa is any aa, unknown, or other
MGRRPARCYRQIKNKPYPKSRYCRGVPDPKIRIYDVGMKRKGVDEFPYCVHLVSWEKENVSSEALEAARIACNKYMTKSARKDAFHLRVRVHPFHVLRINKMLSCAGADRLQTGMRGALASLRALCXGGHCSSPPFRAMQEHNAAHGSETLLPAKSSFPGAQKSWKAKSGVSQVPPPYYLK

SEQ ID NO: 70584 - DNA, 700 bp, Zea mays
  misc_feature: Ceres CLONE 1550496
  misc_feature: Encodes the peptide sequence at SEQ ID NO. 70585
  misc_feature (484)..(484): n is a, c, t, g, unknown, or other
  misc_feature (504)..(504): n is a, c, t, g, unknown, or other
  misc_feature (608)..(608): n is a, c, t, g, unknown, or other
  misc_feature (610)..(610): n is a, c, t, g, unknown, or other
  misc_feature (611)..(611): n is a, c, t, g, unknown, or other
caaagctggagctcaccgcggtggcggccgctctagaactagtggatcccccgggctgcaggaattcctctcacccctagaaaaaaagccggacgacgcagcgtagcagcagaaagccagagaccagagatggccgccctcgccgccgcctccacggccgccttcgccgcgaagccgcgcgcgcgcctctccgtggcctgctccgccgccaccggcgacagcagcagcgtgtcgctcgcgtcctccgtgaagacgttctccgccgcgctggcgctgtcgtcggtgctgctgtcctcggccgccacctcccctccgcccgcggccgccgacatcgcggggctgaccccgtgcaaggagtccaaggcgttcgcgaagcgcgagaagaactcgatcaagaagctcaccgcgtcgctgaagaagtacgcgcccgacagcgcccccgcgctcgccatcaacgccaccatcgagaagaccaagcgcccgntcgagaactacggcaagtcngggctgctgtgcggcgccaacggcctgccgcacctcatcgtcagcggcgacccagcgcactggggcgagttcgtcacccggggcctgctcttcctttaatcccngnntggattgggttggtccggcagaactacctcatcgccatcaccggcaaaaaaccccccttgagggaaccttcctcgacgttcaacccccc

SEQ ID NO: 70585 - protein, 157 aa, Zea mays
  misc_feature: Ceres CLONE 1550496
  misc_feature (42)..(157): Pfam Name: PSI_PsaF Pfam Description: Photosystem I reaction centre subunit III
  misc_feature (119)..(119): Xaa is any aa, unknown, or other
MAALAAASTAAFAAKPRARLSVACSAATGDSSSVSLASSVKTFSAALALSSVLLSSAATSPPPAAADIAGLTPCKESKAFAKREKNSIKKLTASLKKYAPDSAPALAINATIEKTKRPXENYGKSGLLCGANGLPHLIVSGDPAHWGEFVTRGLLFL

SEQ ID NO: 70586 - DNA, 628 bp, Zea mays
  misc_feature: Ceres CLONE 1550498
  misc_feature: Translation starting site: 158
  misc_feature: SWISSPROT Homolog: EC 1.4.1.2 Glutamate dehydrogenase
  misc_feature (377)..(377): n is a, c, t, g, unknown, or other
tcgccgcggtggcggccgctctagaactagtggatcccccgggctgcaggaattcgtctcacccctagaaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcgggcaagaaccaggtcgccatgaacccccatcacaccgtctttgatgccnagcgtctcatcggcagggagttcagtgatgcgtctgtccagagtgatatcaagttgtggcccttcaggtcatttttcttggccctgtgagaccccaatgatttgtgttcagcccaagggtgaggagaagcattttgcagcttgagagatcttctccatggttcctatccagatgcgtggaaattgctaagctttaccttgggagcccgatcaaaaatggctgggggtcaaagtcccttgccttacttaaag

SEQ ID NO: 70587 - DNA, 702 bp, Zea mays
  misc_feature: Ceres CLONE 1550501
  misc_feature: Translation starting site: 396
  misc_feature: SWISSPROT Homolog: EC 3.2.1.14 Chitinase
  misc_feature (466)..(466): n is a, c, t, g, unknown, or other
  misc_feature (563)..(563): n is a, c, t, g, unknown, or other
caaagctggagctcaccgcggtggcggccgctctagaactagtggatcccccgggctgcaggaattcgtctcacccctagaaaaacacaccacccaaactaaacaacaccagcttctctcacgatcacgatgatgagagccctggcggtggtggccatggtggccaccgccttattcttcgctgtgcccgctcgcgccgagcagtgcgggtcgcaggccggcggcgcgctgtgccccaactgcctgtgctgcagccagttcgggtggtgcggcagcacctccgactactgcggcagcgggtgccagagccagtgcagcggcagctgcggcagcaccccgaacccgccgagcagcggcggcgtggcgtccatcatccccgagtcgctcttcaacagatgctgctgcaccgcaacgacgcggcgtgccccgccaacggcttctacacctacgcgggcttcatcgcggncgccaacgcgtttccgggcttcggcaccacgggggcgcccgacgtgcagaaacgcgagctggcggcgttcctggcgcagacgtcgcaccagacaacnggcgggttgggcgaacggcccccgacggggccctacgcctgggggttacttgtttcaagaagaacaagggcggccctccggggcccgaattattgcaaacccagcgcccaagggcccttgcgccccggggaaaaaaaaa

SEQ ID NO: 70588 - DNA, 695 bp, Zea mays
  misc_feature: Ceres CLONE 1550502
  misc_feature: Encodes the peptide sequence at SEQ ID NO. 70589
  misc_feature (298)..(298): n is a, c, t, g, unknown, or other
  misc_feature (300)..(300): n is a, c, t, g, unknown, or other
  misc_feature (303)..(303): n is a, c, t, g, unknown, or other
  misc_feature (695)..(695): n is a, c, t, g, unknown, or other
acccgcggtggcggccgctctagaactagtggatcccccgggctgcaggaattcgtctcacccctagaaaaatcccacccctcgcccaatgcgtagttgtatctgcatctccaacaccaccagcagaggttccagttagttttttttagattagaaaaatcgagtccaacagactcgccgcactgcgcgggatcgacctcgtcgcaactcccgtgtgcgccgccaataatggagacccgggacacggatgcgacgccgctcccctactcgtacacgccgctgccgggcgccgacgccncntcngccgaggtctccggcaccggcaggacgcggagcaggcggcggcccctctgccccgcgggggtgggggggggggcccccctgctcctacccgtggcctccctcgtcggcgtccgtagccggccccgcgcggtggggatgacaaaatccgcgggctcgtccccgaccccgaggaggatccggggcccccaagggccggccgggccccaaaagaccttccgggcccgtccgaaacaaggggggcagggctcccgggaaagccgagcggaaacccccttccccggggagagaacgcccatgcttccagcgggcagccccacgcggaattccccctttccagggccggcaaaaaaaactgggttggcgcctgcccccgaatggggcccccacgggan

SEQ ID NO: 70589 - protein, 155 aa, Zea mays
  misc_feature: Ceres CLONE 1550502
  misc_feature (24)..(24): Xaa is any aa, unknown, or other
METRDTDATPLPYSYTPLPGADAXSAEVSGTGRTRSRRRPLCPAGVGGGAPLLLPVASLVGVRSRPRAVGMTKSAGSSPTPRRIRGPQGPAGPQKTFRARPKQGGQGSRESRAETPFPGERTPMLPAGSPTRNSPFPGPAKKTGLAPAPEWGPHG

SEQ ID NO: 70590 - DNA, 737 bp, Zea mays
  misc_feature: Ceres CLONE 1550503
  misc_feature: Encodes the peptide sequence at SEQ ID NO. 70591
caaagctggagctcacccgcggtggcggcgctctagaactagtggatcccccgggctgcaggaattcgtctcacccctagaaaaatccaggcagcacagctccctccccactcgaggctccgagctttattttttcttgttttgtttcgttttcttggcaggagtaataatagattctggtagccttcttcctcctcgctctctacccgaggagagaggagaggagagaaatccggaggcaaagcttcagggtttgtataaagggattctagatctaatcgactaaccagagagaaaaaaaacaaaaaataacgcgagaaagcatgagccacttcgccgccgccgccgtgaagagccccctcgacgtggccgcgcccgccgccggcgacgccaagagcccgctcttctgccccaaagcgcggcgccccgcggcgcccctgcggtgccaccagggcggcaactccggcatgtatctgctcgaactcctcctgtcaaagggagagaagagcggcctgtcgggagctttcccagcttttctgcggttccccgcccccgcagggtttttaacccggtggtacaaaaaaggccggtaattcttggaattgcccaacccttgcccggggccacttcccattaaaggaacgtttacattaaacctgaccgtagggaaagcccccccccttaatattccatatggcccggccaattgttgcacccccgaaatcaaaggtttggtg

SEQ ID NO: 70591 - protein, 89 aa, Zea mays
  misc_feature: Ceres CLONE 1550503
MSHFAAAAVKSPLDVAAPAAGDAKSPLFCPKARRPAAPLRCHQGGNSGMYLLELLLSKGEKSGLSGAFPAFLRFPAPAGFLTRWYKKGR

SEQ ID NO: 70592 - DNA, 666 bp, Zea mays
  misc_feature: Ceres CLONE 1550505
  misc_feature: Encodes the peptide sequence at SEQ ID NO. 70593
ctccccgcggtggcggccgctctagaactagtggatcccccgggctgcaggaattcgtctcacccctagaaaaaaacccttcacatcccgtacccgtcgccagcaagcaagcgctccccgcgtgttcacacctcgacctgcgacgtgaggccggcgtggaccagccgccgaccacacgcctgggagtctgccagccgccgccgaccgccgcaagggggaggagagatgaagtgggggctggcagccgccgtggcttccgcggcgaccgtggcggcggcgtcgggcgccgagctcctcgcctgcgactgcgacgcctctgctccgtcgccggcccctgccgcgaccgtcggcaggtgcgacgggctggtgctctcccggcagcaccacgacgacgaggtccctgagggatcctcgtcggcgtcgagagacaacgccatagcggcggtcgccgcgggagcggttcgcgcccccattcatggcctgcgcttcatcgaaaggctcgtcacggccccccgctgaagcgacggacccgcgaaccccctggctgcctatgctcccggtggaaatccccccgcccccatggttcggcaattcgttgttccctggtggccgctttcgccccccaagtttttttttcaaaaacacatttcggcttcccctttttcc

SEQ ID NO: 70593 - protein, 97 aa, Zea mays
  misc_feature: Ceres CLONE 1550505
MKWGLAAAVASAATVAAASGAELLACDCDASAPSPAPAATVGRCDGLVLSRQHHDDEVPEGSSSASRDNAIAAVAAGAVRAPIHGLRFIERLVTAPR

SEQ ID NO: 70594 - DNA, 763 bp, Zea mays
  misc_feature: Ceres CLONE 1550507
  misc_feature (273)..(273): n is a, c, t, g, unknown, or other
  misc_feature (519)..(519): n is a, c, t, g, unknown, or other
  misc_feature (625)..(625): n is a, c, t, g, unknown, or other
  misc_feature (626)..(626): n is a, c, t, g, unknown, or other
  misc_feature (658)..(658): n is a, c, t, g, unknown, or other
cttagctgtagctcaccgcggtggcggccgctctagaactagtggatcccccgggctgcaggaattcgtctcacccctagaaaaaacaagctcgaccaccaacccagctcgctcgtcccagctgatcaggtcgagcacctagtagcgacctgctcgatcatcagtgtagagtgtcagtaggtgtctgtctctcttggtgggtggttgcaacggtcatggctacgtcttctcgtcgggtgcccttgctgctgctgtgcctgggcgtgctggtgntctgatccttcgcggcgggcagcttggaccaggagctggacatcacgtggggcgacgggggtggtatggtcctttgacacgggcggttgctcaccctttctttggacggagggtcgggctccgggttcccccccccccccccataccttgttcgggaagatcgaacttgaaactgcggcttgggtgcgggaaacttccccggggaccgttcccgccctactaccttgttctaccccaggcggggcngccacgaaaagatcgaatttcaatttccttggggtaacattttccgggggaggccttaaccttttgaaacacccaaactttttaccacctgtaggaagggggccgnnggggaacgaacatttcccccaccccggggttngtctccctcccgctgaatttgcaaacctaatatctatatcccttgggaaccccacggacgagtctctactttctagggggggagaaaaattcgcccctattcggg

SEQ ID NO: 70595 - DNA, 741 bp, Zea mays
  misc_feature: Ceres CLONE 1550509
  misc_feature: Encodes the peptide sequence at SEQ ID NO. 70596
  misc_feature (36)..(36): n is a, c, t, g, unknown, or other
  misc_feature (320)..(320): n is a, c, t, g, unknown, or other
  misc_feature (322)..(322): n is a, c, t, g, unknown, or other
  misc_feature (353)..(353): n is a, c, t, g, unknown, or other
caatgctggagctccccgcggtggcggccgctctangactagtggatcccccggggctgcaggatttcgtctcacccttagaaaaaaccgaagcatccaccccaatcagatccgatttcgtagagatgaagcccggcagtagaggcggatgctgacgagcgagcggcggaggagatggcacctaagaaggcagcggctgccaagaaagcggccgaggaagttgaggtggaggaggtggtggacggggacgaggcggtcgatggggagggcgacggtgacgaggacgacgatggggaaggcggtgacgaggaggatataangnaaagtggaatggggaaaaaaaaaagaagccnccagggttttgtgaatatctccaacaaaaacaacaacaacggtgacgggaaggcggacaacgaccacaacaatgacggggatgacgacgacgactacgactaggactcatacgacgaggaagaggtcgacggtgaagacgatcaggaggaggagctgggaaccgagtatctggttcagcctcttgggcgggctgaagacgaagagcactcgagcgactttgaaccggaagataacggtgagggtgccgacgatgaggagatcgatgaagaggacgatgacggtgaggactctgtgaatgcgcagacctctacgaagaggagaggtcaggcgacgaagaataagagacgacgacgatggggatgatgatggtgacgatgatgacgatgt

SEQ ID NO: 70596 - protein, 93 aa, Zea mays
  misc_feature: Ceres CLONE 1550509
  misc_feature (49)..(49): Xaa is any aa, unknown, or other
  misc_feature (50)..(50): Xaa is any aa, unknown, or other
  misc_feature (60)..(60): Xaa is any aa, unknown, or other
MAPKKAAAAKKAAEEVEVEEVVDGDEAVDGEGDGDEDDDGEGGDEEDIXXSGMGKKKRSXQGFVNISNKNNNNGDGKADNDHNNDGDDDDDYD

SEQ ID NO: 70597 - DNA, 714 bp, Zea mays
  misc_feature: Ceres CLONE 1550513
  misc_feature: Translation starting site: 120
  misc_feature: SWISSPROT Homolog: EC 3.1.3.11 Fructose-bisphosphatase
  misc_feature (337)..(337): n is a, c, t, g, unknown, or other
  misc_feature (556)..(556): n is a, c, t, g, unknown, or other
ctggagctccccgcggtggcggccgctctagaactagtggatcccccgggctgcaggaattcgtctcacccctagaaaaagcgggcgaggggccggtgaaccgagcggcggacgcggagatggaccacgcggcggaggcgcagcggacggacctgatgacgatggcgcgcggctggctcaacgagcacagccgccacccggagtcgggcggcgacttctgcattctcctctcctacatcgtcctcggctgcaagttcgtctccgccgcgctcaacaaggccgggctcgccaagctcatcggcctcgccggagagacgaacgtccagggcgaggagcnaaagaagctggatgtcctgtccaacgaggtcttcgtgaaggcgctcgtcagcagcggccgcacctgtgtcatcgtgtctgaagataacgaggagcgcatcttcgtcgacacggacctccgcgagaagtactgcgtctgcttcgacgcgctggatggctcctccacatcgactgtggtgtctcaatcggaacgatctttgtgatttacttggtcacaganaagacaacgtgaccttggaggatgtgctgcagcctgcaccaaacatgcttgctgcatgctactgcatgtagagtagttcatgcacacttgtgctgagcactgcggaacgtatcaatggcttcactgtcgatgcttaccctggagagttgttttgacac

SEQ ID NO: 70598 - DNA, 762 bp, Zea mays
  misc_feature: Ceres CLONE 1550514
  misc_feature: Encodes the peptide sequence at SEQ ID NO. 70599
  misc_feature (1)..(1): n is a, c, t, g, unknown, or other
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (48)..(48): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (84)..(84): n is a, c, t, g, unknown, or other
  misc_feature (98)..(98): n is a, c, t, g, unknown, or other
  misc_feature (142)..(142): n is a, c, t, g, unknown, or other
  misc_feature (144)..(144): n is a, c, t, g, unknown, or other
  misc_feature (151)..(151): n is a, c, t, g, unknown, or other
  misc_feature (155)..(155): n is a, c, t, g, unknown, or other
  misc_feature (166)..(166): n is a, c, t, g, unknown, or other
  misc_feature (169)..(169): n is a, c, t, g, unknown, or other
ncaaaagggggnngggggnnntnnnnnnnnttggggnnnnntgggggngnnnccaaagctggactccccgtggaggcggcttcncggtgctagaggancccccgggctgcaagagtttgcatcacccggagaaaaaacccancncacggcnagcnagcacaagcanagngttttggcttgccacctaagtaaggcccgcctgagagccatggcatccaaggccgtcctcttcttggctctcaacctcctgttcttcacggtggccaacgcctgcggcaactgcccgaccccaacgcccccggtcgagccaccgccgccgcctcctgctgctaccccacccccttcgtccagcggcaagtgcccgctgaacgcgctcaagttcggcgtgtgcgccgatgtgctcggcctcgtcaaaggcgaggctggcaaggtgcgtgccgagccatgctgtaccctcatcaaaggccttgcggacttcgaggccgccggctgcctctgcacgggcatcaaaggcaacgtggtcggcgtcggcagtcgatgtcccaataaagctcagcggccctcgtgaaacaccggggggaaggagccggcccaaaggggttacttggggcgcggaaaacgagcttttcggggggggtgacacgcgcccggaaggtgggttcaccggtgcccaagaataaccaataagtgcagcgccaaccccccggcaaggggcgagagaaaaggcgagtggccatttgggggagcccggcccagaaacaa

SEQ ID NO: 70599 - protein, 119 aa, Zea mays
  misc_feature: Ceres CLONE 1550514
MASKAVLFLALNLLFFTVANACGNCPTPTPPVEPPPPPPAATPPPSSSGKCPLNALKFGVCADVLGLVKGEAGKVRAEPCCTLIKGLADFEAAGCLCTGIKGNVVGVGSRCPNKAQRPS

SEQ ID NO: 70600 - DNA, 847 bp, Zea mays
  misc_feature: Ceres CLONE 1550516-R
aattgggtacctcgagcgtctcgtttttttttttttttttcgatggcaatgctgcaaaccttttataaagaaaaactaatgctgatgcaaacaccgacaggaattacacggctataacaattgtacaatcttacaacagggcgaggcctccaggttcctggtcttcacctcaccgcatgttccactacctgccccagttttcaggtttcctcctatccaattccaatatgttgaggtaacttccagctcggcgactaggtaaatacggcacactctacagtaagtacacaactgctgacagttgtacaggtgaatccgtgcatgtgctatcctggggatccacttcgtcaacaaaacgacaaacagcatggcactggttagagttcctacatggccaaaatttacagcaatctcaccccataaattcatgctagaatcctttcttgaactaaggtgttatggtttccagtgcccccatcaacatctggcttatagatgctacgttctgggtgattgcccagcatcaaaaccatctgctgatgaactatctgtgtccgtatcactagaggatgaacccgagtcactgctagagcttccagaaacacttgatctaccagcattctctccccttctgatcttccaaatgaaccaggtgaatgattccacccacacatctcctcattaatatttctggctgcaacttttcccttagggggggatcaaacatcaaaccggttttccgggttttctgggaaaacggggttctttggttactggccaaggaaaatttgtgaatccctggaaaaccccgccttttggcccctggtcccttcacaaaatgttttta

SEQ ID NO: 70601 - DNA, 656 bp, Zea mays
  misc_feature: Ceres CLONE 1550520
  misc_feature: Encodes the peptide sequence at SEQ ID NO. 70602
  misc_feature (490)..(490): n is a, c, t, g, unknown, or other
  misc_feature (656)..(656): n is a, c, t, g, unknown, or other
ctccccgcggtggcggccgctctagaactagtggatcccccgggctgcaggaattcgtctcacccctagaaaaagtctcgacctgaccaatcctaccgccagcctctgcccttgtgctccagtctcctcccgcgaccgttccaaattcctgcctcgcgttcgtattccacgcggcgacgtcgccgtcgcggccgccgctccgctcccccttccttcgcctatacgtaggtagccgctgcggccgcctccccaaaccctaagcctttccctcccacacgcgcttcaccccgcacatcgccggcgatgggatccaaggaccagggcggaggggccgcctcctcgggcggcggcttcttctcgtcgttcgccgccggcatgcgcagctggggcaccgccgtgcacaaatccgtcaacgggctgcttggttatgaaggccttgaagtttttaaccccgatggaggcacagatgatgctgaagaagaagctttanggggccgatggaagcaagaggatcgtgatagctattggaagatgatgcacaagtacataggatcagatgttacatcacttgtgacacttccagtcatattttttgagccaatgacaatgcttcagaaaatggctgagttgatggaatacctgtgagttgttagacn

SEQ ID NO: 70602 - protein, 113 aa, Zea mays
  misc_feature: Ceres CLONE 1550520
  misc_feature (63)..(63): Xaa is any aa, unknown, or other
MGSKDQGGGAASSGGGFFSSFAAGMRSWGTAVHKSVNGLLGYEGLEVFNPDGGTDDAEEEALXGRWKQEDRDSYWKMMHKYIGSDVTSLVTLPVIFFEPMTMLQKMAELMEYL

SEQ ID NO: 70603 - DNA, 654 bp, Zea mays
  misc_feature: Ceres CLONE 1550521
  misc_feature: Encodes the peptide sequence at SEQ ID NO. 70604
  misc_feature (312)..(312): n is a, c, t, g, unknown, or other
ggagctcaccgcggtggcggccgctctagaactagtggatcccccgggctgcaggaattcgtctcacccctagaaaaaccgggcacacaccatcacagtacacacacacacacgcacacgctcatcaagcttctctctcgcctactcggctgcaatggcgcgcttccagctcgcggccctggccatggcaatgctcttcgccgccgcggcggcgcaggcccgggccgcaccccgacgccggctcccaaggcgtctcctcccccgccggcgacgccctcctcgacgcccgcggacccgccgcccggcccgggngccggtgtcgcctccccccccaagcctccggccaagcctcccccgggccccggcacccgattccaaaggccccccggcccccgggcccaaaagacttttccccccgccgccaaagggctaaggcccccaaccccccaaaagaatctcccccccagaatcccaaaggaaggggcccctcccccaaaaaccccccaaccgaaggtggcccccttgcccgaagggggggggataccccctttttccggcaaacgccaaaaaaaaaagggtttattcgcccaatttccaaatccaaaaaaagccccgcgggttcggggcgattaaaaatgtcgaaaaagagggcac

SEQ ID NO: 70604 - protein, 92 aa, Zea mays
  misc_feature: Ceres CLONE 1550521
  misc_feature (53)..(53): Xaa is any aa, unknown, or other
MARFQLAALAMAMLFAAAAAQARAAPRRRLPRRLLPRRRRPPRRPRTRRPARXPVSPPPPSLRPSLPRAPAPDSKGPPAPGPKRLFPPPPKG

SEQ ID NO: 70605 - DNA, 578 bp, Zea mays
  misc_feature: Ceres CLONE 1550524
  misc_feature (229)..(229): n is a, c, t, g, unknown, or other
ctccaccggcggtggcggccgctctagaactagtggatcccccgggctgcaggaattcgtctcacccctagaaaaaaaacatcgtctcgcgccggccccccgtggggaactagaactgactccctcgatcccagcggcagcggcggaagcgaacggtgaccgcgacctcccctgaccctgaggctgcatatactcggatcgggtttcacatctccggttttggattggnttggttgcccgcggcgatggggaggagagcttgtggtggtatccataggggatcctccggttgcgtcccttggtgcgatgggcttccaacctccgtttcctgaattaacccgcgggaaaaaaaaatggccacaaaagccttccggggaatcgggggggcccccttttacttttttgggggaaccttcccaaaaaaacccacccggggaaaaatccccccccccctttttggccccctccttttccccggtttttaattttccaccgggggaagggggggtctcctctcccgggggggggtaaaaaaaaaacaaaaaatgggggggggaaaaatttttgtttgtttgttt

SEQ ID NO: 70606 - DNA, 673 bp, Zea mays
  misc_feature: Ceres CLONE 1550527
  misc_feature: Encodes the peptide sequence at SEQ ID NO. 70607
tggagctccccgcggtggcggccgctctagaactagtggatcccccgggctgcaggaattcgtctcacccctagaaaaaatggcgagctcctcctcctccgagcaccgagctcaaacacacatcaagaaagcaagaaagaaaagactgtagctagctagccaccgcgcgcgcgcacgagtagtctagctagaatacactcgcgttcaaaaaaacacacagcgtcgtgctgcgtgatctctgaccgcgtcgacaactaccgcagcaccaagcagctgatggcggccaccgtatcttcctgcctgagcctcgtccccaccgtgcaccacggggccgggcgggttccccagcagtgtggcactgacgaacacgcttcagcgccgtcgtcgttctcgccgctatcttgtcgtccgctcggcgacgaagagccgaacaggagccgcccctgtgagatccaagacgtgggacctcagctctcatcaggccccggccgaaaaacgggaactccccgcccggggggcgggaggtccacggggcacaaaaactggggaggggttggtggaccccatgaggggggggggtcctccagagaaccatccccctagggggagtttcccccgggccccctaaaaaggttttaaaaaaaaaacccttttccccccaaggggggggagt

SEQ ID NO: 70607 - protein, 108 aa, Zea mays
  misc_feature: Ceres CLONE 1550527
MAATVSSCLSLVPTVHHGAGRVPQQCGTDEHASAPSSFSPLSCRPLGDEEPNRSRPCEIQDVGPQLSSGPGRKTGTPRPGGGRSTGHKNWGGVGGPHEGGGSSREPSP

SEQ ID NO: 70608 - DNA, 676 bp, Zea mays
  misc_feature: Ceres CLONE 1550534
  misc_feature: Encodes the peptide sequence at SEQ ID NO. 70609
acccgcggtggcggccgctctagaactagtggatcccccgggctgcaggaattcgtctcacccctagaaaaacaatttatattgagggcattcggcatcctcttctacttgaacagtctcttatggcagaagaatcaactacagaagcatctgaaatgcctgttccattggacatgtgggtcaaaaagaatgcaaggatagttgtgatctctggacctaacactggaggcaaaactgccactatgaagaccttggggctgtcctcgcttatgtcaaaagctggtatattcttcccagccaaaggaaggcctaggattccatggttcgatcaggttcttgcagatattggtgatcaccagtcgctggagcacagcctctctacattcagtgggcacatatcacgtctgcgcaagattgtagaaatggtatcaaaagattctctagttctaattgatgagattggcagcggcactgatccagctgagggtgtagctctttcaccagcatttttgaagtatcttggcagtagagtgaatttagccattggtgacaactcataatgctgatctaagtcggcctccagtccagttgacaacggattccaaaaatggctgcatgggaattttttgtgtagaaactcctacaaccaacttacccaaatcttttgggggcagta

SEQ ID NO: 70609 - protein, 145 aa, Zea mays
  misc_feature: Ceres CLONE 1550534
  misc_feature (1)..(145): Pfam Name: MutS_V Pfam Description: MutS domain V
MAEESTTEASEMPVPLDMWVKKNARIVVISGPNTGGKTATMKTLGLSSLMSKAGIFFPAKGRPRIPWFDQVLADIGDHQSLEHSLSTFSGHISRLRKIVEMVSKDSLVLIDEIGSGTDPAEGVALSPAFLKYLGSRVNLAIGDNS

SEQ ID NO: 70610 - DNA, 662 bp, Zea mays
  misc_feature: Ceres CLONE 1550535
  misc_feature: Translation starting site: 176
tggcggccgctctagaactagtggatcccccgggctgcaggaattcgtctcacccctagaaaaactcgaaaccctagtcctctgttacttctcccgccgccgccaatcccctcccgttctccgccaccgccaatcccctcccgtcctccgccacctctgctgagagcgagaagagatggccggcaagggtgatgggccggcaatcggcatcgatctcggcacgacctactcttgcgtcggtgtgtggcagcacgaccgtgtcgagatcatcgccaacgaccagggtaaccgcaccacaccctcgtacgtcgccttcaccgactccgagcgcctcatcggagatgcggccaagaaccaggtcgccatgaaccccatcaacaccgtctttgatgccaagcgtctcattggcaggaggtttagtgatgcctctgtccagagtgatattaagctgtggcccttcaaggtcattcttgggcccggtgagagccaatgatagtttgtcagcacaggggggaaggagaacagtttgcagccgaagagatctccttcatgttcctcatcaggatgcgggagatcgctgaggcttaccttggcagcacgatcaagaatgctggtgtcacggtccctggctacttcaacgactcaaagaggcaggccacgag

SEQ ID NO: 70611 - DNA, 688 bp, Zea mays
  misc_feature: Ceres CLONE 1550536
  misc_feature (688)..(688): n is a, c, t, g, unknown, or other
ctggagctccccgcggtggcggccgctctagaactagtggatcccccgggctgcaggaattcgtctcacccctagaaaaagccgcggactggacagcccaccacactcttccactcccctcccccgccccgccaccgatccccaccgccgaacaaccgacgggtgctgctgctcctgctcctgccgccacctgctacgtagcatacgcggacggacgtaccaccaaacccccaccgaactagctgccggtccatcgcgctacgccgctacctacgacgatcgggcaagcgaagcgcgcgagttcgacgtcgtcgtcctctggcatcatctctatccgccgtcctgtggtatcgtcagcagcaccggcgtcctcgtcgtcgatcgtttccggttgtgaggagaggccgccatgaataggaccacgagcaggagcggcgcgtcgcccgccgccggcctgtggctccggccgggccggctcggtgaggttctcgccgtcgcgactctgctggcctcggcgttgctgccgtcggcggcggctgctaccgacgcgcccgccgccggcttcttcgcccgcggaacaactacaaggacgcgcctgcgcaagaagcctggttctcctccaaggcggcagccggtcggggcggcctgccgcaccggctaggcgctgtaccttgggggggaccccctn

SEQ ID NO: 70612 - DNA, 647 bp, Zea mays
  misc_feature: Ceres CLONE 1550538
  misc_feature: Encodes the peptide sequence at SEQ ID NO. 70613
ctggagctccccgcggtggcggccgctctagaactagtggatcccccgggctgcaggaattcgtctcacccctagaaaaagaggagctctatagagcccatcctctgcttcgcataacctagcggcaccagcagctaaccgtccagagaacagaacagagatgaccaccagcgtccccgtccctctggcctcacagtcgcaggcgccgcagcgcaagccacggacctacaccccgagcccatggggtgacttcttcctccaccacaccccatgcactccgtcacagctcttgttgatgaaggagagggcaaaggtcaaggagcaacaggtgaggcagatcatacaggaaacgatggcctcctccaacctgcttcgcaagttggagcttgtggacacgctgcagcgtctcggggtggactaccgctacaacgaggagatcgaccagttgcttcgctctgtatacgacgacgacgacgggaacggaggcgggctccacaatctctacctcacctcgctgggggtgtacttgctcaggaaacatgggtatacaaccccttcgatgggtccaaaaaattaggaccagcccgggaacgtctcgagcgaaaatgccggcttcttgcctctggttaatgaccctgtcaataaag

SEQ ID NO: 70613 - protein, 138 aa, Zea mays
  misc_feature: Ceres CLONE 1550538
  misc_feature: SWISSPROT Homolog: EC 4.2.3.13 (+)-delta-cadinene synthase
MTTSVPVPLASQSQAPQRKPRTYTPSPWGDFFLHHTPCTPSQLLLMKERAKVKEQQVRQIIQETMASSNLLRKLELVDTLQRLGVDYRYNEEIDQLLRSVYDDDDGNGGGLHNLYLTSLGVYLLRKHGYTTPSMGPKN

SEQ ID NO: 70614 - DNA, 666 bp, Zea mays
  misc_feature: Ceres CLONE 1550539
  misc_feature: Encodes the peptide sequence at SEQ ID NO. 70615
  misc_feature (344)..(344): n is a, c, t, g, unknown, or other
ctccccgcggtggcggccgctctagaactagtggatcccccgggctgcaggaattcgtctcacccctagaaaaactctttcccaccgccttcttccactactcttcaccctcccctcctccccatcgcgaactcacaagagaaccaagtagacgagggagaaggagatggcgaagaagaaggagaaggcggtgaacgtgtcgggcaagccgcggcactcgaacgacgtcaaccgccccaatgacaagaagggcgcgggcggcggcgccggtggcgggagccggtccgcggctaccgtgcggcggctcaagatgtacaagacgcggcccaagagggaccgcgccngggaggtgctcaggaacgattttcagtctaaagagctcccccaacacccgcatcgagcccgaccgccgggtggtcgggcatactcccggttgtggggcccccacagctggaaatgtcccgggaggaactccgaggcggctttccgacaacttcggtgtcatctggaaagaacggaacctgccccttatcgctcctgccagatcttccaaagcgagccaagggcccttcggccttgaagttaaccttttgtgactgccttttgggccaaagggggaaggggaaacccccaaaacaaacgggccttggaaacaaaaattttggg

SEQ ID NO: 70615 - protein, 137 aa, Zea mays
  misc_feature: Ceres CLONE 1550539
  misc_feature (60)..(60): Xaa is any aa, unknown, or other
MAKKKEKAVNVSGKPRHSNDVNRPNDKKGAGGGAGGGSRSAATVRRLKMYKTRPKRDRAXEVLRNDFQSKELPQHPHRARPPGGRAYSRLWGPHSWKCPGRNSEAAFRQLRCHLERTEPAPYRSCQIFQSEPRALRP

SEQ ID NO: 70616 - DNA, 628 bp, Zea mays
  misc_feature: Ceres CLONE 1550540
agctccccgcggtggcggccgctctagaactagtggatcccccgggctgcaggaattcgtctcacccctagaaaagtcagtttgctggccagcaagcgggcttgggattggattggagctctcgtcagctcctatcttatcaccagagccagacagacagtcgtcatcgtctccgatccatctccgtcttcgtcctcctcgctcgacaacccaccaaggagcaagagaagaagatcgacgacgacgacgacggctgccctctgcgttcctcaagaataatactccgttgcgtcccgtcccttccgtgctccaagaaagatccggctgcgggccacacgatgagcaatcttaagcttggcgtcgaggttaccagcgctcacgatctcctcccgaaagagcagggcacggcgaacccctttcgtggaggtcgagttcgacgggcagaagtcccgcacggccttcagggacagggaccctcacccctgtctggaacgagcagctctccttcaacgtgtctgacccgtcccgccttccggagctgccactcgaggccctcgtggtacacgcgaaaccgggcgaacacctccagtcctggctggggcagggttccatttcggggaccctcctt

SEQ ID NO: 70617 - DNA, 676 bp, Zea mays
  misc_feature: Ceres CLONE 1550541
  misc_feature: Encodes the peptide sequence at SEQ ID NO. 70618
  misc_feature (286)..(286): n is a, c, t, g, unknown, or other
  misc_feature (398)..(398): n is a, c, t, g, unknown, or other
  misc_feature (454)..(454): n is a, c, t, g, unknown, or other
  misc_feature (457)..(457): n is a, c, t, g, unknown, or other
  misc_feature (507)..(507): n is a, c, t, g, unknown, or other
  misc_feature (552)..(552): n is a, c, t, g, unknown, or other
  misc_feature (573)..(573): n is a, c, t, g, unknown, or other
  misc_feature (676)..(676): n is a, c, t, g, unknown, or other
ctccccgcggtggcggccgctctagaactagtggatcccccgggctgcaggaattcgtctcacccctagaaaaagctccaacgttcacctctctctctctcgttcatccttggcgcatgcctcccgtatgaacacgcccatgccagccacagcataaggcggctgctgtgccaccgatcgtgcatgcctcgatctcgtctaccattactcgaaccctagatagcgagaaagcctggtgtttctggaggaagcagccatgatccctgccgttgctgatccgacgacnctggacggcgggggcgcgcgcaggccgttgctcccggagacggaccctcgggggcgggctgccgccggcgccgggcagaagcgggccgcggcgacgccgaccgttctccccngcgtcgtctccgccgtgctcctgctcgtcgtcgtggcggtcacagtcctcgcgtcncancacgtcgacgggcagggtggggggcgttcccgccggcgaagatgccctcngtcgtcgaggtggccgcttcccgtggcgtggctgagggcctgtcnaaaaaatcaacgcccagctcntcgggggccggcgcgctccaggacttctcctggaccaacgcgatgctgggcgtggcaacccacggggtttccacttccagccccccaagaaatggaatgaacn

SEQ ID NO: 70618 - protein, 59 aa, Zea mays
  misc_feature: Ceres CLONE 1550541
  misc_feature: SWISSPROT Homolog: EC 3.2.1.26 Beta-fructofuranosidase
MPSVVEVAASRGVAEGLSKKSTPSSSGAGALQDFSWTNAMLGVATHGVSTSSPPRNGMN

SEQ ID NO: 70619 - DNA, 682 bp, Zea mays
  misc_feature: Ceres CLONE 1550545
  misc_feature: Encodes the peptide sequence at SEQ ID NO. 70620
  misc_feature (313)..(313): n is a, c, t, g, unknown, or other
  misc_feature (396)..(396): n is a, c, t, g, unknown, or other
  misc_feature (398)..(398): n is a, c, t, g, unknown, or other
  misc_feature (406)..(406): n is a, c, t, g, unknown, or other
  misc_feature (411)..(411): n is a, c, t, g, unknown, or other
  misc_feature (413)..(413): n is a, c, t, g, unknown, or other
  misc_feature (498)..(498): n is a, c, t, g, unknown, or other
  misc_feature (594)..(594): n is a, c, t, g, unknown, or other
agtgctggagctccccgcggtggcggccgctctagaactagtggatcccccgggctgcaggaattcgtctcacccctagaaaaagatctccaccacggctccacgagcccaaccggctagcttcttcttcgtccgctgttacccacaccgcgggaagcctccatgcgatcccctgggcggcgcctacggctaccagcgccgtcgcggctcgtcgcggctgccctcctcctcgcagctctcaccgggggagccgtcggcgccgatgggtacgggcgggcgaagagggtgtacatgaaagaacaaagtcctgganatgttttaccatgccttttgacaactacatgacttatgcattccctctttattcccccccccccctgggggggggggggggcncnggaactcncttantnaactttcccaatttaaattcttgaaacacttggcccccggattttgggggggtccccctttaaaccctggtttgaatccattatncaaggccttggttggcccctaaggtaaccccccccaaggttggagaaaaggaagtctcctggggctttcaaaaaaatctaaaattttggagtgttnaagccccccaataaaattctttttagaagggaaacaaaaaaactcccagagggggcgtcttcttttccgcgccaaatatttttggaag

SEQ ID NO: 70620 - protein, 60 aa, Zea mays
  misc_feature: Ceres CLONE 1550545
  misc_feature (51)..(51): Xaa is any aa, unknown, or other
MRSPGRRLRLPAPSRLVAAALLLAALTGGAVGADGYGRAKRVYMKEQSPGXVLPCLLTTT

SEQ ID NO: 70621 - DNA, 864 bp, Zea mays
  misc_feature: Ceres CLONE 1550546-R
  misc_feature: SWISSPROT Homolog: EC 2.7.11.1 Non-specific serine/threonine protein kinase
  misc_feature (1)..(1): n is a, c, t, g, unknown, or other
  misc_feature (2)..(2): n is a, c, t, g, unknown, or other
nnggggacagaatccgagccagcagccaacgtgaacaatgtacacacacgcacacgccgatcaccagatccaacggccctcgctaatccagcccaccccaatcgcacccaaaaaaaatacaagagcagattaaaccaaacaaagaggcacgcatcacaaggcaattccgaaggagtgaaggaccaccagcgccgggccctcactggctgagcgcgccgccctccgacacggcgggcgagtccgagacgccggaggactcgtccatggactcgtgcgacggcgaagccgtctccccgcacgcgcggacctcgtcgaccatcttcaccacgtacccgaccttgggccgctgctcgggcgccgcggccgtgcagctcagcgccagctgaagcatcgccaccatctcctcctcgatgcccttgtccttcatcagctccaggtcgaacacctccgacgtccactcctcccgcaccacggactgcacccaccggggcagctccaccacgacgccgccgttcgggagctcgctgcccgggaaccgccccgtcaggagctccagcagcaccacgccgaaacgcgtacacgtctccccctgtgcgacgcccaggcctgggggcgggcgggggggcacctcagtgtcccggaaaccccgccgaaccgaagcctctccccctcggccgggggaaaaacccccagtttgccccaaccccacagttctaataaaaaacccgtccacgctccaaatcctttttccaataaagatatgtttggggtccatctttaaagtgtttcccgtggggacctacagtttatcttgtgagagatctcgaattgttcacctaatcgtgtgacacaagaagatgatgg

SEQ ID NO: 70622 - DNA, 680 bp, Zea mays
  misc_feature: Ceres CLONE 1550548
  misc_feature: Encodes the peptide sequence at SEQ ID NO. 70623
ctccccgcggtggcggccgctctagaactagtggatcccccgggctgcaggaattcgtctcacccctagaaaaaacccagccgcccattgccggcattgctcgcagcgctagcttcttgcgctcatcactcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcggcggcgaagagctcgtccgcgacgtcccccaatggaagcagcacaggctgccgccgacgcctccggggaagctccccatcatcgggcacctccacctcatcggctccccaccgcacgtctccttccgcgacctcccacgcaagtacggccacaacgggctgatgctggtgcaggtcggccccttgcccaccatcgtggtgtcccaccccgcaagccgccaaggccgttgctcgaaaaaatgacacggtggtggcgtcccgcccggggaacccctgtcccaaatttatcggttaaaactccggggaaggggccttcccgccctacaggaaaatctgggcccccggcccctaaaggggggccacaccccccctggccaagccccaaaatgggtttctcccagagggggg

SEQ ID NO: 70623 - protein, 170 aa, Zea mays
  misc_feature: Ceres CLONE 1550548
  misc_feature: SWISSPROT Homolog: EC 1.14.13.68 4-hydroxyphenylacetaldehyde oxime monooxygenase
PRGGGRSRTSGSPGLQEFVSPLEKTQPPIAGIARSASFLRSSLVSDQDQQGRHGSRSSVRLPARRRRPVHAHTSSSSPRRPPPPRHPASRGGEELVRDVPQWKQHRLPPTPPGKLPIIGHLHLIGSPPHVSFRDLPRKYGHNGLMLVQVGPLPTIVVSHPASRQGRCSKK

SEQ ID NO: 70624 - DNA, 733 bp, Zea mays
  misc_feature: Ceres CLONE 1550553
  misc_feature: Encodes the peptide sequence at SEQ ID NO. 70625
ggagctccccgcggtggcggccgctctagaactagtggatcccccgggctgcaggaattcgtctcacccctagaaaaagcaaaaatcacagcggcaggggtcagcaaaaatctccatgcccacgctcggcctagatctcccgcgaaccggccccgcgcggtagccgattcactctccgaccccgacccgatgggcggcgaggtgccggagccgcgccggctgagccgctcgctcagcttcggctgcggcggcgtccccgaggaggcgctgcacctcgtgctcggctacgtggacaacccccgcaaccgggaggcgggctcgcttctggtgccgccccttggcacccgcatttgacgcgcttttcgcccaaacacgttcaccgttcggtttctggttcccccgtggaagccccccccgccttggttccccagggttccggggggcctcaaggtcccttccgcgctcacagggggaaggcccccgcccccccccttggttacggggcttcttccccccgaaagaattttggggccccttacgcggcccccccttggggtcccccaaagtttccccgggcccgtttcggaaggggttcaagggggctccccccctgcggccggcttgacccctctccccaagaaagggaaattcgcgggtggttcgtccgcgggcgccggggggcccaaattgttgaaggggggctaaaggtctcacaaaagggggtcccggggtt

SEQ ID NO: 70625 - protein, 54 aa, Zea mays
  misc_feature: Ceres CLONE 1550553
MGGEVPEPRRLSRSLSFGCGGVPEEALHLVLGYVDNPRNREAGSLLVPPLGTRI

SEQ ID NO: 70626 - DNA, 655 bp, Zea mays
  misc_feature: Ceres CLONE 1550632
  misc_feature: Encodes the peptide sequence at SEQ ID NO. 70627
cgattgggtaccgggccccccctcgagccctgcagtggtaaaggtcgccctcgtaatcaatctccgcctccctgcctgcttaccccgaccccgtcggcatctcggagaatcgcggcggtcaaagcccagcctaccccacctcgcgccgcgtcgccgcggtttccgcgggccagtgctctcgggagtcgggagctcagatcaggagggacgggctaggtagggttcgcgagcgagcgagggtgctgccgtccggcgccggtgtccgagtagcaagaggagagatggacgcgttcctgcagaggctcaagcggttggacgcgtaccccaaggtgaacgaggacttctacaagcggacgctctccggcggcatcgtcacgctcgtcgccgccgtcgtcatgctgcttctcttcatctccgagaccaggtcatatttttattcagcaacagagactaagttagttgtggacacatcaagaggagaaaggctacgagtaaattttgatattacttttctgagcattccttgcaccctcctcagcgttgatacaatggatattagtggagaacagcaccaggacattaggcatgacatcgaaaagatacgattagatgcacatggtaatgttattgaagcaagaaaagttagcattggtgg

SEQ ID NO: 70627 - protein, 124 aa, Zea mays
  misc_feature: Ceres CLONE 1550632
MDAFLQRLKRLDAYPKVNEDFYKRTLSGGIVTLVAAVVMLLLFISETRSYFYSATETKLVVDTSRGERLRVNFDITFLSIPCTLLSVDTMDISGEQHQDIRHDIEKIRLDAHGNVIEARKVSIG

SEQ ID NO: 70628 - DNA, 627 bp, Zea mays
  misc_feature: Ceres CLONE 1550636
  misc_feature: Translation starting site: 118
ctattgggtaccgggccccccctcgagccactgcagtggtaaaggtagcgcaccaatcccatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccatatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagagagcagtgggatcagttcgttgtgatgttccaccgctacaaggagaagacagagaaggaactccaagcagcggtgcggcttcagacggcagcacgagggttcctggcacgccgccaggtacagtcccttcgtggggagaaacaccttgc

SEQ ID NO: 70629 - DNA, 641 bp, Zea mays
  misc_feature: Ceres CLONE 1550653
  misc_feature: Encodes the peptide sequence at SEQ ID NO. 70630
  misc_feature (600)..(600): n is a, c, t, g, unknown, or other
  misc_feature (607)..(607): n is a, c, t, g, unknown, or other
cgattgggtaccgggccccccctcgagccactgcagtggtaaagggtgaaccctgctccaccgttccggtcctcccgaaagctaagggagacgagcagcctaaaaaccctagcccccgaatcagatccgaccgcccgccggagcgcggaaccctgccctcggccgccatggagatgagcgatgcggagcggctgttcttcttcgagatggcctgcaacaactccgaggtcgcgtacgagcagaaccccaacgacgccgacaacttgacgcgatggggcggagcgctgctggagctatcgcaactgcgtaacggccccgacagcctcaagctcctccaagatgcggaagccaagctggaggaggcactgcaaattgatcccaacaagtctgatgcgctctggtgcttgggaaatgctcagacttctcatggattcttcactccagacactgcaatagcaaatgagttttttgcgaaggcaactgaatgtttccagaaagctgctgatgtggaacctgcaaatgagctgtacaggaagtcattagacttgtcagcgaaggcacctgaactgcactcggagatccacaggcaaatggcttctncagcggncacacaagcatcctcagcctcaaatccaacgcaa

SEQ ID NO: 70630 - protein, 158 aa, Zea mays
  misc_feature: Ceres CLONE 1550653
  misc_feature (6)..(158): Pfam Name: TOM20_plant Pfam Description: Plant specific mitochondrial import receptor subunit TOM20
  misc_feature (145)..(145): Xaa is any aa, unknown, or other
  misc_feature (147)..(147): Xaa is any aa, unknown, or other
MEMSDAERLFFFEMACNNSEVAYEQNPNDADNLTRWGGALLELSQLRNGPDSLKLLQDAEAKLEEALQIDPNKSDALWCLGNAQTSHGFFTPDTAIANEFFAKATECFQKAADVEPANELYRKSLDLSAKAPELHSEIHRQMASXAXTQASSASNPTQ

SEQ ID NO: 70631 - DNA, 728 bp, Zea mays
  misc_feature: Ceres CLONE 1550664
  misc_feature: Encodes the peptide sequence at SEQ ID NO. 70632
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (284)..(284): n is a, c, t, g, unknown, or other
  misc_feature (399)..(399): n is a, c, t, g, unknown, or other
  misc_feature (400)..(400): n is a, c, t, g, unknown, or other
  misc_feature (421)..(421): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaattggggtaccgggccccccctcgnaccactgcagtggtaaagggcgtaaacatcgaatcgtctcactcgtgtctgccctgctcatactgcttgccctcgccgtatcgtcacccgcaacgcacaggaagattcatggcannacacacgggacgttggtgggncgcatcagacgtgccgggaagcgagaacgactttcacctcagaagctcgcccgcttcgccgtcgatgaccccaacaagaggccaatgctccttttggggttccagaaactggtgaaaggccaaaaaccaattggttgcctggcccaaagtatcttttctcccctttttaaatggaagggagggcgaaaattcaaaaaaccttttcaaaaaaaataagggtttggggaaaaaaccttgggaaaaaaccctagggggggtcccgaaaaaatttaaaaccttttttaaaaaaggggtgtcccccccccaa

SEQ ID NO: 70632 - protein, 126 aa, Zea mays
  misc_feature: Ceres CLONE 1550664
  misc_feature (10)..(10): Xaa is any aa, unknown, or other
  misc_feature (48)..(48): Xaa is any aa, unknown, or other
RIGVPGPPSXHCSGKGRKHRIVSLVSALLILLALAVSSPATHRKIHGXTHGTLVGRIRRAGKRERLSPQKLARFAVDDPNKRPMLLLGFQKLVKGQKPIGCLAQSIFSPLFKWKGGRKFKKPFQKK

SEQ ID NO: 70633 - DNA, 687 bp, Zea mays
  misc_feature: Ceres CLONE 1550676
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (353)..(353): n is a, c, t, g, unknown, or other
  misc_feature (360)..(360): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttttgttttttttttctattgggtacgggccccccctcgagccactgcagtggtaaaggagccggtccaagaacagggcacggcaccagacgcgtccatggaccccaccggcgtcgacggcgattccgcggcggcgagggggagcggaggcggaggcggagggggcacagggccggccggtgggcggttggcncgtgtgncggggcttgtctactacactgcgcggtacgcgagccagcgcggtgtcccttgcagcagacgtgctcctcgtccctctctggtcgctctccatccttcggcctcctcttccgcaaactccacatttcggtgcccgtgggatcccctgagaatgccaaattctccggggaaatggcaaaaaacctaagtttgctttccttttcccatataaggaagaagcctcgccaagacttaattttaaggggggggtcgcaaaacggaaaatataaaaaaaaactgttttttttaaaggggggtttcctcaaattggtttttttctccaacccttt

SEQ ID NO: 70634 - DNA, 632 bp, Zea mays
  misc_feature: Ceres CLONE 1550680
cgattgggtaccgggccccccctcgagccctgcagtggtaaagggtgatgacaagaaggggagaagaaaggagaagaagaagtactacaagaagaagggcggcggtgcccatgtttgccgggaatgggactccgacgagagctccaccgactcctcctccgacgaggacgccgcaaacatcgccgtcaccaaaggtcttctcttccccaacgtcggccacaagtgcctcatggcaaaggacgacaaaaggaagaaggtaaaatcaagatcctccaccaaatatgaaacctctagctatgaggataatgctagtaatgaggaggataacttgcgcattctttttgccaacctaaacatgcaacaaaaagaaaagttaaatgaattaattagtgccatcatgagaaggatgatctcttggacaccctagaggacttcctaatcaaggaaaacaaaaagcatgttaagtttaaaaatgcttacgctctagaagtagagaaatgtgaaaaacattctagtgagctaagcacttgccatgaaaccattgacaaccttagaaatgaaaatgctagtttaagtgctaaggttgattcaaatgtttgtgatgtttcaattcccaatcttagaaatgataa

SEQ ID NO: 70635 - DNA, 634 bp, Zea mays
  misc_feature: Ceres CLONE 1550725
  misc_feature: SWISSPROT Homolog: EC 3.1.1.31 6-phosphogluconolactonase
  misc_feature (1)..(1): n is a, c, t, g, unknown, or other
ncgattgggtacgggagcgtcctcgacctccacagggtgaaggcttttttgggatctttcggttgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgcctcggacgatggcgcactgacctttgccgcagagtctgcgctgccgggtagtccgactcatatttccaccgatcaccaggggcagtttgtctttgtaggttcttacaatgcgggtaacgtgagcgt

SEQ ID NO: 70636 - DNA, 649 bp, Zea mays
  misc_feature: Ceres CLONE 1550752
  misc_feature: Encodes the peptide sequence at SEQ ID NO. 70637
cgattgggtaccgggccccccctcgagccactgcgtggtaaaggttaggcccactggccggtgagaatggaggttgcgacaatggtgtggacggtgccggtggtccggactggactagtgtactggttcgtcatgggcgatgggcgcttcctaggtgtaactgcaatcggccgatggatctcatgatgggatccatcacgcgcgacaaggtgcaggacaactacactcagtactgatccttcttccgtcaccccagcgagacggccacaacggctgtgtctgcaggagaacgtgccggccttcgactacaccttctactacctcgtgacgaagatctactagtgggggtggggccagtccttctacttcgtcccgtgcctcaccggccgctcccaccgcgacgccacgcgcgtccacgaggagcgcgtcacctacctcctcggcgccaggtcgggcctccgcctcctgaacgtcggttggctggtctgcgtgcccatgttcgccatcgccaaccactcgggatccaacgtcgtcggaatcgccctcaacgagtgcgaggtgaaccttgctcttgggcacacttcagggtcggccttcacttcctgccctgcgaaggtcgttggggtgactttcttttccatgccgttcg

SEQ ID NO: 70637 - protein, 51 aa, Zea mays
  misc_feature: Ceres CLONE 1550752
  misc_feature: SWISSPROT Homolog: EC 2.1.1.143 24-methylenesterol C-methyltransferase
MFAIANHSGSNVVGIALNECEVNLALGHTSGSAFTSCPAKVVGVTFFSMPF

SEQ ID NO: 70638 - DNA, 546 bp, Zea mays
  misc_feature: Ceres CLONE 1550761
  misc_feature: Encodes the peptide sequence at SEQ ID NO. 70639
  misc_feature (230)..(230): n is a, c, t, g, unknown, or other
  misc_feature (274)..(274): n is a, c, t, g, unknown, or other
  misc_feature (299)..(299): n is a, c, t, g, unknown, or other
  misc_feature (305)..(305): n is a, c, t, g, unknown, or other
  misc_feature (323)..(323): n is a, c, t, g, unknown, or other
  misc_feature (324)..(324): n is a, c, t, g, unknown, or other
  misc_feature (340)..(340): n is a, c, t, g, unknown, or other
  misc_feature (343)..(343): n is a, c, t, g, unknown, or other
  misc_feature (354)..(354): n is a, c, t, g, unknown, or other
  misc_feature (361)..(361): n is a, c, t, g, unknown, or other
  misc_feature (365)..(365): n is a, c, t, g, unknown, or other
  misc_feature (384)..(384): n is a, c, t, g, unknown, or other
ccgattgggtaccgggccccccctcgagccactgcagtggtaaaggaatcctcctcctcctttcccctcgccgatcccaggtcccaatcttttccttctccgccctcgccgccggccaacatgatgcacatgaccttctactggggcaagtccgccacgatcctattcgacggctggcgcacctccacgtggctcggctaccttctctccctcgtggccctgctcctcgnccgccgccttttaccagtacctcgaggccttgcgggtccgcgtngaagctcatcgcggaaggatccgcnatgctnagctctcatccctcaccnngcagctcgacccgggnaancgcgctctcgngcccgcnttcngccgggcgctggcccgccngcgtggtggccgtggccgcaattgtcgggggtcaaactcccggccttcgggttaactcccttaaggcctctccaataaggggccggtcaaaaggggggggggtgtttttcttttgcccctttctcccgtggggcccccccgccccccggggggaaacccccc

SEQ ID NO: 70639 - protein, 113 aa, Zea mays
  misc_feature: Ceres CLONE 1550761
  misc_feature (37)..(37): Xaa is any aa, unknown, or other
  misc_feature (52)..(52): Xaa is any aa, unknown, or other
  misc_feature (60)..(60): Xaa is any aa, unknown, or other
  misc_feature (62)..(62): Xaa is any aa, unknown, or other
  misc_feature (68)..(68): Xaa is any aa, unknown, or other
  misc_feature (74)..(74): Xaa is any aa, unknown, or other
  misc_feature (75)..(75): Xaa is any aa, unknown, or other
  misc_feature (81)..(81): Xaa is any aa, unknown, or other
  misc_feature (82)..(82): Xaa is any aa, unknown, or other
MMHMTFYWGKSATILFDGWRTSTWLGYLLSLVALLLXRRLLPVPRGLAGPRXSSSRKDPXCXALIPHXAARPGXXRSRARXXPGAGPPAWWPWPQLSGVKLPAFGLTPLRPLQ

SEQ ID NO: 70640 - DNA, 647 bp, Zea mays
  misc_feature: Ceres CLONE 1550765
  misc_feature: Encodes the peptide sequence at SEQ ID NO. 70641
cgattgggtaccgggccccccctcgagccattgcactggtattcgggtttgtttggctctattcccaattatccacgcattccgatcctcctgccctccccacgtcttcctctctccgtgcaacatattgcggctgcggtggcggcgagcgccttcccttgtcatttccacacgtgttgctgacctcatcctctttgctgagggaggggagatggcttgcctgacctatatgccgatgaggccggtgcggccggttccgccgatgcaacaccggggccctccgccgatggcgcgcctccgccccatacctatctaccgctagaagacctgccctctgctgctcatggttttcacaagggttgctggtcactaccagaatgaacagttctctgtgagaggtgagaactatagatcaacttcagagttgcgcttggagggatgcccctctccgcgagcgtactgatatagtgtaacaggatgctcttccctcccggtcaatgtacgcgaaggcttccttttgcattcggatcccagactaaacggccccttttgttgttctcccgggaacgcttttagaatttgggcaggtttggaaccttcgctccataaaccccttgctttattgggccaaactagcctttgcatta

SEQ ID NO: 70641 - protein, 36 aa, Zea mays
  misc_feature: Ceres CLONE 1550765
MACLTYMPMRPVRPVPPMQHRGPPPMARLRPIPIYR

SEQ ID NO: 70642 - DNA, 542 bp, Zea mays
  misc_feature: Ceres CLONE 1550806
  misc_feature: Encodes the peptide sequence at SEQ ID NO. 70643
  misc_feature (365)..(365): n is a, c, t, g, unknown, or other
  misc_feature (384)..(384): n is a, c, t, g, unknown, or other
  misc_feature (422)..(422): n is a, c, t, g, unknown, or other
ccgattgggtaccgggccccccctcgagccctgcagtggtaaagggaccttcttgagcccgaagcaaaaggcactgctcatcgatccgccaccacgccacaaaatcctctcctactccggcagttctgctcgccgccgcctccacgatgccggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatatcccgcgccttccgccctcacgtcgcgctccgtcgccgcctcgccgcgcgggacgtctcccgcttncctcgcttcgcgcttcccngcgtcctccgaagcctacggacgcctcactgccctggntgccaaaggaggatgataactgaaaatggaggttgaaatgctttaaacttcccgaaaaactaaaatttccaatccaaaacatggggcccccccggggaaattggaaaaatttattgcccc

SEQ ID NO: 70643 - protein, 103 aa, Zea mays
  misc_feature: Ceres CLONE 1550806
  misc_feature (73)..(73): Xaa is any aa, unknown, or other
  misc_feature (80)..(80): Xaa is any aa, unknown, or other
MPEDVQMNDSEPQPAASAPAVGAPALSTLHHLKEIASVIEAGSLSKEVRRISRAFRPHVALRRRLAARDVSRXPRFALPXVLRSLRTPHCPGCQRRMITENGG

SEQ ID NO: 70644 - DNA, 745 bp, Zea mays
  misc_feature: Ceres CLONE 1550815
  misc_feature: Encodes the peptide sequence at SEQ ID NO. 70645
  misc_feature (91)..(91): n is a, c, t, g, unknown, or other
acccgcggtggcggccgctctagaactagtggatcccccgggctgcaggagttcgtctcacccctagaaaaactactccggccgcctctcnttccagcaatccctcccacctcctccccgccgtctcacgaggagctagaggaaggggaggctctgtaccagcctgttggaagggggcgagatgagcatgtacgggagggatccctggggcggcccgctggagatatgccacgactcggccacggacgacgaccgcagccgcaacctggacatcgaccgggccgcgctgtcgcggacgctcgacgagacgcagcagagctggctgctggcgggggaccgccgaccagccccgcaagaagaacaagtacgtcgacatcggctgcctcctcgtcagcccccccccccgggcatctggacgctcggcgtgctcctcgccgccgccgtggttcccggggggccgtggccgggatcgccaaggccatccccaggcgggcaccgcccgctgccaaccgcccgaagactacaccctccccgcctgcacaagggcgctccatggttcttccaggcccaagaaattctggggaacctttccgaaaccccaacaaaataccatttgggcccgggtaactcttttgcttgaaaggaccgggcttttctggacccttgcaattcaggggcaaactccttggtttgggcggggaatttttgaatcccggggaacacccctttaaagtttctattttcg

SEQ ID NO: 70645 - protein, 152 aa, Zea mays
  misc_feature: Ceres CLONE 1550815
  misc_feature: SWISSPROT Homolog: EC 3.2.1.4 Cellulase
MSMYGRDPWGGPLEICHDSATDDDRSRNLDIDRAALSRTLDETQQSWLLAGDRRPAPQEEQVRRHRLPPRQPPPPGIWTLGVLLAAAVVPGGPWPGSPRPSPGGHRPLPTARRLHPPRLHKGAPWFFQAQEILGNLSETPTKYHLGPGNSFA

SEQ ID NO: 70646 - DNA, 720 bp, Zea mays
  misc_feature: Ceres CLONE 1550816
  misc_feature: Encodes the peptide sequence at SEQ ID NO. 70647
tggagctcaccgcggtggcggccgctctagaactagtggatcccccgggctgcaggaattcgtctcacccctagaaaaaagctcactcgtgccgtgcactcgtcccgtccgcctccaccctccaagacctcgcattgccaccgccgccgccgagtcaggggagaggagagaggccagccgcgtcgcggcgagcggatgaggaggactagcgcgagagcggagcgagccagccgggcacgatgttcgggcgggatccctggggcgggccgctagagatctccaacgccgactcggcgacggatgacgaccgcagccgcgacctggaccgggcggcgctgatgcggcagctggacgagacgcagcacagctggctcctggccgggcccggcgaccaggccggcaagaagaaaaagcggtacgtcgacctcggctgcctcgtcgtcgaccgcaaggtcttcatgtgtacagtcggtaccgtgctcggactcggcgtcgtcatcggcttcgtcatcatgatcgtcaagctcgtactgcacgagcgcccctccgcgccgtccgcccgacagtaaacgcaggcgctgcataaggcgctcatggttcttcacgcccagggatcgggtccgctgcccaagcaaaagggcgtagagcttgacgggctactcctgcatggatggacggcttctcgaaaagaagctttccgggggaagccggttctgaagc

SEQ ID NO: 70647 - protein, 109 aa, Zea mays
  misc_feature: Ceres CLONE 1550816
  misc_feature: SWISSPROT Homolog: EC 3.2.1.4 Cellulase
MFGRDPWGGPLEISNADSATDDDRSRDLDRAALMRQLDETQHSWLLAGPGDQAGKKKKRYVDLGCLVVDRKVFMCTVGTVLGLGVVIGFVIMIVKLVLHERPSAPSARQ

SEQ ID NO: 70648 - DNA, 719 bp, Zea mays
  misc_feature: Ceres CLONE 1550819
  misc_feature: Encodes the peptide sequence at SEQ ID NO. 70649
ctggagctccccgcggtggcggccgctctagaactagtggatcccccgggctgcaggaattcgtctcacccctagaaaaaagggagaacttattacaaccgaccaacgcgctttgtaacgcctccgctgcaatcagcccccgcggcgagcttgccctgcccctgaccctgagtgctagttctcgccgttacgtaaggtaagctccatctccatcttatttttttcttctcttctccattcatatcggcagatgagcgacgggttctgatccctttcgaaaaacaggcttcttggccttgcgtcctccgtctttcgttgctgatacatcgaggtattaaagaagctgcctgattccgggtagcagaggtcgccgccgcctgcagcaatggccgacttctcctggctcacggtgcttggtttcctattcctcacattcaactcaggcatggcgatttatcggtccaacggtgacgccggctccgtcgctttcgtcgtggtatcttatctcgacctggtggccctgttcgcctgcttgcgctactacgagcagtgtgatcagcagcactcccaaaagcgcgcgagggtcaaggctggggtttggagcctcacgaccctccttactatcatgttcagttacaaggtggctgagaatatgccccctgcagtcaaacttgttgtctggtcgatggcaggcgcttacaacctgttcggcttctacg

SEQ ID NO: 70649 - protein, 111 aa, Zea mays
  misc_feature: Ceres CLONE 1550819
MADFSWLTVLGFLFLTFNSGMAIYRSNGDAGSVAFVVVSYLDLVALFACLRYYEQCDQQHSQKRARVKAGVWSLTTLLTIMFSYKVAENMPPAVKLVVWSMAGAYNLFGFY

SEQ ID NO: 70650 - DNA, 699 bp, Zea mays
  misc_feature: Ceres CLONE 1550820
  misc_feature: Translation starting site: 257
  misc_feature (485)..(485): n is a, c, t, g, unknown, or other
ctggagctcaccgcggtggcggccgctctagaactagtggatcccccgggctgcaggaattcgtctcacccctagaaaagttcctccgcgctcatcactgaccttctcacgggcgagaggactaacctccctcccttcgcgccatctcccgcggtgctgcctcctctggcgccgattcgccgctgggagccccaattctataacccctctgttcgatctgggatccgctagattcgttggggcggtgatgagggcgatggcggaggtgatgcaggaggggtgcgtggagaatcggcagccactggcggcttcgagctcgtccgtgtcggatggcagcagctgtggcggcggagagcgggcggggacgtcgccgccggtgtcaagctccgggaattgcatctccgttctgagacgaacaagtggaccgataagaagaactaagggtggctggacactgaaagaggatgaaacactgcggaaggcangtgaagctttcaagggtagaaattggaaaaaatagctgaattttttcaggacagaactgaggtttcatgtttgcatcgttggcagaagggttcttatccgaaactatcaaaggcccttggactcaggaggagatgaaaaaatctttgaccttgtgcgcaagtttgaaccacaaaatggtctatcatcgcaaaatcttggctgggcgcctaggca

SEQ ID NO: 70651 - DNA, 715 bp, Zea mays
  misc_feature: Ceres CLONE 1550821
  misc_feature: Encodes the peptide sequence at SEQ ID NO. 70652
  misc_feature (403)..(403): n is a, c, t, g, unknown, or other
  misc_feature (404)..(404): n is a, c, t, g, unknown, or other
ggagctcaccgcggtggcggccgctctagaactagtggatcccccgggctgcaggaattcgtctcacccctagaaaaagttcctccgcgctcatcactgaccttctcacgggcgagaggactaacctccctcccttcgcgccatctcccgcggtgctgcctcctctggcgccgattcgccgctgggagccccaattctataacccctctgttcgatctgggatccgctagattcgttggggcggtgatgagggcgatggcggaggtgatgcaggaggggtgcgtggagaatcggcagccactggcggcttcgagctcgtccgtgtcggatggcagcagctgtggcggcggagagcgggcggggacgtcgccgccggtgtcaagctccgggaattgcatctccnncctgagacgaacaagtggaccgataagaagaactaagggtggctggacactgaaagacgatgaaacactgcggaaagcagttgaagctttcaagggtagaaattggaaaaaaatagctgatttttttcaggacagaactgaggttcaatgtttgcatcgttgggcagaggttcttaatccggaacttatcaaaggcctttggactcaggaggaagatgaaaaaatcattgacccttgtgcccaagtatggaccaacaaaaatggcctatcatcccaaaatcattggctggcccccttaggcaagcaatgcc

SEQ ID NO: 70652 - protein, 156 aa, Zea mays
  misc_feature: Ceres CLONE 1550821
  misc_feature (65)..(111): Pfam Name: Myb_DNA-binding Pfam Description: Myb-like DNA-binding domain
  misc_feature (53)..(53): Xaa is any aa, unknown, or other
MRAMAEVMQEGCVENRQPLAASSSSVSDGSSCGGGERAGTSPPVSSSGNCISXLRRTSGPIRRTKGGWTLKDDETLRKAVEAFKGRNWKKIADFFQDRTEVQCLHRWAEVLNPELIKGLWTQEEDEKIIDPCAQVWTNKNGLSSQNHWLAPLGKQC

SEQ ID NO: 70653 - DNA, 705 bp, Zea mays
  misc_feature: Ceres CLONE 1550822
  misc_feature: Encodes the peptide sequence at SEQ ID NO. 70654
gcggtggcggccgctctagactagtggatcccccgggctgcaggaattcgtctcacccctagaaaaattcgaggcgataggcatcgtcgtcccacccagcagtgcagagactctctctctctctccccggccacctctcgctcacgagcaccccatcttcccggccagggcctgggtatgggtgctccgctcgcctcctggccatgggcaagcctcggatcatacaagtacctgctgtacgggcctctggtggcgaaggtggcgcacgcgtggagggagacggggagcctgccgctggggtcgtggtgcctccacctcctgctcctcctggcgctccgctcgctcaccttccagctctggttctcctacggcaacatgctcttcttcaccccccgccgccgcgtcgtcaaggacggcgtcgacttccgccagatcgacgccgagtgggactggggatacatggtgatcctgcaaaccctggtcgcggcggtggcgatgggcagcgcggcgttcccggccgtgtcggagctgcgggcgtgggacccgcgcgggtgggcccctggcctgctcctgcacgtggccgtctcggagcccgtcttctactggaccacagggcgctgcaccgggcccgctcttcagccagtaccacgcaggcaccactcgtccccgtcacgcagccgtcacgggcgggtttcgcacgcgctg

SEQ ID NO: 70654 - protein, 176 aa, Zea mays
  misc_feature: Ceres CLONE 1550822
MGAPLASWPWASLGSYKYLLYGPLVAKVAHAWRETGSLPLGSWCLHLLLLLALRSLTFQLWFSYGNMLFFTPRRRVVKDGVDFRQIDAEWDWGYMVILQTLVAAVAMGSAAFPAVSELRAWDPRGWAPGLLLHVAVSEPVFYWTTGRCTGPALQPVPRRHHSSPSRSRHGRVSHAL

SEQ ID NO: 70655 - DNA, 751 bp, Zea mays
  misc_feature: Ceres CLONE 1550825
  misc_feature: Encodes the peptide sequence at SEQ ID NO. 70656
  misc_feature (1)..(1): n is a, c, t, g, unknown, or other
  misc_feature (2)..(2): n is a, c, t, g, unknown, or other
  misc_feature (34)..(34): n is a, c, t, g, unknown, or other
  misc_feature (415)..(415): n is a, c, t, g, unknown, or other
  misc_feature (416)..(416): n is a, c, t, g, unknown, or other
nntttttagtcgctcagcaatgctgcaattctanggctggtggatcccccgggctgcaggaattcgtctcacccctagagaaaaaccgatcggatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgaactcnncgccaagctcacggggctggcccctgccgacgccatcctcgtggcgagctccatcctgcacatgctcaacctcgcccacctggccgaggaggtgcagatcgcgcaccgcccccgcaacagcaaactcaagaaaggtggcttcgccggacaaggctcccgcaccaccgaagtccgacatcggggaagacgctccaagcgcctcgtgtcccaaggtcgggaaggtccccggaggaaggggtccgaggggcctcaaaaaacagaaccgttcaacctcggtcttttccgggcgattcccacgcgagttccgccccgcccgctttgtcccctggcaaaaa

SEQ ID NO: 70656 - protein, 195 aa, Zea mays
  misc_feature: Ceres CLONE 1550825
  misc_feature: SWISSPROT Homolog: EC 4.1.1.31 Phosphoenolpyruvate carboxylase
  misc_feature (84)..(84): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELXAKLTGLAPADAILVASSILHMLNLAHLAEEVQIAHRPRNSKLKKGGFAGQGSRTTEVRHRGRRSKRLVSQGREGPRRKGSEGPQKTEPFNLGLFRAIPTRVPPRPLCPLAK

SEQ ID NO: 70657 - DNA, 714 bp, Zea mays
  misc_feature: Ceres CLONE 1550827
  misc_feature (62)..(62): n is a, c, t, g, unknown, or other
  misc_feature (134)..(134): n is a, c, t, g, unknown, or other
  misc_feature (403)..(403): n is a, c, t, g, unknown, or other
  misc_feature (483)..(483): n is a, c, t, g, unknown, or other
aaagctggagctcccccgcggtgggcggccgctctagaaactagtggatcccccgggctgcnaggaattcgtctcaccccctagaaaaaaaaacccatccctaaaatcccgagcccccaaaccccccgtacgcngcccgccgcgccgcaatggcacaccaccgccgcgcccccgctcctccccatcctcctcctcctcctcctcctgctcgccaccaccacggaacccgcggcgcccggcgccgcatcgcgctcggagccgacgctgccagtgccgccggtcccaagcgccgcggtgcccccctccgcggcgctggcgtcgacgcctccgccggtctcgccctcggccgcggcgctcgcggcattcctcgccaaggcctgacccggccatcgcgcctgcgccntccccagccccgcccccccccccctgctccccgccggggggtcacctgcacgggcacccggccatatcatccgccctcgntcctcgagtcggcgggggctcaacggggacgttccgccggggcacgctctcgcgactcgtcgagcttcgcgtgctcagcctcaagtcaacgcgcttcacgggccggtccggaactctcccgctctacaactcaaggcgctcttcctcgcgggaaacgcttctcggggcctttccggcctcgtttgcttcctgggcggctcggtcatagactctccggtacagctctcgggc

SEQ ID NO: 70658 - DNA, 719 bp, Zea mays
  misc_feature: Ceres CLONE 1550829
  misc_feature: Encodes the peptide sequence at SEQ ID NO. 70659
  misc_feature (597)..(597): n is a, c, t, g, unknown, or other
ccgcggtggcggccgctctagaactagtggatcccccgggctgcaggaattcgtctcacccctagaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccaaataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgtaaactgcgctcgcctttgcgtgttcgtggtccttttgcgctttctcgtccctctttctctcaatctctccttattcttctccttccacggcgaagccggcggctggtatggatcccaatggcctcaaaactggaggccttttgctccccgacatcgagaggcggtgcacgtcgcctccatccgtcattgtcatcggcggtggcatctcgggcgttgcagctgcccgtgcccntctcaaatcttcattttaagtgactgtttttgaatccagagatcgtattggcgggcgcattcatactgattacctcgttggatgccccattgatatgggaggctcatggctacccggctgtg

SEQ ID NO: 70659 - protein, 47 aa, Zea mays
  misc_feature: Ceres CLONE 1550829
  misc_feature (42)..(42): Xaa is any aa, unknown, or other
MDPNGLKTGGLLLPDIERRCTSPPSVIVIGGGISGVAAARAXLKSSF

SEQ ID NO: 70660 - DNA, 701 bp, Zea mays
  misc_feature: Ceres CLONE 1550831
  misc_feature: Encodes the peptide sequence at SEQ ID NO. 70661
  misc_feature (539)..(539): n is a, c, t, g, unknown, or other
  misc_feature (698)..(698): n is a, c, t, g, unknown, or other
acccgcggtggcggccgctctagaactagtggatcccccgggctgcaggaattcgtctcacccctagaaaaaagttcggcttcttcgtccaggccatcgtcaccggcaagggcccgctcgagaacctcgctgaccacatcgctgacccagtcaacaacaacgcatgggcctacgccaccaacttcgtccccggcaactaagctcaacggctatgctatgcaacttcattgtctttcggatcggagagggtgtacgtacgtggattgattgatgctgcgagatgcatgtgtgtcttttgtttcacgttgcattgcatacgcaagtcgagatgatgagttggcgttgtacactaagatgaaccatgtttgtgcaatagtggtggattttgtttcgtgctggctaaaaaaagcttcctgcttttcgtcctcacctcacttcccccactctcttctctccacgcggcccgtgactcatccacccacagtccactcgccactccccccggaaacggcgctgcggctactgcggaggagtaacgncagatggcgaggacacctctcgactacgaggagctgaacgagaaacgtcagaggatgcagtacgcggtgcgcggggagctgtacctccgcgccctcgagctgcagaaggagggcaagatgatcatcttcaccaacgtcggcgacccgcacgtcctcggncag

SEQ ID NO: 70661 - protein, 53 aa, Zea mays
  misc_feature: Ceres CLONE 1550831
  misc_feature: SWISSPROT Homolog: EC 2.6.1.2 Alanine transaminase
MARTPLDYEELNEKRQRMQYAVRGELYLRALELQKEGKMIIFTNVGDPHVLGQ

SEQ ID NO: 70662 - DNA, 734 bp, Zea mays
  misc_feature: Ceres CLONE 1550836
  misc_feature: Translation starting site: 208
  misc_feature (734)..(734): n is a, c, t, g, unknown, or other
aaaagtggagctcaccgcggtggcggccgctctagaactagtggatcccccgggctgcaggaattcgtctcacccctagaaaaacccctagaaaaacgtgccaccagagaaggtgttcgccgtgcataatcacagactatatacattccacagacctgtaaagctctgtgaatttggagctcccacaggttctgcattggcgttgagatggggaggcattcttgctgctacaagcaaaagttgagaaaggtgctctggtcccccgaggaggatgagaaactcatgaaccacataacaaagcatggccatggctgctggagttctattcccaaactcgctgggctccaaggtgcggaaagagttgtaggctgaggtggataaactatctgaagccagacctcaagagagggccactctcccaagacaaagaaaactcatcattgaacttcccgcctgtcctgggaaacagggggtctcaaattgcacctcacctgcccggggggactgataatgaaatccaaaatcttgggaactcgggcatcaggaaaaaaccctaggcaaaagggtttttatcccaaacccccaaaagcccctttatggagggttaacgccgggggagaaatttcccccctttgagccccggaggaacccctgggggccccagcaaaaacacccatataggggcgggggggcttgggagaaatgtggcccaccccctcccggaaagaggttan

SEQ ID NO: 70663 - DNA, 736 bp, Zea mays
  misc_feature: Ceres CLONE 1550837
  misc_feature: Encodes the peptide sequence at SEQ ID NO. 70664
ctcaccgcggtggcggccgctctagaactagtggatcccccgggctgcaggaattcgtctcacccctagaaaaaactctcactctcacgcacacactccacagtgccactcgtctcgctcgcgcagcagacagcatgggttcgtcggcggcgcttcagccgaagcagctgtaccagctcgtggtgaacaacttcgtcgccgtgctcgctgcgccgctggccgtggcggccgtcgtcaatgcggcgcgcgtcaggccggacgagctgctcggcaggctgcaggcgctccgggcggtgcacgtatttctcgccgtgtgtgtcgcggccgccacggcgatactgtacgtcctgctgcggccccgggccgtgtacctggtggactacacctgcttccgcaccccccccaactgacgcgtacccttcgccaccttcctggagcacgcgaagctggtgacgttcgtggagggagcctccatcgacgagcgcagcgtccggttcatgacgctgctgctggagcgggtcggcctcggcgaggagacctgcctgcccccggcccaccaattacatcccggcggtaacggaactgggaggcctccccgcgccggaggtgggagctcgccatcttttttgggccattcgacaacctggtccgcgaaagacggggcaatagcccccaggggccttcgaaaatcctggggggtgaaattgtaccctttttcggggcccggcccctttct

SEQ ID NO: 70664 - protein, 91 aa, Zea mays
  misc_feature: Ceres CLONE 1550837
MGSSAALQPKQLYQLVVNNFVAVLAAPLAVAAVVNAARVRPDELLGRLQALRAVHVFLAVCVAAATAILYVLLRPRAVYLVDYTCFRTPPN

SEQ ID NO: 70665 - DNA, 706 bp, Zea mays
  misc_feature: Ceres CLONE 1550839
  misc_feature: Encodes the peptide sequence at SEQ ID NO. 70666
  misc_feature (495)..(495): n is a, c, t, g, unknown, or other
ctcaccgcggtggcggccgctctagaactagtggatcccccgggctgcaggaattcgtctcacccctagaaaaaggcacgtactccagagacgcgcgcgcgagtccataaattatgagctcgccctttggaaccgagaggcgtttcctacccaccttaccttatcattattagctcctccaagcaagtcgcacacgacacatcatcatcaacagcctgacatggccggcgacgacggggcgcacggcgcgtcggcgcggctggagggcgtgctgacggatgcgtcgaccccgtgggcgcggcgcgcgtggggcgcggccgccatcgagctgccgctgctgacgcggctggcggcgccggcggtggtgatgtacatgatcaactacctcatgtccatgtcgacgcagatcttctcgggccacctcggcaacctggagctcgccgccgcctcgctcggcaacatcggcgtgcagattttcgcctacggactcatgcntggcatgagcagcgcggtggagacgctgtgcgggcaggcgtactgcgccccacagtacgagatgctgggcatctacatgcagcagtcgggcgtgctgctgtgcgcgacgggcgtgccgctggccgtgatctacggcttcctcgaagcgatcctggtgtccctggggcagtcgccggaaatcgcccgggcggggtcattctcgtgtacggcc

SEQ ID NO: 70666 - protein, 162 aa, Zea mays
  misc_feature: Ceres CLONE 1550839
  misc_feature (92)..(92): Xaa is any aa, unknown, or other
MAGDDGAHGASARLEGVLTDASTPWARRAWGAAAIELPLLTRLAAPAVVMYMINYLMSMSTQIFSGHLGNLELAAASLGNIGVQIFAYGLMXGMSSAVETLCGQAYCAPQYEMLGIYMQQSGVLLCATGVPLAVIYGFLEAILVSLGQSPEIARAGSFSCTA

SEQ ID NO: 70667 - DNA, 665 bp, Zea mays
  misc_feature: Ceres CLONE 1550841
gctgcaggaattcgtctcacccctagaaaaagttactgggatccctgaatattgtatgttacgctgactcgagcagttcacctaaaaaaaaaaaaacgagcggaagacagacaggcaggcaagccagaccaacgcgggggcggagcccgagaggccacccgagggcgagaagtggaggcggtgctgcggtggcatgccatggttataaaaagtaacggagcgcgacgagggtagaaagcggaaggcccgccgcttccccttcttcattcccgtcccacacacgccgccgccgccggtgcggctcgcttccgtcccccccggtccgcgcgggctgcctgcgggagcagggtggcagggcactccagcaaccacttgggtggggaggcgacgacaccaccctatgctctgtcctcgcccgccgagtaagattgctcccgcagtgaatttgggagcttgaagcattcatctgagacatggaaaaagtgatcttgctgggtatatctccttcaacgcaagcagtttctcgaaaagaaactcttgattgctgttgtcttaactcgtgggaacactcctcttctcctctctcgtgaactacactatggtggtttatatgttcgctctatgctcaacaacaaggagggctgtatgcctactttttggcttga

SEQ ID NO: 70668 - DNA, 716 bp, Zea mays
  misc_feature: Ceres CLONE 1550842
  misc_feature: Encodes the peptide sequence at SEQ ID NO. 70669
ctccccgcggtggcggccgctctagaactagtggatcccccgggctgcaggaattcgtctcacccctagaaaaatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgccttgccgcccaggcgggtggacgcggtcgcgatggtctccaacgcggagaccgagacggagaaggagcaggaggaggcggcggccgccagcgaggagctgcccgtcatgccctgggccacctccgtcgcaagcggttacacccttttgagggatccacaccacaacaagggtcttgctttcacagaggaggaaagggatggacactacttgcgtggactgctccctccggcagtactatctcaggaactccaaattaagaaagtcatgaacaccctgcggcagtaccagacccctttgcagcggtatatagctatgatgaaccttcaggaaacggacgaggagcttttctacaagcttttaattg

SEQ ID NO: 70669 - protein, 173 aa, Zea mays
  misc_feature: Ceres CLONE 1550842
  misc_feature: SWISSPROT Homolog: EC 1.1.1.40 Malate dehydrogenase (oxaloacetate-decarboxylating) (NADP(+))
MLSTRTAAVAASASPASPWKLGGRSEGGASCDGCRTYRNTLRRRAAPAKVRALPPRRVDAVAMVSNAETETEKEQEEAAAASEELPVMPWATSVASGYTLLRDPHHNKGLAFTEEERDGHYLRGLLPPAVLSQELQIKKVMNTLRQYQTPLQRYIAMMNLQETDEELFYKLLI

SEQ ID NO: 70670 - DNA, 710 bp, Zea mays
  misc_feature: Ceres CLONE 1550846
  misc_feature: Encodes the peptide sequence at SEQ ID NO. 70671
  misc_feature (356)..(356): n is a, c, t, g, unknown, or other
  misc_feature (419)..(419): n is a, c, t, g, unknown, or other
  misc_feature (500)..(500): n is a, c, t, g, unknown, or other
tggagctccccgcggtggcggccgctctagaactagtggatcccccgggctgcaggaattcgtctcacccctagaaaaattcttctctctcctcctttctcggtcctctccgcatttcggccacttgtggcggcgtagctagcgtactacagctccctgcatggtgatggaggggcgcacgggctcactctacggccgcctcaacaagagcagcacgcgggggttcctcgcctacaccgccgccggggctgcctgcgcggctgtcctcgcctgcttcgtgctctccgccgcggactcgccggcatctgcggcacgcaacgatggcgcgcgcctccccgctgtctcgcgctcaccgngcgtctggcccgaccctcgcgtcactggcgggtgggtgtcgcccacgtcgtcgggtcctccgntccgcgtttggcaccgtcggcggcgtcggcggaggcgggatcctcgtggccatgctcaacctcgtcggcggttccgaaacnaaatccggcgccgggctccccaaatgcatgatcatgggggcctccgcgtcatccgttttggcaaccctccgggggtcccccccaaccaagggagggccccgaatcaaataaaaagcccggtttgctttcccagcccctgggtaagcccggggaaaacaccggggggaaaaaccaaggcctttttcccaaaaggggaaaccggggcccatt

SEQ ID NO: 70671 - protein, 96 aa, Zea mays
  misc_feature: Ceres CLONE 1550846
MARASPLSRAHRASGPTLASLAGGCRPRRRVLRSAFGTVGGVGGGGILVAMLNLVGGSETKSGAGLPKCMIMGASASSVLATLRGSPPTKGGPRIK

SEQ ID NO: 70672 - DNA, 687 bp, Zea mays
  misc_feature: Ceres CLONE 1550847
gcgctcttaactagtggatcccccgggctgcaggaattcgtctcacccctagaaaaaatcccagatcaggattagccgaccacccgccgaaggccagagagaaatatctcatcttctctccaccggatcggttcaatcgagagcgagggagaaagggaggtggtgcgtcgaggggggccgagattttgccggtttggagccagataggggtatgagctgcttcgcgcaccgccgccgctccgacgtcgcccgccgccaggacggcctcctcgtcttcgtcttcttcctctcgattcccatacgtaccagtagttttaatttaagtagtagtaattgtagtagcaatctcttgaaaactgcgctcgcctttgcgtgttcgtggtcctcctcccctttctcgtccctctttctctcaatctcctcttattcttctccttcacggcgaaaccgcgggtggtatggatcccatggcctccaactggagggcttttgctcccgacttccaaaagcggggcagtccgctcactcgtttttggcatcggggggggttcccggggttgaactgcccgggcccttccaattttttttttaggggactgttttggattcggaaatttttttgggggggcccttctcccgtaacccccttttggggcccctttttttggggcccccttggctccccgg

SEQ ID NO: 70673 - DNA, 690 bp, Zea mays
  misc_feature: Ceres CLONE 1550848
  misc_feature: Encodes the peptide sequence at SEQ ID NO. 70674
  misc_feature (587)..(587): n is a, c, t, g, unknown, or other
  misc_feature (632)..(632): n is a, c, t, g, unknown, or other
ggagctcaccgcggtggcggccgctctagactagtggatcccccgggctgcaggaattcgtctcacccctagaaaaagtcgcggcgtcgccggctcccacggtccaccgacgactcttcttcctcacctcctcccgctccagctccagctcgtctctctcctcgcctcgcgtagggtttcgcttcccgtctcgccgccgtcagcatgggggacaactacgatgacgaaggcgagccgatcgtgaacctcgacgaacgggaaccctcccctgagcatcagccgtacgaagacctcgatgacgacctcgacggcggcggcgattggacccgcgaccgctctccgaccccgtccacggcgacgacggcggggcagggtcctcctctagccccgaaagcgccttctcaagaagggcggcggtggaggcatgcccggcgatgacgggctggatgactttgggttggaggacgaagacgcggaaccttcggctgaagcgaagaagagaaaggctcgtcgtcgctgagggacctcacgaggggcggggcgagcagggagaagaagctaagaaaatgagagggaagaactacggnagggggatggacactcggatgttgagggataggcgggaatcagangaaaggactcacgccggtaggatgaccatgatgattggggagagggagatccaggagc

SEQ ID NO: 70674 - protein, 77 aa, Zea mays
  misc_feature: Ceres CLONE 1550848
MGDNYDDEGEPIVNLDEREPSPEHQPYEDLDDDLDGGGDWTRDRSPTPSTATTAGQGPPLAPKAPSQEGRRWRHARR

SEQ ID NO: 70675 - DNA, 719 bp, Zea mays
  misc_feature: Ceres CLONE 1550849
  misc_feature: Encodes the peptide sequence at SEQ ID NO. 70676
ctggagctcaccgcggtggcggccgctctagaactagtggatcccccgggctgcaggaattcgtctcacccctagaaaaagctgcggaagagtgtctcgtgctgctgcttccgctgcagtaaaatacggggaagaggaggggagggagacgcggccgctgcctgccgcacatgctttaagtcccactccccacctccccagatctccgccctcctccccaccgcccccattcctcccctcggccgctaccgtagccgccgcactacggagcaagatcgtctggtagacggacgggcgggcgggcgggcgcggctctgtatctatctgtcggtgggagaccgcgtgtgtcggttaggcggcgggtggcaaggaataatggcggcgagcggcagatccgtcgcgtgctgtacccccacgctgctcgcggccgcgttgctcctctctgcaccgactgcaacagaggcttatgattcgctggatcccaatgggcacatcaccatacaatgggatatcatgcagcggactcctgatggatatgtcactgttgtcaccatgtttaattatcaacaatttcggcctatcggcgcacctggttggcagcttgggtggacatgggcaaagacagaggttatatggtccatggttggcgctcagaccactgaacagggcgactgctcaaagttcagagcagcccacccccatgctgccagaaagaccaa

SEQ ID NO: 70676 - protein, 114 aa, Zea mays
  misc_feature: Ceres CLONE 1550849
MAASGRSVACCTPTLLAAALLLSAPTATEAYDSLDPNGHITIQWDIMQRTPDGYVTVVTMFNYQQFRPIGAPGWQLGWTWAKTEVIWSMVGAQTTEQGDCSKFRAAHPHAARKT

SEQ ID NO: 70677 - DNA, 719 bp, Zea mays
  misc_feature: Ceres CLONE 1550851
  misc_feature: Encodes the peptide sequence at SEQ ID NO. 70678
tggaggtcaccgcggtggcggccgctctagaactagtggatcccccgggctgcaggaattcgtctcacccctagaaaaagcaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagagtactctcgtgcaactaggaaaaggcacaaggttccgtcccactgcatgcgtcaagagactgtctggttttcttgttctgatttgtcatttgctggtgctcaaagccggcttgggttccctcgaagatcagcatctactcttgattgtggactttgtcgcatctgatatcaacttcataaatctttatccaagatggcgctgcaaaacaatggtgcctcaaacagggatgatgccttctacaggtaccagatgcccaagatgattcccaagatagaaggcggtgggtatggtatccagaacaatgttggtggaactggttgacatagcaaaagcatttgccaggccagtttccttacaaaacaagaactttgggaggggactttgggccaggcccaaattttgtgagaaaacgggatttcctgggttaaggggcccaag

SEQ ID NO: 70678 - protein, 42 aa, Zea mays
  misc_feature: Ceres CLONE 1550851
MALQNNGASNRDDAFYRYQMPKMIPKIEGGGYGIQNNVGGTG

SEQ ID NO: 70679 - DNA, 722 bp, Zea mays
  misc_feature: Ceres CLONE 1550854
  misc_feature: Encodes the peptide sequence at SEQ ID NO. 70680
  misc_feature (722)..(722): n is a, c, t, g, unknown, or other
tggagctccccgcggtggcggccgctctagaactagtggatcccccgggctgcaggaattcgtctcacccctagaaaaaaaagctaggtgcttcggcttcctttcgcgcccaattggaggcacaccccgcaataaaaaaaaatgagaattcgatgcgacaaacaagctcaaatgcttggtcggtccttttgaaggttcgagaccagccatgtcctcggcgccctgctggcctcctcgccgttgctggcgcgcgcctgggaccgctgcacagccgcctccaccgcagcgccgtggttcgttcacggcgaagacggcggcaaggtgtacgtggggttctctggggtgcaggctgcgcttacggcggcaggcgcggccgtggccggcggcggcgcctacatcttcgcgccccacactctcggcggggacgcggcggggcggatgttcgcgccgctggtcgccgccgagcccgacccggccgctaccggggagccggttgccgtgcaagcgctggcgctgcagtgcttcctgacactctgctgcagtcctgattttcagatgcttctgaatcagatcaggggcaaggcagtcgtgttcacgggccactcccttggtggcgccgttgcgaccctcacggcgctacactacctctgcatctcatcgttcagctcggcacctgctcctcctgttctgtgcgtcacctttggaagcccattacttggcan

SEQ ID NO: 70680 - protein, 94 aa, Zea mays
  misc_feature: Ceres CLONE 1550854
MFAPLVAAEPDPAATGEPVAVQALALQCFLTLCCSPDFQMLLNQIRGKAVVFTGHSLGGAVATLTALHYLCISSFSSAPAPPVLCVTFGSPLLG

SEQ ID NO: 70681 - DNA, 665 bp, Zea mays
  misc_feature: Ceres CLONE 1550856
  misc_feature: Encodes the peptide sequence at SEQ ID NO. 70682
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (524)..(524): n is a, c, t, g, unknown, or other
tccccgcggtggcggccgctctagaactagtggatcccccgggctgcaggaattcgtctcacccctagaaaaaatacaattctcacacgcgcgcgcccaacacactagcctgcaggatcgtcgagcgcgaggcggctgccccgccggccggttcgttcgctctatagcttgagaccgatcctagctaggccaagacgatatcggcggcgatgatgatggacgcggcgaggatcgtagagtacttcaagggcaagtgcatcctcgtcaccggctcaacagggtttcttggaaagatccttgtggagaagatactgcgggtgcagcctgacgtgcgcaagatttacctgcttgtacgcgcggtcgacgagccatcagcgaagcagcgcgtccaacaagaagtgatagacacggagctgttcggcctgctgagagagaaacccgcaagggcttccagcaannnttttcgttaaaaagagggccccaaggggtcccgctcccccctttttttggggccccgccggggnaaaaaaaaaaacaattttttttttaacaaccgcctggggcttgaagcaacccttcttgaccccctggcccaaggatttaaaatttttttttattttcgaaacacccccaattttttaaaaaagatcaatgtttcccgggga

SEQ ID NO: 70682 - protein, 86 aa, Zea mays
  misc_feature: Ceres CLONE 1550856
  misc_feature (83)..(83): Xaa is any aa, unknown, or other
  misc_feature (84)..(84): Xaa is any aa, unknown, or other
MMMDAARIVEYFKGKCILVTGSTGFLGKILVEKILRVQPDVRKIYLLVRAVDEPSAKQRVQQEVIDTELFGLLREKPARASSXXFR

SEQ ID NO: 70683 - DNA, 672 bp, Zea mays
  misc_feature: Ceres CLONE 1550869
  misc_feature: Encodes the peptide sequence at SEQ ID NO. 70684
aaactggagctccccgcggtggcggccgctctagaactagtggatcccccgggctgcaggaattcgtctcacccctagaaaactcacccctccggacgaaatctgacccgggccacactccgctgctccgccatggcgatccgctccaaggcctggatctcgctgttgctcgcgctggccgtcgcgctctccgcccgggcggaggaggagcccgccgccgcggcggagggcgaggccgtgctcaccctcgacgtcgacagcttcgacgaggccgtcgccaagcaccccttcatggtcgtcgagttctacgccccctggtgtgggcactgcaagaaacttgctccagagtatgagaatgcggccaaggcacttagcaagcatgacccaccgattgttctcgctaaggttgatgctaacgaggagaagaacaggccgcttgctaccaagtacgagatccaagggttcccaaccatcaagatcttcagggaccaggggaagaacattcaggaatacaagggccctagggaggctgatggcattgtcgattacttgaagaagcaggttggccctgcgtccaaggagatcaagtcaccggaaagatgcggtggcccttatcgatgacaagaagatctacattgttggtatcttcgcagattcagcggcactgaattc

SEQ ID NO: 70684 - protein, 162 aa, Zea mays
  misc_feature: Ceres CLONE 1550869
  misc_feature (35)..(143): Pfam Name: Thioredoxin Pfam Description: Thioredoxin
  misc_feature: SWISSPROT Homolog: EC 5.3.4.1 Protein disulfide-isomerase
MAIRSKAWISLLLALAVALSARAEEEPAAAAEGEAVLTLDVDSFDEAVAKHPFMVVEFYAPWCGHCKKLAPEYENAAKALSKHDPPIVLAKVDANEEKNRPLATKYEIQGFPTIKIFRDQGKNIQEYKGPREADGIVDYLKKQVGPASKEIKSPERCGGPYR

SEQ ID NO: 70685 - DNA, 668 bp, Zea mays
  misc_feature: Ceres CLONE 1550875
  misc_feature: Encodes the peptide sequence at SEQ ID NO. 70686
  misc_feature (414)..(414): n is a, c, t, g, unknown, or other
  misc_feature (463)..(463): n is a, c, t, g, unknown, or other
ggagctccccgcggtggcggccgctctagaactagtggatcccccgggctgcaggaattcgtctcacccctagaaaaaagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaggaatgttgtcttggatgangttggaacccccaaagtggtcaatgatggagttaccattgcccgcgctnatgagcttgctgatcccatggagaatgctgggtgcttcctttgatccgggaagtgctaagcagaacaatgacctcggctggtgatgggaacaacaacgggctccggttctccgcttgggaaatcatcaaatttggggcatgtttgaggctttactttaggggggcaattcccggggcccgtttaaaaaagggctttgaaaaaaaa

SEQ ID NO: 70686 - protein, 118 aa, Zea mays
  misc_feature: Ceres CLONE 1550875
  misc_feature (88)..(88): Xaa is any aa, unknown, or other
  misc_feature (105)..(105): Xaa is any aa, unknown, or other
MATIPTTDSGLVLSSSALLRRTRRAASSVTARLPAVARRRPQLLVRASAKEIAFDQGSRAALQAGVEKLAAAVGVTLGPRGRNVVLDXVGTPKVVNDGVTIARAXELADPMENAGCFL

SEQ ID NO: 70687 - DNA, 659 bp, Zea mays
  misc_feature: Ceres CLONE 1550878
  misc_feature: Encodes the peptide sequence at SEQ ID NO. 70688
  misc_feature (632)..(632): n is a, c, t, g, unknown, or other
  misc_feature (659)..(659): n is a, c, t, g, unknown, or other
ctccccgcggtggcggccgctctagaactagtggatcccccgggctgcaggaattcgtctcacccctagaaaaaagccacttggatccggtgctcagcggaacagctagcttagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcggcggccgccgccagcaggaggaccggcggcggcgtgtcctcccggtccggctcccggcggcccgtgcggctgccgaggatcagctgcagcgccaccgaggaggtcagcggcgccgtgtcgtccgtcaccgtggagaggatgctgacggtgacggcgtcggtggaggcgtcgccggccatcgggcagatgtacttccagcgcgccgtcgacgacgtcggcgacctattcggcaagacgctgctgctggagctcgtcagctccgagctcgacgcanagtcgggcgtggagaagacgcgggtgn

SEQ ID NO: 70688 - protein, 130 aa, Zea mays
  misc_feature: Ceres CLONE 1550878
  misc_feature: SWISSPROT Homolog: EC 1.13.11.12 Lipoxygenase
  misc_feature (122)..(122): Xaa is any aa, unknown, or other
MMNLNLKQPLVLPAHHSNVVGSRLSSPSPSAAAASRRTGGGVSSRSGSRRPVRLPRISCSATEEVSGAVSSVTVERMLTVTASVEASPAIGQMYFQRAVDDVGDLFGKTLLLELVSSELDAXSGVEKTRV

SEQ ID NO: 70689 - DNA, 603 bp, Zea mays
  misc_feature: Ceres CLONE 1550879
  misc_feature: Encodes the peptide sequence at SEQ ID NO. 70690
ctccccgcggtggcggccgctctagaactagtggatcccccgggctgcaggaattcgtctcacccctagaaaaacgatacggcacgaggcggcgacccggacaggacggacgcgaaaatcagctgccgtggaggtgcgggcacgaacgcgggccccacccaacacgacgccgtaccgctattatcgcccctatctaccgcccctgccactattccctttccctctgactagtcactagccgaccgcgcgggaagcggtccgagttcacgaacttcacgccgctggctcccctcgccatggccggtgaacgcggccgcggggccgcggagagggtggatgctgccgtgggggcggtgggatccggtggctgggagttccggacgcgtacagcgcagctgctagctctgtcgcggggaatcggctcctcggccccttcacaaggagctgcggaagcaccccggggtcccccgaacaggaggaccagaacgggccctggcccttttccccaacccctgggggaggaatgaacttgctccagttgggcccggaggggaaaaagaaattccccgggcccgggaagggaaaaaatattaaaaaaaatcc

SEQ ID NO: 70690 - protein, 76 aa, Zea mays
  misc_feature: Ceres CLONE 1550879
MAGERGRGAAERVDAAVGAVGSGGWEFRTRTAQLLALSRGIGSSAPSQGAAEAPRGPPNRRTRTGPGPFPQPLGEE

SEQ ID NO: 70691 - DNA, 660 bp, Zea mays
  misc_feature: Ceres CLONE 1550880
  misc_feature: Encodes the peptide sequence at SEQ ID NO. 70692
  misc_feature (483)..(483): n is a, c, t, g, unknown, or other
agctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaagggccagatccaggacaaggnagggcatccctccagaccagcagcggctcatctttgctggggagcagctttgagacgggcgcacgcttgccgactacacaatcagaaggaaagcacctccacctggtgctgcgctccaggggagcatgcagattctcctgaaaccctgaacgggaaaacttaacctccgggggggag

SEQ ID NO: 70692 - protein, 163 aa, Zea mays
  misc_feature: Ceres CLONE 1550880
  misc_feature (6)..(74): Pfam Name: ubiquitin Pfam Description: Ubiquitin family
  misc_feature (110)..(110): Xaa is any aa, unknown, or other
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKGQIQDKXGHPSRPAAAHLCWGAALRRAHACRLHNQKESTSTWCCAPGEHADSPETLNGKT

SEQ ID NO: 70693 - DNA, 659 bp, Zea mays
  misc_feature: Ceres CLONE 1550885
  misc_feature: Encodes the peptide sequence at SEQ ID NO. 70694
ctccccgcggtggcggccgctctagaactagtggatcccccgggctgcaggaattcgtctcacccctagaaaaagccgtcttctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaacacgccgccgccgccatcgcgcgcgactcggccgccgtgttcgcctggtagggggagaccctcgagtagtactggtggtgcaccgagcgctgcctcgactggggcgaggcggcggccccgacctcatcgtcaaagacggggggaccccccgttcttatccccaagggtggcaaggcccaggaggtttccaaaaacccggggaagaccccgaacgcgggatccccgaataa

SEQ ID NO: 70694 - protein, 109 aa, Zea mays
  misc_feature: Ceres CLONE 1550885
  misc_feature (12)..(110): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTAVLIETLTALGAEVRWCSCNIFSTQEHAAAAIARDSAAVFAW

SEQ ID NO: 70695 - DNA, 644 bp, Zea mays
  misc_feature: Ceres CLONE 1550887
  misc_feature: Encodes the peptide sequence at SEQ ID NO. 70696
gcggtggcggccgctctagactagtggatcccccgggctgcaggaattcgtctcacccctagaaaaacgcgcggcgcgggggcggtctcctcggtcgccggcccgcttcagcgctgtctacggccaccacacccgcgacgcctcaacacatctcccactacctggcgcaccagccgcgggcgacatgggaggcgctctccgccgccttccccgccggcgagatgtcccacggccacgtagatgctgttctcctctccctcgctaggcacccccacgcctcccccgagcccgtcgccaggaacgccctcgccttcttccattggtccactgccgcagccgcttcgtcctcttccccgccgccgccgccgtcctcgcactcgctacggtcctactgcctcctcgtccacctcctctcccgcgccgcgctcttccgcgatgcctccgtcctcctcgaatcagccatttccaagcaccaatcgtctttgttctccgcttcgtgcttcctcgacgccttcttcgctgcctacgaggacagcggcacggccgccacgacccgcggcctacacctcctggttcacgcctacgcgcggctgcgcctcccgggggaggccctcgaggcctgccgctacctcgcgcggcgtggc

SEQ ID NO: 70696 - protein, 141 aa, Zea mays
  misc_feature: Ceres CLONE 1550887
MSHGHVDAVLLSLARHPHASPEPVARNALAFFHWSTAAAASSSSPPPPPSSHSLRSYCLLVHLLSRAALFRDASVLLESAISKHQSSLFSASCFLDAFFAAYEDSGTAATTRGLHLLVHAYARLRLPGEALEACRYLARRG

SEQ ID NO: 70697 - DNA, 673 bp, Zea mays
  misc_feature: Ceres CLONE 1550889
  misc_feature: Encodes the peptide sequence at SEQ ID NO. 70698
agctccccgcggtggcggccgctctagaactagtggatcccccgggctgcaggaattcgtctcacccctagaaaaactagaaaaataaaaaaaattgttcattcacccccgtgcgctctctccctgccgtggcgacgactgggcgacagccgccgccgcagccgtacaccaggcgccaaggccttcttcgggaccctcgccggcggagtatattctgtgccaatgaaatgtctgcctctgaaaaccaggctgctgaagccagaatggacaaaagtgccataaaaattggcccaactgggaacaaaatccgaattcgtttgccattatcactgagaaagcggttggccgaaggccttcagaccatgagcacaggattacctgaggatacaacaaaacacgctgctaaggaagtacctgaatatactgatgacactgccaaggctgatttcattgtcccagacctgaatctgacaatcactgctggcacgcaggataaaagggaaagcatttgccctgtaagaaaagggtcatgtgaagagcgacacacggaaattatgagcaatgggctgcctcctgacagcagcaaaacaacaaagaagcaagcgtgtgtaggagccatggacaacacccaaagcatggaaccttcaatcacaggagtgcaaagtgaagtgga

SEQ ID NO: 70698 - protein, 148 aa, Zea mays
  misc_feature: Ceres CLONE 1550889
MSASENQAAEARMDKSAIKIGPTGNKIRIRLPLSLRKRLAEGLQTMSTGLPEDTTKHAAKEVPEYTDDTAKADFIVPDLNLTITAGTQDKRESICPVRKGSCEERHTEIMSNGLPPDSSKTTKKQACVGAMDNTQSMEPSITGVQSEV

SEQ ID NO: 70699 - DNA, 663 bp, Zea mays
  misc_feature: Ceres CLONE 1550890
  misc_feature: Encodes the peptide sequence at SEQ ID NO. 70700
ctccccgcggtggcggccgctctagaactagtggatcccccgggctgcaggaattcgtctcacccctagaaaaaattccctctcttcctcccgaaatttcccacctcagactccgagagaagcaaacacaagaagaagaagaaaaaaaaccgtccgcacaaaaaagaaaacggcagcgccagccagtgaggagaaaagcttcagatccagctccagctccaggtccccctcctccccaatgcctcgcccgtagccgcgtccgccgcacgtcgcaatggccggccccagcgtgcccgcagcggcgctggcggccctgctcgcggtcgccgccctcacgtgctgcgccgtcgcggagccgccgccgagcgagcggtccgctctgctggcgttcctcaccgcgaccccgcacgagcgccgcctcgggtggaacgcctccaccccggcgtgcggctgggtcggggtcacgtgcgacaacgccaactccaccgtcgtcgaggtgcgcctcccgggcgtgggcctcgtcggcgccatcccgccgggcacgctcggccggctcaccaacctccgcgtgctctcgctccgctccaaccgcgtcctcgggaccgtccccgacgacgtgctccagctttgcagcctcaaggcgctgtttctgcaacagaaccc

SEQ ID NO: 70700 - protein, 129 aa, Zea mays
  misc_feature: Ceres CLONE 1550890
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAGPSVPAAALAALLAVAALTCCAVAEPPPSERSALLAFLTATPHERRLGWNASTPACGWVGVTCDNANSTVVEVRLPGVGLVGAIPPGTLGRLTNLRVLSLRSNRVLGTVPDDVLQLCSLKALFLQQN

SEQ ID NO: 70701 - DNA, 681 bp, Zea mays
  misc_feature: Ceres CLONE 1550892
  misc_feature (410)..(410): n is a, c, t, g, unknown, or other
  misc_feature (473)..(473): n is a, c, t, g, unknown, or other
  misc_feature (474)..(474): n is a, c, t, g, unknown, or other
  misc_feature (479)..(479): n is a, c, t, g, unknown, or other
  misc_feature (509)..(509): n is a, c, t, g, unknown, or other
  misc_feature (510)..(510): n is a, c, t, g, unknown, or other
  misc_feature (553)..(553): n is a, c, t, g, unknown, or other
  misc_feature (556)..(556): n is a, c, t, g, unknown, or other
  misc_feature (570)..(570): n is a, c, t, g, unknown, or other
  misc_feature (593)..(593): n is a, c, t, g, unknown, or other
  misc_feature (654)..(654): n is a, c, t, g, unknown, or other
  misc_feature (655)..(655): n is a, c, t, g, unknown, or other
tggagctccccgcggtggcggccgctctagaactagtggatcccccgggctgcaggaattcgtctcacccctagaaaaagttagagtattgagaggacctttctctagtaccagaggaccgggaaggaggcacctctggtgtaccctttatcgtgcctacggaaaaggcggggtagcctagtgtgcagaggataactgctgaaagcctataactagtaagcccaccccaagatgagtgctctctcaacacaagcaaggcgctcaagatgccgcccgggaaaaaccctagaccggcgatgtccgtccccggagcccccgcgggcggcggttcccgcagtttcgaattcggggcctattaaatgctctgctcctacggggagggcgcgggctctatttagtcagagcccccnggtatgggcgacagtgggcccgatattcatgatagcagactgagggaggcatttgagaaactnntcaanaagagatctatgggaaagagcatgtccttnntactgctgagcaagaggagaaaaaaagagccgaaaactgtgcnccnatccgttcgggggnattccccgccccgcctaccccanccgggactgcctttcctttaagcgtgccgagaccccgaagggtaaatgtggggggcggggnnctaaaagaaaacaaagagcacccgag

SEQ ID NO: 70702 - DNA, 633 bp, Zea mays
  misc_feature: Ceres CLONE 1550895
  misc_feature: Encodes the peptide sequence at SEQ ID NO. 70703
  misc_feature (535)..(535): n is a, c, t, g, unknown, or other
tggagctccccgcggtggcggccgctctagaactagtggatcccccgggctgcaggaattcgtctcacccctagaaaaaaaaaaggacgacccaagcaagctagctcgatctactactactactactagctggtacacatactagccatcctgccagccagccagcttgccatggcgcccaccgtgatgatggcctcgtcggcaaccgccgtcgccccgttccagggtctcaagtccgccgccagcctccccgtcgcccgccgcagcaccaggagcctcggcaacgtcagcaacggcggaaggatccggtgcatgcaagtgtggccggcctacggcaacaagaagttcgagacgctgtcgtacctgccgccgctgtcgacggacgacctgctgaagcacgtggactacctgctgcgcaacggctggatacactgcctcgagttcagcaagctcgggttcgtgtaccgcgagaactccaactccccgtgctactacgatgggcgctactggaccatgtgaaagctgcccatgttcnggtgcaccaacccccgcaggggtacaaggagcttgaggaagccatcgccccctacccggaacgccttgcaccgggtcattggtttcgaaacgtcaggg

SEQ ID NO: 70703 - protein, 115 aa, Zea mays
  misc_feature: Ceres CLONE 1550895
  misc_feature (58)..(116): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSAASLPVARRSTRSLGNVSNGGRIRCMQVWPAYGNKKFETLSYLPPLSTDDLLKHVDYLLRNGWIHCLEFSKLGFVYRENSNSPCYYDGRYWTM

SEQ ID NO: 70704 - DNA, 601 bp, Zea mays
  misc_feature: Ceres CLONE 1550897
  misc_feature (229)..(229): n is a, c, t, g, unknown, or other
  misc_feature (232)..(232): n is a, c, t, g, unknown, or other
  misc_feature (233)..(233): n is a, c, t, g, unknown, or other
ctccccgcggtggcggccgctctagaactagtggatcccccgggctgcaggaattcgtctcacccctagaaaaaacagacccccgcccacgaccacacgcagcaagcagcagccgcgcgctcgcctaggactaccgactacgagtagtgctcagctagcctccatccctcagcggcgagtggctgctgcgcattccctctcttatccgtctctgtgcttgtttatttgngtnncgtcgggagtaggcggccggcacatattgcagcgcagtccatgctcatgtcgacaagcgtcaacgggggccgccgcttgccgttctttaaggcgttcggccgggtccttaccgcgggtaccgcttgcgtttgtgttattcttcgtaggttaagggctccaagggcctttccctgaagcccttcccccttttggcaaatcaagggcaaaacccgccccggaaaaaaggtttttgccccaccccaaacttggggggacacgggggggggccccaaaaaggggcccccaaaaggggtttttttttgggcaccttttttggaaaggaaggggggtttttttttttttggggcgggaaagaataaaccccccg

SEQ ID NO: 70705 - DNA, 682 bp, Zea mays
  misc_feature: Ceres CLONE 1550905
  misc_feature: Encodes the peptide sequence at SEQ ID NO. 70706
  misc_feature (329)..(329): n is a, c, t, g, unknown, or other
  misc_feature (332)..(332): n is a, c, t, g, unknown, or other
  misc_feature (580)..(580): n is a, c, t, g, unknown, or other
tccccgcggtggcggccgctctagaactagtggatcccccgggctgcaggaattcgtctcacccctagaaaaaggtgcccagtgagctcagctcgatccatcgatcggagagcttttgcactgcaccagctctgaagccatggctgctgcttcttcctccatggacaggatcgcccagtgggtgtcgtcccaggaggtcccgaccgacctcaccgtccgcatcgccgactccgtcttctctctccacaaggcggtgatggtgcccaagtgcggctacatccgccgggccgtggcggcgagccaaacgcagggcccggggggcggcgccntcnagctggaccctctcgcgctgccgggcggcgctgacgcctgccagaaggcggcgcgctgctgctacggcgacagcctcgagatcacggcgcgcgacgcggcggcacttcgctgcgccgcggaatccctcgacgcgccggacctggcccgccgcgccgacgacttccttgcgcaggccgcgctgcgcgcgcttccccgggccgccgcccgtctgcgggtcctgcgaagggctgctccccggccgccgacnagctcgggcgtccccggcccgcgcccgcggaccccgtcccgcctcgggggctggcaacgaggggctttttcccgaacccccgggggccgccccccggtgggg

SEQ ID NO: 70706 - protein, 181 aa, Zea mays
  misc_feature: Ceres CLONE 1550905
  misc_feature (64)..(64): Xaa is any aa, unknown, or other
  misc_feature (65)..(65): Xaa is any aa, unknown, or other
MAAASSSMDRIAQWVSSQEVPTDLTVRIADSVFSLHKAVMVPKCGYIRRAVAASQTQGPGGGAXXLDPLALPGGADACQKAARCCYGDSLEITARDAAALRCAAESLDAPDLARRADDFLAQAALRALPRAAARLRVLRRAAPRPPTSSGVPGPRPRTPSRLGGWQRGAFSRTPGGRPPVG

SEQ ID NO: 70707 - DNA, 672 bp, Zea mays
  misc_feature: Ceres CLONE 1550912
  misc_feature: Encodes the peptide sequence at SEQ ID NO. 70708
tggagctccccgcggtggcggccgctctagaactagtggatcccccgggctgcaggaattcgtctcacccctagaaaaaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgccggcgccatcggccaggtgtgccaggtgatcggcgccgtcgtcgacgtgcgctacgatgagggcctcccgcccatcctcacggcgctcgaggtgctcgacaacgacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgtatcattaatgt

SEQ ID NO: 70708 - protein, 168 aa, Zea mays
  misc_feature: Ceres CLONE 1550912
  misc_feature (85)..(151): Pfam Name: ATP-synt_ab_N Pfam Description: ATP synthase alpha/beta family, beta-barrel domain
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTALEVLDNDIRLVLEVAQHLGENMVRTIAMDGTEGLVRGQRVLNTGSPITVPVGRATLGRIIN

SEQ ID NO: 70709 - DNA, 627 bp, Zea mays
  misc_feature: Ceres CLONE 1550913
  misc_feature: Encodes the peptide sequence at SEQ ID NO. 70710
  misc_feature (463)..(463): n is a, c, t, g, unknown, or other
  misc_feature (497)..(497): n is a, c, t, g, unknown, or other
  misc_feature (518)..(518): n is a, c, t, g, unknown, or other
ggagctccccgcggtggcggccgctctagaactagtggatcccccgggctgcaggaattcgtctcacccctagaaaaaactcgcagcagccagaggccagatccagccgccaaccccccaaacaaaaccctaggccaccattctgaccaccaggcacaagcagagcagaagcagacatggccaccattccgaccaccgattctggcctcgtcctcagttcctccgctctcctccggaggactaggagggccgcctcatccgtcaccgccaggctgccagccgtcgcccgccgtcgcccgcagctcctcgtgcgtgcctccgccaaggagatcgcctttgaccagggctccagagccgcccttcaggccggcgtcgagaagctcgccgccgcggtcggcgtcaccctcggacccagaggaaagaatgttgtcttgggatgagtttggaaccccccaaagtggtncaatgatgggagttaccattgccccgcgctattngagcttggctgatcccatggnagaatgctgggtgcttcccttgaattcggtgaagttggctagcaaagacgaatggactccgggctggtgatgggaaccaccaactgccctcttgttctcgcctagggga

SEQ ID NO: 70710 - protein, 87 aa, Zea mays
  misc_feature: Ceres CLONE 1550913
MATIPTTDSGLVLSSSALLRRTRRAASSVTARLPAVARRRPQLLVRASAKEIAFDQGSRAALQAGVEKLAAAVGVTLGPRGKNVVLG

SEQ ID NO: 70711 - DNA, 670 bp, Zea mays
  misc_feature: Ceres CLONE 1550916
  misc_feature (602)..(602): n is a, c, t, g, unknown, or other
ctccccgcggtggcggccgctctagaactagtggatcccccgggctgcaggaattcgtctcacccctagaaaaactcggtccctcccactcctgtcctctccccgccatttggctccgaaccctcacaacagtgcatcgtctctcctgtccccgccatttggttcggaactctcgcggcctcaactcctcctcgtcatcgtaacacccacgcttagagttcgtgagggtcgcccccgggggatctcgagacgtccgtttccaagagtggaccggctcggaggcgctgctgttaccttgggtggagctcggacctgcggatcagtgggattctcaagggagacggtggtttctgatttcctttctctaagcataccaaatcctttgtctcgagtcgggagcaactggttttgggcgtcgcggagcacatggcttaagaataatttcttccagcccggcgacaaattcgcagttggattcagcatatgcattttttatgctgacataggatgtgctcaaccatccgtggactccctctagttgcacaaaccacctcagtgctctctctttcttcgaatcggctaataatgggcagtgcttgccnaagctgcacagacgggccttttccgcaggatgtgttagggataggggatgccgccttagagaatggcc

SEQ ID NO: 70712 - DNA, 677 bp, Zea mays
  misc_feature: Ceres CLONE 1550921
  misc_feature: Translation starting site: 561
  misc_feature (292)..(292): n is a, c, t, g, unknown, or other
  misc_feature (293)..(293): n is a, c, t, g, unknown, or other
  misc_feature (308)..(308): n is a, c, t, g, unknown, or other
  misc_feature (500)..(500): n is a, c, t, g, unknown, or other
ctccccgcggtggcggccgctctagaactagtggatcccccgggctgcaggaattcgtctcacccctagaaaaagcagccaaccatctaccagcgactcagcgagcgagagcagcacacactgcacgcagctagctaggagcagcagcagcggcggcgatggcggcctccatgatctcctcgtcagctcctggcggtggcgcctcagggcctgccgcccctcggccgccgcgcctcctccttcgccgtcgtctgctccaagaagaagatcaagaccgacaagccctacgggnnattgggggtggcctngaccgtcgacgtcgacgccaacgggagaaagggcaagggcaagggcgtgtaccagttcgtcgacaagtacggcgcgaacgtcgacggatacagcccaatctacaacgaggatgactggtctcccaccggcgacgtctacgtcggtggaaccactgggcttctgatctggggcgtcaccctcgctgggatccntcgcgggcggcgccctcctcgtctacaacacaggcgcctctccgctaaggatatcaatgcatgcgcctcttgcgaatcgtcatgaaaaatcagggtgctgtcattatctacccccctggatgccccaccttcgcctggaacataaccagggtactcttcattactaaaaaaacgatg

SEQ ID NO: 70713 - DNA, 687 bp, Zea mays
  misc_feature: Ceres CLONE 1550923
  misc_feature (80)..(80): n is a, c, t, g, unknown, or other
  misc_feature (230)..(230): n is a, c, t, g, unknown, or other
  misc_feature (311)..(311): n is a, c, t, g, unknown, or other
  misc_feature (395)..(395): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (405)..(405): n is a, c, t, g, unknown, or other
  misc_feature (445)..(445): n is a, c, t, g, unknown, or other
  misc_feature (630)..(630): n is a, c, t, g, unknown, or other
  misc_feature (650)..(650): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (687)..(687): n is a, c, t, g, unknown, or other
agtgctggagctccccgcggtggcggccgctctagaactagtggatcccccgggctgcaggaattcgtctcacccctagnaaacatctcctcccgatccatccgagcccaaaccctagtccagccagatctccgccgccgccggcgagagcacggcatcagatccgccgcgatggcgttcccccgcatcttatccacagcggtgcgccgccgctcggccatcgccgcggnagcggccgggaacgcccgcgaggccctcacggccgtcgccccggcgccccgggtgcttccccccggaggcgaccccgggtnccccctcccgtgatgccctaagatcgcatcgcccaaagcccttaatttttttctcccccccccctgggggggggggaggggggnttttttnnnnttttcaaacccccctttccttccaaaaaaaaaaaaatatnctttcttgggggggggggagaccccgggttcccaccctttccaaagggctggcgggtgggccaagggaaatttttcctcgtcccgggggactggtaacggggggggtggttgattcaaatcgggcttggtttttataagaaggagagaggggtcgcgttctcgcatgtttgtagggccgttcccntggaagagaccgcggaatcnccaccccgccacnnnnttgtcccgagatattgtagcn

SEQ ID NO: 70714 - DNA, 671 bp, Zea mays
  misc_feature: Ceres CLONE 1550924
  misc_feature: Encodes the peptide sequence at SEQ ID NO. 70715
aaagctggagctccccgcggtggcggccgctctagaactagtggatcccccgggctgcaggaattcgtctcacccctagaaaaaagtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcccctcccgaccacgtcgctctacgtgggcgacctggagggggccgtctcggactcgcagctgtacgaactcttcagccaggcggggcaggtggtgtcggtgcgcgtctgcagggatgtcacctcgcgccgctcgctcggatacgcctacgtcaactacagcaatcccttggatgctgcgagagcattggaagtgctgaactttgctgctcttaacaacaagcctatccgggtgatgtattcaaaccgtgatccaggagccgcaggagtggatctgctaacattttcataaaaaatcttgacaagaa

SEQ ID NO: 70715 - protein, 125 aa, Zea mays
  misc_feature: Ceres CLONE 1550924
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNNKPIRVMYSNRDPGAAGVDLLTFS

SEQ ID NO: 70716 - DNA, 828 bp, Zea mays
  misc_feature: Ceres CLONE 1550926
  misc_feature: Encodes the peptide sequence at SEQ ID NO. 70717
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (138)..(138): n is a, c, t, g, unknown, or other
  misc_feature (148)..(148): n is a, c, t, g, unknown, or other
  misc_feature (149)..(149): n is a, c, t, g, unknown, or other
  misc_feature (186)..(186): n is a, c, t, g, unknown, or other
  misc_feature (187)..(187): n is a, c, t, g, unknown, or other
  misc_feature (193)..(193): n is a, c, t, g, unknown, or other
  misc_feature (196)..(196): n is a, c, t, g, unknown, or other
  misc_feature (198)..(198): n is a, c, t, g, unknown, or other
  misc_feature (199)..(199): n is a, c, t, g, unknown, or other
  misc_feature (354)..(354): n is a, c, t, g, unknown, or other
  misc_feature (599)..(599): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (649)..(649): n is a, c, t, g, unknown, or other
  misc_feature (650)..(650): n is a, c, t, g, unknown, or other
  misc_feature (828)..(828): n is a, c, t, g, unknown, or other
tttttttttttnnnnnnngnnnnntaataaggtagatattggtgtnnnnnnnnnnnnnnnttccctgggactccccgcggtggcggccgctctagactagtggatcccccgggctgcaggaattcgtctcacccctangaaaaacccnntttctgtctttggctgtggggcaatctgccaccgctnntcctgnagntnntccttcgcttcctcgcctggggcgttcccacccccttgccaccatcgccccgcttccgggctcctcccccctcgcccgtccctgctctggtcgcggcgggacccgtcagatctggggccacgggttgccagccccaagccggcggggcggccggnaccggaggggctgccgggatgaaattcttcctttgatggagcccgggaaggaagcctgcgggggggtcaagcaaacggggttcatccattcggcggcccaggccttggtattcccctcctggggttcctccacccttctttccaaggggcccaatatctggggggccccccccccttttggggaaggggccctattttcccccccccccccccgcggcgtgtttggtgccccccccccccctccntgtaatttggagccccggagacctcgccccnnnnnnnnnnnnnnnnnacnncggggtctggtgggcgccccccccacggtagttgctgggttttagatgagaggagggtgagtattaaattacacgggaacctccgctttcggtctttcatatttcactccgcatcggccccattcttctgttacccctactccccctaatcctaaactatatgtgacgatggacattn

SEQ ID NO: 70717 - protein, 101 aa, Zea mays
  misc_feature: Ceres CLONE 1550926
  misc_feature (81)..(81): Xaa is any aa, unknown, or other
  misc_feature (82)..(82): Xaa is any aa, unknown, or other
  misc_feature (83)..(83): Xaa is any aa, unknown, or other
  misc_feature (84)..(84): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
MEPGKEACGGVKQTGFIHSAAQALVFPSWGSSTLLSKGPNIWGAPPPFGEGALFSPPPPRGVFGAPPPPPCNLEPRRPRPXXXXXXXRGLVGAPPTVVAGF

SEQ ID NO: 70718 - DNA, 663 bp, Zea mays
  misc_feature: Ceres CLONE 1550927
  misc_feature: Encodes the peptide sequence at SEQ ID NO. 70719
  misc_feature (427)..(427): n is a, c, t, g, unknown, or other
ctccccgcggtggcggccgctctagaactagtggatcccccgggctgcaggaattcgtctcacccctagaaaaacctctaccgcctccgcaccgcagagccgcagccaagcaagctgcgcccctggacttggcctcaccggtgaagcggagctcgaggataggcggtgctcgggagataccaagcggtcggccgcaggcgccacgtcggcggagatgacggacggtcaccacttcaacaacatcctcctcggagggcgcggcggcacaaaccctggtcagtttaaagtgcattctggtggacttgcatggaagagacaaggtggaggaaagaccattgagatcgacaaagctgatgtaccagcagttacttggatgaaagtcccccagagcatatcagcttggagtcaggattaaggctggccctgntctacagatttattggccttccgtgaacaggatgtaagcaactggaccaacttcatacaaaagaataggggtgtcacaccaaatgaaaaacagctttctttttagtgcccagaatggggggagggattggattgaatgggaaaccgcctaccctttttgggtgggtcaaaaacaacccttttagggggcccctcccagaggttgcccacaccccgatgggcggggaaaaaccctgg

SEQ ID NO: 70719 - protein, 66 aa, Zea mays
  misc_feature: Ceres CLONE 1550927
MTDGHHFNNILLGGRGGTNPGQFKVHSGGLAWKRQGGGKTIEIDKADVPAVTWMKVPQSISAWSQD

SEQ ID NO: 70720 - DNA, 675 bp, Zea mays
  misc_feature: Ceres CLONE 1550929
  misc_feature: Encodes the peptide sequence at SEQ ID NO. 70721
  misc_feature (335)..(335): n is a, c, t, g, unknown, or other
  misc_feature (394)..(394): n is a, c, t, g, unknown, or other
  misc_feature (415)..(415): n is a, c, t, g, unknown, or other
ctggagctccccgcggtggcggccgctctagaactagtggatcccccgggctgcaggaattcgtctcacccctagaaaaagcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggntggtggggctcagcccgctcagcgaagccctgtgggcggacagcaaggcgctcccggcngggggccggccccgccgcgcntcatcggcgacgtgtccgccaggctcacgtggaaagacctctgcgtcacccgtggctctgggcccccggcaagacgcaaaccgtgctggacgagctcaccgggtacgcgggaccccgggtcgctgaccgcgctcatgggggccctccgggtccggggaagtccaccctggtcaaagcccttggcggggcgccttgccggccaaggcttccttttcgggaacgtggttccttaagggccgaaagcccaactcttccttcgg

SEQ ID NO: 70721 - protein, 143 aa, Zea mays
  misc_feature: Ceres CLONE 1550929
  misc_feature (40)..(40): Xaa is any aa, unknown, or other
  misc_feature (60)..(60): Xaa is any aa, unknown, or other
  misc_feature (67)..(67): Xaa is any aa, unknown, or other
MRRVGGDLQGDGTTPRSAAAGQAMMELQANGSAAVGGAMXGGAQPAQRSPVGGQQGAPGXGPAPPRXIGDVSARLTWKDLCVTRGSGPPARRKPCWTSSPGTRDPGSLTALMGALRVRGSPPWSKPLAGRLAGQGFLFGNVVP

SEQ ID NO: 70722 - DNA, 820 bp, Zea mays
  misc_feature: Ceres CLONE 1550935-R
  misc_feature (428)..(428): n is a, c, t, g, unknown, or other
  misc_feature (512)..(512): n is a, c, t, g, unknown, or other
  misc_feature (525)..(525): n is a, c, t, g, unknown, or other
  misc_feature (580)..(580): n is a, c, t, g, unknown, or other
ttgggtactcgagcgtctcgtttttttttttttttttgacatgaatccatgctttcgaggcaaattgcattacagaattatttctatgttcacatatatttaaagtttatcagttacaccatatgtgcataacaacatgggccatttacaatgcctgctttagtttgaacaatatgtacatagtaatcgtagataacaaaaaagggattgatcttgggttgtagatgagatgctaaaaaaatccccatcttctagcagtgaaccaaaaagaatagtaaaataaaaattaagcagggaccgaaaatttctgcacctatggctttacatgagtcttctaatggttctcgcgagagcccgagataaaatacgattggttaaatccgctggcagaagaagcaactgctgttgggactccggtggaagctcangaatgacagaaagaactggaagaaaatctggcagaaaagtcattccatacagcgcaagagcaagttcatccgtgctaccacttnccttctctatggnactggtatattcaggaaattggagatggattttccttctgagaaaactttagatnaaagtaggaacaggcgatacagattccttaaagtttgtggcaatctcctcattctaggggaggcaatggggggatggccccccacccaatgggcaatcctgaaggctgcctgccaaacatttgcaaaaaccttaaggggggcctaccccaaggggaatttcatttcccccttaacaaatcccccggaaaaaaaaataaaatcccctttcccacaaagggcccccctgggtttaaacggac

SEQ ID NO: 70723 - DNA, 661 bp, Zea mays
  misc_feature: Ceres CLONE 1550936
  misc_feature: Encodes the peptide sequence at SEQ ID NO. 70724
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (397)..(397): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (430)..(430): n is a, c, t, g, unknown, or other
  misc_feature (433)..(433): n is a, c, t, g, unknown, or other
  misc_feature (434)..(434): n is a, c, t, g, unknown, or other
agctccccgcggtggcggccgctctagaactagtggatcccccgggctgcaggaattcgtctcacccctagaaaaaagtacggaggacgggaggagtgatctccacgcccgctcgctcgcgtcctgtcgccttgtcggcgtccgccactccgccccctccagccagatccctcctattcccccacttcactcccaatccgaatccagatccgcgaatgctggggcgggcggcggcactgtccgcgccacggtggcgcggcggggtgccagaccttcgcgccgcgctgcggtcggggggcaacctcctcttcgcgctcttcgtggcggccgtgctcgcattcacgctcctcgcggcgttccacagccccgacgatgnnngctctcaccccgtctctcnacagctcaccgatttcctcacnnntcgcacttncannctcaacttcctcactgacgactccgtgctgcgcacgggggagggactcaactcctcgtccaccggccccccgggcaagtccccgcctgggggtggcaaattcttcccgaaggccgtcccgttcataagcttctccaaatggggccccaggcccaaaaaaaggacccgaaaagggagggggcctcccccttaaaactgagggcccccgggcaagggcccctttttcaa

SEQ ID NO: 70724 - protein, 136 aa, Zea mays
  misc_feature: Ceres CLONE 1550936
  misc_feature (54)..(54): Xaa is any aa, unknown, or other
  misc_feature (55)..(55): Xaa is any aa, unknown, or other
  misc_feature (61)..(61): Xaa is any aa, unknown, or other
  misc_feature (69)..(69): Xaa is any aa, unknown, or other
  misc_feature (72)..(72): Xaa is any aa, unknown, or other
  misc_feature (73)..(73): Xaa is any aa, unknown, or other
MLGRAAALSAPRWRGGVPDLRAALRSGGNLLFALFVAAVLAFTLLAAFHSPDDXXSHPVSXQLTDFLTXRTXXLNFLTDDSVLRTGEGLNSSSTGPPGKSPPGGGKFFPKAVPFISFSKWGPRPKKRTRKGRGPPP

SEQ ID NO: 70725 - DNA, 786 bp, Zea mays
  misc_feature: Ceres CLONE 1550939
  misc_feature: Encodes the peptide sequence at SEQ ID NO. 70726
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (263)..(263): n is a, c, t, g, unknown, or other
  misc_feature (269)..(269): n is a, c, t, g, unknown, or other
  misc_feature (304)..(304): n is a, c, t, g, unknown, or other
  misc_feature (305)..(305): n is a, c, t, g, unknown, or other
  misc_feature (307)..(307): n is a, c, t, g, unknown, or other
  misc_feature (309)..(309): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaactgggactcaccgcggtggcggccgctctagaatagtggatcccccgggctgcaggaattcgtctcacccctagaaaaatttattaattaacaaagagaagacttctttccttcctcgtcgtctccagcccatttcaatttcnttgatncatcgcccccaccatcactactcccctaatccttnncnancgtctcgtcgtccagtccaccaccctcaacggccaatgggcaagcggttagcccgcacccaaccagatcaacaagggattccgtttcattccgggaaggggcagttttggaaccccccatgggggaggctaccccgtccaaagtcccggatgtggggttcaaaccccaaattgttaaaatccccgggagagcccacacccccccccccggggaattcccggcgcccccccaccctttttttttttctctttattaaacccaaatggccccccccccccccctttttttttccccggggttttatgagggggaaaattccccccccccccaaaaagaacaaacacacccccccccccccttttttttttcgggggggggggggccccccccgtgtggggtccccccccccccccccccccaaaaaaaaatttttcccgcgggggggttttgcccccccccccccccctccttataaaa

SEQ ID NO: 70726 - protein, 45 aa, Zea mays
  misc_feature: Ceres CLONE 1550939
MGEATPSKVPDVGFKPQIVKIPGRAHTPPPGEFPAPPHPFFFSLY

SEQ ID NO: 70727 - DNA, 643 bp, Zea mays
  misc_feature: Ceres CLONE 1550942
  misc_feature: Translation starting site: 177
  misc_feature: SWISSPROT Homolog: EC 1.1.1.40 Malate dehydrogenase (oxaloacetate-decarboxylating) (NADP(+))
  misc_feature (384)..(384): n is a, c, t, g, unknown, or other
  misc_feature (387)..(387): n is a, c, t, g, unknown, or other
  misc_feature (457)..(457): n is a, c, t, g, unknown, or other
  misc_feature (485)..(485): n is a, c, t, g, unknown, or other
  misc_feature (520)..(520): n is a, c, t, g, unknown, or other
  misc_feature (521)..(521): n is a, c, t, g, unknown, or other
  misc_feature (577)..(577): n is a, c, t, g, unknown, or other
  misc_feature (614)..(614): n is a, c, t, g, unknown, or other
  misc_feature (643)..(643): n is a, c, t, g, unknown, or other
ctccccgcggtggcggccgctctagaactagtggatcccccgggctgcaggaattcgtctcacccctagaaaaaactgccagctccggtccgaagagggagggaggaggacgccagttgccactgccgcgccgctcccgcctccctctctccatccgacgagctcgagaagccaccatgatctccgcgcgcaccgccgcagcttcccccgcttccctgtggaagcggggaggacgaagcgagggcggcggcagctgcgacggatgtcggacctacaggaacactttgcggagggccgcagcagcgaaggtgcgtgccttgccgtcgagggcggtggaggcggtcaaaatgggctccgccccgcgaagtggagcaggaggaagcngangtagccgcggccgcggacggcgtcgtcgtcgaggaccactacggcgaggacagcgccacccgagagctgnccatcatgccctgggccttctccgtcgncagcggttacaccctcttgagggatcacatcacanncagggtcttggcttcacggagaaggagagggatgcacacccacttgcgtgggctgnctcctcctgcaagtggtcctcaagaactccaattaangaagatcatgcacaacctggcgcagtacn

SEQ ID NO: 70728 - DNA, 648 bp, Zea mays
  misc_feature: Ceres CLONE 1550944
  misc_feature: Translation starting site: 110
  misc_feature (412)..(412): n is a, c, t, g, unknown, or other
tggagctccccgcggtggcggccgctctagaactagtggatcccccgggctgcaggaattcgtctcacccctagaaaaaattcccatcccgagacaggagagggcaaggatgctgctcctgagctcccccttcgtgtccgtgtcgccgccgccgccgccgctcagctcccatggcgctcgcccggcgctgcggatcgaggcggccaggcagctgacggggcgggtggtgacgaccaaggcggacaaacgtcgggtggggaagagggggtccccctggctccacaccccaagtacaagcgccgggagcgcatcaagaagaagtaccaggcgcacgaccccgacaaccagttcaaggtcggcgacgtcgtcgagctccaaccctcccgtcccatctccaaggacaagcactttnctcgccatcccgctcccgcccccgggacactcgccggcaagtcttagctccctaccgcccgctccagtccgaagaacgaacagggaaccgtccctccccgagagggattggatgggaattgattgctgccctgtccattggcttccttcgtaaagctcttctcccatcaaaggggctggtttccaatttcaaaatgccaaaacccgggggggtttttgacaaaatatttccctttt

SEQ ID NO: 70729 - DNA, 663 bp, Zea mays
  misc_feature: Ceres CLONE 1550945
  misc_feature: Encodes the peptide sequence at SEQ ID NO. 70730
  misc_feature (162)..(162): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
ctccccgcggtggcggccgctctagaactagtggatcccccgggctgcaggaattcgtctcacccctagaaaaaatcgtctccagtgtcctgctcctgtccacaagccgcggcgcctgaacgcgtcactgcttacctaacccgacccgaccagaaaccaccngcgcactgggacgccgcccggctccgtctccggctccggctcccgctcccgctcgaggtcgaggcccacgcagcaatctggtcttctggaaatctccatcaatccgattccgaacggcagaaaattttcccttcccccggccaccaaccaaccaaacccgagcaaccagcctgagccacctcccatgcgccgcgccgcagccctgagaggaaggaagagacncnngtgtctgggagagggatggagggcccgtcctcgctgccgcccttcctgaggcagacgtacgagatggtggacgaccgggccacgacgccgtgggtggcgtggacgccgctggggacagcttcgtcgtcgccaaccaggccgagtttggcagggatctgcctccccaggtacttcaggccaacaaacttctccaggcttcgtgggggaactgaacccctacggcttttaaaaaattgatcctgaaacaatggggatttgcaaaagatgattttcatt

SEQ ID NO: 70730 - protein, 73 aa, Zea mays
  misc_feature: Ceres CLONE 1550945
MEGPSSLPPFLRQTYEMVDDRATTPWVAWTPLGTASSSPTRPSLAGICLPRYFRPTNFSRLRGGTEPLRLLKN

SEQ ID NO: 70731 - DNA, 682 bp, Zea mays
  misc_feature: Ceres CLONE 1550947
  misc_feature: Encodes the peptide sequence at SEQ ID NO. 70732
ctccccgcggtggcggccgctctagaactagtggatcccccgggctgcaggaattcgtctcacccctagaaaaagaggatatacccattgtttcatccgtttcctttgcccgaacgtgcgctgtctctcgatcctgcatctctgcacctgctcgcctccccagggaggcagggacaatcgacttcggcgggcgccggctagccccaccggcgacgacaggcacagtggaccacggaggagaaagtactctgctttgaatgggaagtgccatgaacaaagacaaagttcatgacaaggagactcacggaacaagtagtgatataactgagaaaacacctgtggaaacggtgaagggtcccaatctgcttgagcgagcaaaggaagagatcgaggcccttgccggaactgttcatactaagatggagcacctttcacgtcccacgcgaaagaggatgattcccttaggaaaacaaggaggggaacctgcccaaaataaaagcccccccggataaactcccggaaacagggggttaacttaatggaaaaccccccctttgacaaattcaaagggcccaaaaggtttttaaccggccaagagaaaaaatttaaaccttttgggaaaaccttccccccccaaaaaaagggttccccccacctttgtggaaaacccgaacacccccgg

SEQ ID NO: 70732 - protein, 80 aa, Zea mays
  misc_feature: Ceres CLONE 1550947
MNKDKVHDKETHGTSSDITEKTPVETVKGPNLLERAKEEIEALAGTVHTKMEHLSRPTRKRMIPLGKQGGEPAQNKSPPG

SEQ ID NO: 70733 - DNA, 678 bp, Zea mays
  misc_feature: Ceres CLONE 1550948
  misc_feature (225)..(225): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (248)..(248): n is a, c, t, g, unknown, or other
  misc_feature (255)..(255): n is a, c, t, g, unknown, or other
  misc_feature (256)..(256): n is a, c, t, g, unknown, or other
  misc_feature (419)..(419): n is a, c, t, g, unknown, or other
  misc_feature (480)..(480): n is a, c, t, g, unknown, or other
  misc_feature (486)..(486): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (534)..(534): n is a, c, t, g, unknown, or other
  misc_feature (537)..(537): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (562)..(562): n is a, c, t, g, unknown, or other
  misc_feature (563)..(563): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (618)..(618): n is a, c, t, g, unknown, or other
  misc_feature (622)..(622): n is a, c, t, g, unknown, or other
  misc_feature (624)..(624): n is a, c, t, g, unknown, or other
ctccccgcggtggcggccgctctagaactagtggatcccccgggctgcaggaattcgtctcacccctagaaaaagtccgcttctcccctctcctcctcacgtcacgcaccccatctcttctctccccctctcgtctcgtccagtcgtccccctctcccccactctacccagctgccctgctctgcgtcgctcgccatggcgtcctccacggggaaagcttggagncacgggnnnnnnggggttcacgnttcacgnnccgccgcccttcatcacctccttcaccgagctgctctccggcgcaagggaacatgcttagaacggggcccaaaaaggaaagggggttctccccaaaggggggggttttttccccccgggggccccaagggggggggggcccccattgagaaaggggggggggntccccccacgggggatattttggccccgcccaggggggggcccccccctcactataaaaanaacccncccccccccccnnnnnnntgagccccagagagcccnnnnnnnaagagnagnagaaacccccctctttttnnnnncnntgtcnnnaaaaaaaaggggggggggggcccccccccaggggggggggccccgccncggngntaatatttttttttataaaaaaagaacccccgctccccctaggttgtttttttt

SEQ ID NO: 70734 - DNA, 669 bp, Zea mays
  misc_feature: Ceres CLONE 1550950
  misc_feature: Encodes the peptide sequence at SEQ ID NO. 70735
ctggagctccccgcggtggcggccgctctagaactagtggatcccccgggctgcaggaattcgtctcacccctagaaaaaaaaaaatctctctcccctctcctcgcctccagctcctgctcggcccgctcgcgtccagctgcgcgcgcgcctgcggtggccgtgaaggacagcccgagggacgcgccgggtgcactgatctgggggccgcgtgtccccggtggtggggcgaggcggcgccggcttccaggaatgggcagcttgtagtggctgtttcttttgcatatgcactttctattgttgttgtcatttcaaaggaggccatagtctcctggattttgtatgccttgttatctggaattggtgaccatagatgtcatttcgtagcatagtccgtgatgttagggacggtttcggcagcttgtcgaggagaagctttgaggtgaccctcgcaagcatttatggccttactgggcatcacaaagggaagaccagagctcatcacatgtgctcaacgactcactttccataattcgtgaaagtcgatgggcgaatctgcctctggacccatccgggatatcttacggaaactggagcttgataaaacccctgggcaccgggaaaccccttcttttgcttccaactttttgtggaattgaaaaaaattgta

SEQ ID NO: 70735 - protein, 52 aa, Zea mays
  misc_feature: Ceres CLONE 1550950
MSFRSIVRDVRDGFGSLSRRSFEVTLASIYGLTGHHKGKTRAHHMCSTTHFP

SEQ ID NO: 70736 - DNA, 918 bp, Zea mays
  misc_feature: Ceres CLONE 1550951-R
  misc_feature: Pfam Name: DUF1630 Pfam Description: Protein of unknown function (DUF1630)
acgattgggtacctcgagcgtctcgttatacttttttttgcgccagaagggatccactttgtctatagcgggcgaaaaataggggcaacggcaatttttcttagggggcgggaacaaactttacggggggccaatgcctttggcccccagggccttctcttgactaccttgaaaaaaaacacctcttttagggttggaaagcaggatttgctccaagcccttcggcagaacattgaatgctgcttggaggcctcccttcaatttttggcatgccccttttgaatcagcacttccttttccagggttccccatctctctgaaaaaataacccccaacaccatcaaaaaaatcaatcccctctatttcgaacatttttgacattagcttttcaatgtcaacattcatgcgagcctgcccccaaagcctctgctgttcttgctccccagcaccacccctttgccggaaccaaggcataaaattggggccttcaaaaaatcccctttttaggcccaaccaattggacctgatccttttggacaaaaacttccctggacccctagctgccaaacctttgataaactcttctgcttgaaacgggggtaccaatggggggccaacaaaaggagaagccccttctgaaggggttgtagttcccaaatacggcccaaaagcccaaggaaattggccgtccactccaaaaagtgccccccccaatttcccattggtgaactaccgaaaggggactcccccaatcttgggggaccccccagccgcaatgagccctttttaaaaaaaaatttccgggcttttgtgggtgggcaaaaacgcgcccacaaaagctttctttggcgcctcgccaaaaaaaaagaaaaacctccccttccccattttgagggattccaaagggctcatgtggga

SEQ ID NO: 70737 - DNA, 702 bp, Zea mays
  misc_feature: Ceres CLONE 1550952
  misc_feature: Encodes the peptide sequence at SEQ ID NO. 70738
  misc_feature (422)..(422): n is a, c, t, g, unknown, or other
ggagctccccgcggtggcggccgctctagaactagtggatcccccgggctgcaggaattcgtctcacccctagaaaaaacccggtcttactacctttctcctcgtctctctcacggggtgacatctagtttccaggatgacaaattctgagatcagattccattcgtgagcctgtagaacatagatgctcctctaatccatactaatttgaacccaatcagacacatattcgcgcgcaatacttcctcttcgtgaagtaccgcaatcctcaccacgactcctagtccttcggcacatgcgccatggtgtctctattcagtgaattcctgggcctggccgtgtccctgcactcccggagggcgttcgatcgattacaggacattcctgccgagcgacgtcttgatccagctgcaacaccttcncctttctttaagtttactgtacaggatttaaagaaactcttcccaaccgattttttcccttcgtggggttcattcccaccaaaccggaagcttaaaggtggtaatttaagaggtgacaaaaaatctggccctttttgtccaaggagggccgccttcaaaaggggaccaaaaacttctggggggaacctatttttttgaaccactccaagagggggtctttccgggggcccccccttctttttttttaaaaaatgtaccaccttgtgcacctgtgtccccc

SEQ ID NO: 70738 - protein, 105 aa, Zea mays
  misc_feature: Ceres CLONE 1550952
MVSLFSEFLGLAVSLHSRRAFDRLQDIPAERRLDPAATPSPFFKFTVQDLKKLFPTDFFPSWGSFPPNRKLKGGNLRGDKKSGPFCPRRAAFKRGPKTSGGNLFF

SEQ ID NO: 70739 - DNA, 672 bp, Zea mays
  misc_feature: Ceres CLONE 1550953
  misc_feature: Pfam Name: Glyco_hydro_81 Pfam Description: Glycosyl hydrolase family 81
ccgcggtggcggccgctctagaactagtggatcccccgggctgcaggaattcgtctcacccctagaaaaaaggcggcgagatgcggaagtggacgaggaagctgggccacaccctctcccgcatcgtcacgtccaagccgcgcttcgccttctcccagcccaggcctaggcccaggcccaggcccgcacaacccggtctgccttcctcacaacccgtctcgatcccgccgcagccgccggagcttccccccttcgtccccaccgccatgccgcaccacggcagccaccgcccgccggcgccgccgccgggtggccccgtgttcccgcgcgcaacgtccacggtggttcccgacccgtcccgcttcttcgcgccgccgctcctcgccgcgccgctccccaccaactccttcttccagaacttcgtgctcaagaacggggaccagccggagatacgtccacccgtactccgtccgctcccccggaggcgccgcactcgacatctgctacccttcgcggaaccactcgccgtccttcgtcatccagaccttcgtccccgacctcaccgtctccgacgccgccgggagcgcgcagcgccactgcgtctcggctttcaacaacctctccgtcacgctcgaagtctccccgtccctccgcgcacaccttgtccgcgga

SEQ ID NO: 70740 - DNA, 720 bp, Zea mays
  misc_feature: Ceres CLONE 1550958
  misc_feature: Encodes the peptide sequence at SEQ ID NO. 70741
  misc_feature (391)..(391): n is a, c, t, g, unknown, or other
  misc_feature (610)..(610): n is a, c, t, g, unknown, or other
aagctggagctccccgcggtggcggccgctctagaactagtggatcccccgggctgcaggaattcgtctcaccccttactaggattgcagccgttgtgtgctgtcagggagctgcaatgctatcaggctccgtggtatgtgaaggcagtgaacaaggtgttgatatgcttttaccaatgtcttcacctggtgccagttcatgcaattcaaacttgaagagcaatgccgtcaaatatccatcaagcgtggatgttctaactgttcttctgctggctttacatcccaacacgtggttgggcatcaaagacgagaagctcaaagctgaatttcagactcttatttcaacagacagtctacctgatgatctgaaacgagagatattgcacctaangcggcaactctactatctaaaggccctgtaagaagaggaatgcgaagatgccgagcaaccatcgcctaagcagcagtgctgaagtggcagtgtgcccatgtcgttaattttacttgtaagaaattgatgtgaaggggaaaagttaccagagggtatagactatgaaatggccagaattatgatgaatagaatggagggatgattacctggttgtcaagntctgggggttggtcccttccaccaaaggcttttaaacccctcttgccaaaggaagggctaaggtcccttttcccaaagaaaaaaaaacccaccaccccttgctttgggca

SEQ ID NO: 70741 - protein, 139 aa, Zea mays
  misc_feature: Ceres CLONE 1550958
  misc_feature: SWISSPROT Homolog: EC 2.3.2.15 Glutathione gamma-glutamylcysteinyltransferase
  misc_feature (130)..(130): Xaa is any aa, unknown, or other
AGAPRGGGRSRTSGSPGLQEFVSPLTRIAAVVCCQGAAMLSGSVVCEGSEQGVDMLLPMSSPGASSCNSNLKSNAVKYPSSVDVLTVLLLALHPNTWLGIKDEKLKAEFQTLISTDSLPDDLKREILHLXRQLYYLKAL

SEQ ID NO: 70742 - DNA, 649 bp, Zea mays
  misc_feature: Ceres CLONE 1550963
  misc_feature (352)..(352): n is a, c, t, g, unknown, or other
  misc_feature (353)..(353): n is a, c, t, g, unknown, or other
  misc_feature (550)..(550): n is a, c, t, g, unknown, or other
  misc_feature (551)..(551): n is a, c, t, g, unknown, or other
  misc_feature (553)..(553): n is a, c, t, g, unknown, or other
ctccccgcggtggcggccgctctagaactagtggatcccccgggctgcaggaattcgtctcacccctagaaaaactccatgcctgcagtccagagtccagactccaggactaccagtctaccaccacttcgtctcgtcctcacacctcactccaccacctctgccttgcaaagccttccacaccgatccgccgcctcgtccgcgcgctcgcaggcagcagtgtggactacccgccccatactccatcccctactcgaaggatacaccgtgagtaggcgtgatggtgcttgataccccgttttcgtgcagcttgttgctaattcgttttagtttgagggatcaagaaccaccnnttgtcttcctttctttccttttttgactacgatgaatcattgcaaatctcttgaatacatttttcactattaaaatactgcctggccttttaagctcctttggtccacgtggaatggtttcttttgtcctcccaatttttggcaggaccccccaattaaaatttggggcaaagaaaaaaggtggtttccattttccnnangagggggaattcctttcccgggggacccccccaggtcaaatttgaacccccccctttggggttttctgggggggggggttttccccggccctcccc

SEQ ID NO: 70743 - DNA, 659 bp, Zea mays
  misc_feature: Ceres CLONE 1550969
  misc_feature: Encodes the peptide sequence at SEQ ID NO. 70744
  misc_feature (372)..(372): n is a, c, t, g, unknown, or other
  misc_feature (427)..(427): n is a, c, t, g, unknown, or other
ctccccgcggtggcggccgctctagaactagtggatcccccgggctgcaggaattcgtctcacccctagaaaaattttgtttttcttctcccgtccgcagtccgcttggcgtgcgcgacggctagggcgaccgccgccgccctacgccctacgtccagctgcccatgtcttcttcgggccccttgccggcgggaactcaccagaccaggaatcgtgctggcaaccggcgcaagtctggagatagggctgataaagctaattactcctacaataatgatggagagaagagcaatgttccttcattaaagaaccttcctcccattgttcatcatgaaacattcttcagcaatgttcagaatgactacaatcaancaggattagtgcctttggagggatggtctgccagtgaggcttcacagctcctcantgatcgctggactgctgcaaatcacatgtacaatgacaaaacatttgacccctcaaagaaccgggaatgtattcctgatctagaacctcctcctgggggccccctaaagcttcctcatcaaataaacttcccccaggaatttccccccgggattggaccctcataccaaattttgcgccccccggtcctcccccggaaactaatccaagccggcctctggctcattatggcg

SEQ ID NO: 70744 - protein, 165 aa, Zea mays
  misc_feature: Ceres CLONE 1550969
  misc_feature (70)..(70): Xaa is any aa, unknown, or other
  misc_feature (88)..(88): Xaa is any aa, unknown, or other
MSSSGPLPAGTHQTRNRAGNRRKSGDRADKANYSYNNDGEKSNVPSLKNLPPIVHHETFFSNVQNDYNQXGLVPLEGWSASEASQLLXDRWTAANHMYNDKTFDPSKNRECIPDLEPPPGGPLKLPHQINFPQEFPPGIGPSYQILRPPVLPRKLIQAGLWLIMA

SEQ ID NO: 70745 - DNA, 662 bp, Zea mays
  misc_feature: Ceres CLONE 1550976
  misc_feature: Encodes the peptide sequence at SEQ ID NO. 70746
  misc_feature (69)..(69): n is a, c, t, g, unknown, or other
  misc_feature (390)..(390): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (632)..(632): n is a, c, t, g, unknown, or other
  misc_feature (633)..(633): n is a, c, t, g, unknown, or other
  misc_feature (636)..(636): n is a, c, t, g, unknown, or other
tccccgcggtggcggccgctctagaactagtggatcccccgggctgcaggaattcgtctcacccctagnaaaagtcgagagagtcgtccccccgcgtgctctccgcctgcggcctctgtatcccgcaaccaaaaactaccccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcatccccctccccaccacgtcggggggggtgggggacctgnagggggccttctcggactcnnnnctgtacgaactcttcacccaggcgggggcggtggggtcggtgcccctcctgccgggatgtcaccctcgcgcccctccgctggaaaccgcctacgtcaagtaacggcgaccccttggaaggcggcccgcgcatttggaaatggctaacctttgccgccctttaaccagccggccttcccgggggaaagtttttcacaacgggggtcccgacgcggccccnnggnggcggattttccttaaaatttttggg

SEQ ID NO: 70746 - protein, 73 aa, Zea mays
  misc_feature: Ceres CLONE 1550976
  misc_feature (33)..(33): Xaa is any aa, unknown, or other
  misc_feature (40)..(40): Xaa is any aa, unknown, or other
MGARALSPRWCRRELSAWLIPLPTTSGGVGDLXGAFSDSXLYELFTQAGAVGSVPLLPGCHPRAPPLETAYVK

SEQ ID NO: 70747 - DNA, 688 bp, Zea mays
  misc_feature: Ceres CLONE 1550981
  misc_feature (623)..(623): n is a, c, t, g, unknown, or other
  misc_feature (688)..(688): n is a, c, t, g, unknown, or other
ctggagctccccgcggtggcggccgctctagaactagtggatcccccgggctgcaggaattcgtctcacccctagaaaaaaccccctcgccggctgcccggtctctccactccacaccccacatgccacacagccaacttggctggagaaagaggtgtagagagactcgtctctagctctctgctcctctcgagtctcggctagagcgagagcggccaacgcaggcagcggtccagggctggaggcagccacagccaagccgaaggcaacgagtggagaccggacaccggagccgcggagcgggagaccatccttgacttgtttttttcgccccttggatgtgacgactgagacgcgcgcggccgcgcctctccccactccgctgaccggacctgcgtgccccgcgaccgcaccagcgcggagctgcgtatcccgccagcggtgagccggtggaaggaccccgcccgccctgctattctctgctccaaatccaaaccagccttttccccctccgtgcgcccacagcaaagccggaggaggagacgagagtgaagaagaagaagaaaccactaggcgcggcaaggatttgctccgagagagtgatgtgcttaaggattcacgancatggcttcattggtgcccggtgtcctcgtgaagctccttcagcatatgaacacggatgtaaaan

SEQ ID NO: 70748 - DNA, 708 bp, Zea mays
  misc_feature: Ceres CLONE 1550982
  misc_feature: Encodes the peptide sequence at SEQ ID NO. 70749
ggagctccccgcggtggcggccgctctagaactagtggatcccccgggctgcaggaattcgtctcacccctagaaaaagatcgcttccaccatcgcacccacccggagcgcctcctcttctccagcgtccgatccccattccccacctctcctccctccgccgccagctcccgcccccttctctcccctcctcgcctccccgcgcgcgcgtttttataagggtttcggcggaggcgcccggtcgctggcgatggccgacgacggcgggagccacgagggcagcggcggcggcggaggcgtccgggagcaggaccggttcctgcccatcgccaacatcagccggatcatgaagaaggccgtcccggccaacggcaagatcgccaaggacgctaaggagaccctgcaggagtgcgtctccgagttcatatcattcgtgaccagcgaggccagcgacaaatgccagaaggagaaacgaaagacaatcaacggggacgatttgctctgggcgatggccactttaggattcgaggagtacgtcgagcctctcaagatttacctacaaaagtacaaagagatggagggtgatagcaagctgtctacaaaggctggcgagggctctgtaaagaaggatgcaattagtccccatggtggcaccagtagctcaagtaatcagttggttcagcatggagtctacaacaagggatgggg

SEQ ID NO: 70749 - protein, 152 aa, Zea mays
  misc_feature: Ceres CLONE 1550982
  misc_feature (22)..(87): Pfam Name: CBFD_NFYB_HMF Pfam Description: Histone-like transcription factor (CBF/NF-Y) and archaeal histone
  misc_feature: SWISSPROT Homolog: EC 2.7.7.7 DNA-directed DNA polymerase
  misc_feature: The sequence is a functional homolog of SEQ ID NO 1167 in the 10/412,699 US patent application
  misc_feature: The sequence is a functional homolog of SEQ ID NO 783 in the 10/374,780 US patent application
  misc_feature: The sequence is a functional homolog of SEQ ID NO 810 in the 10/666,642 US patent application
MADDGGSHEGSGGGGGVREQDRFLPIANISRIMKKAVPANGKIAKDAKETLQECVSEFISFVTSEASDKCQKEKRKTINGDDLLWAMATLGFEEYVEPLKIYLQKYKEMEGDSKLSTKAGEGSVKKDAISPHGGTSSSSNQLVQHGVYNKGW

SEQ ID NO: 70750 - DNA, 670 bp, Zea mays
  misc_feature: Ceres CLONE 1550984
  misc_feature: Translation starting site: 448
tggagctccccgcggtggcggccgctctagaactagtggatcccccgggctgcaggaattcgtctcacccctagaaaaatgtgctggatatcctagctcgatcttggcaaacccgcccgtctgttctcgtcgtggcggccgccctgtcgccgtgtccccaatccggctccgacaatcccacgcccagcagtccagctccagcaccatcagcgccgccctgcccctgtccctaatcccacgcggccacacccaggacccagcggcctgcgggctgcggcagtgcggctagcacaccacccgtccagccgtccagccgatctaggtctctatgtgtcctttgagtcttctctccatataaattcatcataaaagctcaagacgtagatcggctttttcccccttgttcggcaaaggcgtttcggggtgttcatcgtggattgatcgatcatggcggagggggagacaatcggcggaggaaaagaggaggcggacggggccaccagaggcgcaggagttggaagagaccaagaggagggcgacggggccaccaaaggggcaggaattggaagaaacccctggactctctcaggaacaaaatttcgggccccagggcttggccctggccacccattccggggaggagcagccacgggcccttgttgccgggagg

SEQ ID NO: 70751 - DNA, 669 bp, Zea mays
  misc_feature: Ceres CLONE 1550987
  misc_feature: Translation starting site: 143
  misc_feature (450)..(450): n is a, c, t, g, unknown, or other
  misc_feature (463)..(463): n is a, c, t, g, unknown, or other
ggagctccccgcggtggcggccgctctagaactagtggatcccccgggctgcaggaattcgtctcacccctagaaaaaacagcatctcaagtcttcacactcctcgccatcacataaaaccagtgcaagcagaagcagcgcaatggcgagcagcaccatggccctctcctccacagccttcgccggcaaggcagtgaacgtgccgtcgtctctcttcggcgaggcccgcgtgacgatgcgcaagacggcggcgaaggcaaagccggcggcgagctccggcagcccgtggtacggccccgaccgcgtgctctacctgggcccgctgtccggcgcgcccccgagctacctgacgggcgagttcccgggcgactacggctgggacaccgcggggctgtcggcggacccggagacgttcgccaagaaccgggagctggaggtcatccactcccngctggccatgctnggcgcgttgggctgcgtgttccccgagctgctcgcccgcacggcgtcaagttcgcgaagccgtgtggtcaaggccggtcccagaatctcagcgagggtgggctggactacctcggcaacccgaagctgatccacgcccagagcatcctccccatttgggcctgccaggcctggccccatggcgccatcgagggggtccccgtcccc

SEQ ID NO: 70752 - DNA, 706 bp, Zea mays
  misc_feature: Ceres CLONE 1550989
  misc_feature: Encodes the peptide sequence at SEQ ID NO. 70753
  misc_feature (327)..(327): n is a, c, t, g, unknown, or other
  misc_feature (396)..(396): n is a, c, t, g, unknown, or other
aaagctggagctcaccgcggtggcggccgctcctagaactagtggatcccccgggctgcaggaattcctctcacccctagaaaaaagatggctgctaccagcctcagctcctcgttgcccagggccactgcaaaactaacaggagtgccaagatcttcgtcgtactacacccagctgatcttttgctcgaggcatcctttccagaaagcggcggcagctgcagctttccagaagctcccacccgagctcctccggctaagctacccggcgaagaataataagcatgcaagaaccagctggcggcgggccaccggacacgaccaagcnggcgccgccgcggcgccaggaactaccagcaccccttcctttcccaggctctcccgtttcgagcgcccnaaagatccccggggaaaccccgggaaagggccagccccaaaaacccgtctccaaaacccaaaggaaggcgcccccccaaaacgggggcccccttaaagccccggaaaccgtcttccggcgggcccccttcttttggaaaataccccaaaaccttcccgcaaaaggggttttctccccaaaaccggccaaaaccggaattccgggaaccggttttcttgaaaccccctttgcccaagggggaaaacccaaaaaaggcccggggcccgggggcccggcccccttttgttcccccccccaccccaaaggcccc

SEQ ID NO: 70753 - protein, 134 aa, Zea mays
  misc_feature: Ceres CLONE 1550989
MAATSLSSSLPRATAKLTGVPRSSSYYTQLIFCSRHPFQKAAAAAAFQKLPPELLRLSYPAKNNKHARTSWRRATGHDQAGAAAAPGTTSTPSFPRLSRFERPKDPRGNPGKGPAPKTRLQNPKEGAPPKRGPP

SEQ ID NO: 70754 - DNA, 715 bp, Zea mays
  misc_feature: Ceres CLONE 1550991
  misc_feature: Encodes the peptide sequence at SEQ ID NO. 70755
  misc_feature (290)..(290): n is a, c, t, g, unknown, or other
  misc_feature (291)..(291): n is a, c, t, g, unknown, or other
  misc_feature (307)..(307): n is a, c, t, g, unknown, or other
aaagctggagctccccgcggtggcggccgctctagaactagtggatcccccgggctgcaggaattcgtctcacccctagaaaacagcagcggcgtgttaacttatccactccctcggcactgcagctcagtgcccttcccagcctctcgctctcccgccgaacgcgcacgtcctccgcgccgagcccagaggcagaacagaggacgcggccatggcgtccatcccgtgcaccttccagctgagcacggcggcgtcgaggagggtgtcgccgcgggtggcggcgcaggaannagagcccagggagganggcgagcggcgctgatgacgccgctgctggacgcgctcaggcggggcctgagatggctgcagccgtcacggttgagccgcgtgctgcccgcaagcgagaacggccgggcggctcccacctgctggttcaggttcggcaacaaggacgccgagggtgccggcatctacggcagccagtccagggacgacttcgaccgcgacgacgtcgtagcagtacttcgactacatggagatgctaggcggcggacggcacctacaactagatggaggctctgctgaacaggacatccaccccgtggacatcctcctcatgctggcagcctccgagggcgaccgcccccagatcgatgagctgctccgcgccggcgccaggttcgacatctatgacgacgatcgtctgactgcgctc

SEQ ID NO: 70755 - protein, 87 aa, Zea mays
  misc_feature: Ceres CLONE 1550991
MTPLLDALRRGLRWLQPSRLSRVLPASENGRAAPTCWFRFGNKDAEGAGIYGSQSRDDFDRDDVVAVLRLHGDARRRTAPTTRWRLC

SEQ ID NO: 70756 - DNA, 712 bp, Zea mays
  misc_feature: Ceres CLONE 1550994
  misc_feature: Translation starting site: 166
  misc_feature (626)..(626): n is a, c, t, g, unknown, or other
  misc_feature (627)..(627): n is a, c, t, g, unknown, or other
  misc_feature (668)..(668): n is a, c, t, g, unknown, or other
  misc_feature (701)..(701): n is a, c, t, g, unknown, or other
  misc_feature (711)..(711): n is a, c, t, g, unknown, or other
ggagctccccgcggtggcggccgctctagaactagtggatcccccgggctgcaggaattcgtctcacccctagaaaaagtttcgaattctagggttttgctgctctccgaccccgagctccgaaggccgcagcatcaggcgaggcccccctcgcgtgtgaccgagatggcgctgccgaatcaggggaccgttgattaccccagcttcaatctcgtcatcgtcggcgatggtggaactggtaaaactacatttgtgaagaggcatctcactggagagtttgagaagaaatatgaaccaaccattggtgtggaagttcatccgttggatttcaccactaactgtggtaagatcaggttctactgctgggataccgcagggcaagagaagtttggtggcctcagggatggatactatatccatggccagtgtgcgatcatcatgtttgatgtaaacctcaggcttacttacaagaatgttcctacgtggcatagggatctgtgcagggtctgtgaaacatccccattgtcctctgcggtataaggttgatgtgaagaacaggcaggtcaaagccaagcaggttacttttcacagaaagaagaatctgcagtactatgaaatttctgccnnagagcaactacactttgagaaacctttcctgtaccttgcangaagctggctggtgatccgacctttcactttgntgaagctgtng

SEQ ID NO: 70757 - DNA, 655 bp, Zea mays
  misc_feature: Ceres CLONE 1550996
  misc_feature: Encodes the peptide sequence at SEQ ID NO. 70758
  misc_feature (537)..(537): n is a, c, t, g, unknown, or other
  misc_feature (545)..(545): n is a, c, t, g, unknown, or other
  misc_feature (548)..(548): n is a, c, t, g, unknown, or other
  misc_feature (549)..(549): n is a, c, t, g, unknown, or other
gcggtggcggccgctctagaactagtggatcccccgggctgcaggaattcgtctcacccctagaaaaagccccagccgcttccgccctctcccttccgtttccttcacagctcccaatttccaaccctggatccaaatcccaagctatcccggaaccgatacggaggggcgcaagcaattattggctagcccggcctgtagctccgagatcatgaagcgcgagtaccaaaacgccggcgggagcgacggctacatgggctcctccaaggacaagtcgatggcggcagcggcggccggggcaggggagcaggaggaggaagtggacgagctgctggcggcgctcgggtacaaggtgcgttcgtcggatatggcggacgtcgcgcagaagctagagcagctcgagatggccatggggatgggcggcgcctgccccaccgctgatgacgggttcgtctcgcacctcgccacggacaccgtgcactacaatccctccgacctgtcgtcctgggtcgagagcatgctgtccaagtgaaaaangcccccgncgnncgttcccgcccggggaagccggcaccaagggtcgggttccacctcgtccaaccgtcacaaatggggcccccccccggtgcccgggtaatttcaacctccccgcccg

SEQ ID NO: 70758 - protein, 106 aa, Zea mays
  misc_feature: Ceres CLONE 1550996
MKREYQNAGGSDGYMGSSKDKSMAAAAAGAGEQEEEVDELLAALGYKVRSSDMADVAQKLEQLEMAMGMGGACPTADDGFVSHLATDTVHYNPSDLSSWVESMLSK

SEQ ID NO: 70759 - DNA, 721 bp, Zea mays
  misc_feature: Ceres CLONE 1551000
  misc_feature: Encodes the peptide sequence at SEQ ID NO. 70760
  misc_feature (590)..(590): n is a, c, t, g, unknown, or other
  misc_feature (664)..(664): n is a, c, t, g, unknown, or other
aaagctggagctcaccgcggtggcggccgctctagaactagtggatcccccgggctgcaggaattcgtctcacccctagaaaaattgcctaatcaaccgctactcacgccgtactgtctgatcggcaacacctcgtgtacacgtaggcccggagatatggcggcatcgccggtggccatcggcacggcggtgttccagcgggggccactccgcgtggaggcgaggcacgtcgactacagccaggtccccatcgtgcccaagccgctcatggtggtcgcccccaccgacgccggcgtctaccccgtggccgacttcctgcacggctgctacacggtcaacatctggtatgagagcctcctgtcgcacgtctcgtcccacgggttcatcgccgtgacgccccaactctactgcgtgacgctcaacatgaacgacttgaaggacatcgacgccaccaagcaggtcaccgcctggctcgccgacgagcagcaaggcctggcgcacgtgctcgccaacatcctccagctccacggagtgaggccggacctctccaggctggcgctggccggccacagccgctgcggctacacggnccttcgccgtgacactcgggctcggagccgccgcctcggacgactacgacgactacgcatacgcacgttcatcngccggcgaggttgccacatcaagttgtccgacgctgatcaggcgtgtacctcgtggc

SEQ ID NO: 70760 - protein, 188 aa, Zea mays
  misc_feature: Ceres CLONE 1551000
  misc_feature (4)..(185): Pfam Name: Chlorophyllase Pfam Description: Chlorophyllase
  misc_feature: SWISSPROT Homolog: EC 3.1.1.14 Chlorophyllase
  misc_feature (145)..(145): Xaa is any aa, unknown, or other
  misc_feature (170)..(170): Xaa is any aa, unknown, or other
MAASPVAIGTAVFQRGPLRVEARHVDYSQVPIVPKPLMVVAPTDAGVYPVADFLHGCYTVNIWYESLLSHVSSHGFIAVTPQLYCVTLNMNDLKDIDATKQVTAWLADEQQGLAHVLANILQLHGVRPDLSRLALAGHSRCGYTXLRRDTRARSRRLGRLRRLRIRTFIXRRGCHIKLSDADQACTSW

SEQ ID NO: 70761 - DNA, 676 bp, Zea mays
  misc_feature: Ceres CLONE 1551001
  misc_feature (500)..(500): n is a, c, t, g, unknown, or other
  misc_feature (652)..(652): n is a, c, t, g, unknown, or other
ctggagctccccgcggtggcggccgctctagaactagtggatcccccgggctgcaggaattcgtctcacccctagaaaaactttatgcctcgacattccaggatgggaggttacatccaaacatccattagatgtgatatttgagtttatctctgaagaaattcggcatggcccttttatcctttttctgaaggacacggagaaaatttgtggcaataatgattactatcatggtctgaaaagcaagctaaaacatttcccagctggtgcttttataattggatctcaaatccagcctgccaatcgcaaagagaaggcaaagggtagttctccttttctttcgaagttcccatacagccaaactatacttgacctcgcattacaggtaacttattattgaatacgatgcttgtacattatattctgtttggtaaaaactacttggatgtttttggcaaggcatggtctctcgaatatttgtaaaatccagtgcgatccancaaatttgtgacatcatagaatctttttttctagaaaatcacatatacaatttttatacttatgtaataaatggtcaaaaaaagttagatagtcaaagtttcaaaactttgaccagatttttgtcaaaaagtaaagtacttgttaccagaangagtatttcattaggtctgttata

SEQ ID NO: 70762 - DNA, 720 bp, Zea mays
  misc_feature: Ceres CLONE 1551003
  misc_feature: Encodes the peptide sequence at SEQ ID NO. 70763
ctggagctcaccgcggtggcggccgctctagaactagtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaagtggcggcgtccggcagcccctggtacggccccgaccgcgtcaagtacctcggccccttctccggcgagcccccgagctacctcaccggagagttcccaggcgactactgctgggacaccgccgggctgtccgccgaccccgagaccttccccaagaaccgcgagctggaggtgatccactcccgctgggccatgctcggcgcgctcggatgcatcttccccgagctgctctcccgcaacggcttcaagttcggcgaggccgtctggttaaagcccggctccccaatcttcacgaggggcggctggaatacttggcaaccccaggctgatcccggcgaaaaaatcccccccatctgggctgccaggcctgcttctgggcccctcaaaggtccctaattgccgcgggccgtcccggaaagtgtccaaccccttacccttggggaggttaaccccccggcgcggtaaa

SEQ ID NO: 70763 - protein, 169 aa, Zea mays
  misc_feature: Ceres CLONE 1551003
  misc_feature (61)..(166): Pfam Name: Chloroa_b-bind Pfam Description: Chlorophyll A-B binding protein
MAASTMAISSTAMAGTPIKVGSFGEGRITMRKTVGKPKVAASGSPWYGPDRVKYLGPFSGEPPSYLTGEFPGDYCWDTAGLSADPETFPKNRELEVIHSRWAMLGALGCIFPELLSRNGFKFGEAVWLKPGSPIFTRGGWNTWQPQADPGEKIPPIWAARPASGPLKGP

SEQ ID NO: 70764 - DNA, 711 bp, Zea mays
  misc_feature: Ceres CLONE 1551004
  misc_feature: Encodes the peptide sequence at SEQ ID NO. 70765
  misc_feature (478)..(478): n is a, c, t, g, unknown, or other
ctggagctcaccgcggtggcggccgctctagaactagtggatcccccgggctgcaggaattcgtctcacccctagaaaaaaacggcccagacgcgcaagcggaagaaagggggagcgcaacattcgcggccgcggggagggagagagacaaggggggcggtcacacacacgcggaccgcgcgagctagcgagcgagcgagatccccctctcgcgctgctggatccgatctgacctgaccttacctcgtcgccgccagccgtgagagagagaagaggaagaggaggaggaggcggagatggcaccggtgtcggcgctcgccaagtacaagctcgtcttcctgggggaccagtccgtcggcaagaccagcatcatcacccgcttcatgtacgataagttcgacaacacttaccaggctacaattggtattgatttcctgtcaaagacaatgtacccttgagatagaactgtgagactccnactctgggatacagctggtcaagaaagggtcaggagtttaatcccagctatatcagagactcttccagttgctgtcattggatttcaatgttgcaagcacgcagtctttcttaaatacctcccagtgaatagatgaaattcccccttgaaaggggccagggatgttacccttggggctggttgggaaccaaactgaaccttgtttaacaaaggaaatttctccttaagagaaa

SEQ ID NO: 70765 - protein, 53 aa, Zea mays
  misc_feature: Ceres CLONE 1551004
MAPVSALAKYKLVFLGDQSVGKTSIITRFMYDKFDNTYQATIGIDFLSKTMYP

SEQ ID NO: 70766 - DNA, 701 bp, Zea mays
  misc_feature: Ceres CLONE 1551005
  misc_feature: Encodes the peptide sequence at SEQ ID NO. 70767
gctccccgcggtggcggccgctctagaactagtggatcccccgggctgcaggaattcgtctcacccctagaaaaaatggacgatccctcctccgcctccaacaagcacaagcgcaagcgggggcgcaagcccaaggcgtcgccgccctcccccgaccgctcctccccctctccctcggccgcccccgctccggctgggcgccgtggccgcaagccgcgacgtcacgaggcccccgccgacgcagacgccacgcgtccgccgtccccgccccgccgcggggagccgaagccggtggcaaacggaggcgatgtggtggcagtggcggagtcaggccccgcgagctgggatgaggtggtgagggtagtgccgtgcatggacgctgtggtcaaggttgtctgcgtgcacacggagcccaacttctcgctgccgtggcagcggaagcgccagtacagctccagcagcagcggatttatcatcagcgggcgcccgtgtcctcaccaatgctcactccgtgggagcactattacccaggtaaggcttaaggaggcgcggctcccaacaccaaagtaactttgcacccggcctgggccatcggcaacaaagggggaacatttgccccttaaattgtcaagggaaaaagaaattctggggaagagagttttcccccggtttgattttgggaaaaattacccgccccttcg

SEQ ID NO: 70767 - protein, 164 aa, Zea mays
  misc_feature: Ceres CLONE 1551005
MDDPSSASNKHKRKRGRKPKASPPSPDRSSPSPSAAPAPAGRRGRKPRRHEAPADADATRPPSPPRRGEPKPVANGGDVVAVAESGPASWDEVVRVVPCMDAVVKVVCVHTEPNFSLPWQRKRQYSSSSSGFIISGRPCPHQCSLRGSTITQVRLKEARLPTPK

SEQ ID NO: 70768 - DNA, 727 bp, Zea mays
  misc_feature: Ceres CLONE 1551006
  misc_feature (80)..(80): n is a, c, t, g, unknown, or other
  misc_feature (218)..(218): n is a, c, t, g, unknown, or other
  misc_feature (269)..(269): n is a, c, t, g, unknown, or other
  misc_feature (314)..(314): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (403)..(403): n is a, c, t, g, unknown, or other
  misc_feature (404)..(404): n is a, c, t, g, unknown, or other
  misc_feature (407)..(407): n is a, c, t, g, unknown, or other
  misc_feature (415)..(415): n is a, c, t, g, unknown, or other
  misc_feature (527)..(527): n is a, c, t, g, unknown, or other
  misc_feature (650)..(650): n is a, c, t, g, unknown, or other
  misc_feature (708)..(708): n is a, c, t, g, unknown, or other
  misc_feature (725)..(725): n is a, c, t, g, unknown, or other
attgctggagctcaccgcggtggcggccgctctagactagtggatcccccgggctgcaggaattcgtctcacccctagangaagtctcttctggaaccgtccctcgctcgtcatctttccgccttcgctacgcaattcctgtccacgctgcgggccagttgtgacgaccgcgaagctcgtcagagaaagaagagaggccggcaggcgggcggcaatcngagatggcgccagaaaagccccggaaggagcaggaggaggaggaggaggantttatcctggaggattgaaccctccagggagggccccccccccancttcgatgatttcggtgaatccaacgaggaggaagataactttttttttccccccccccccggggggaaagaaaggggggttttnnncnnttntcttcccnttccctctggtggggaggaaaaaaaataaggagaaccagcgggggggggggggggggtccgccccctacccccaacctttgggttgcttcggggccccttccccggtgcaancggtgccgcccccgaacttttaggcctggtggcgtcgagtggtccggagaaacgaagtgagcttccggcgtgtgccagtcatcgatacgacgagacaacaatccgacctggacgaccgcgccnaaaggagagtccagctagccggataagaacggcgacagggccccccgtttccgatcanagcaaacaaggaggcgncc

SEQ ID NO: 70769 - DNA, 721 bp, Zea mays
  misc_feature: Ceres CLONE 1551010
  misc_feature: Encodes the peptide sequence at SEQ ID NO. 70770
  misc_feature (1)..(1): n is a, c, t, g, unknown, or other
  misc_feature (465)..(465): n is a, c, t, g, unknown, or other
nagagctggagctccccgcggtggcggccgctctagaactagtggatcccccgggctgcaggaattcgtctcacccctagaaaaatctcaccaaatccttctcctccgcgccgccacagtcgggcgcgcctctcgatcgagatccaggagatatgcctcgttatgatgatcgccatgggaatacacgcttgtatgttggaagattggcccctcgcaccggttcccgcgacctagaatatcttttcagcaaatatggaagaatacctgaagtgtagttgaagcgtgactatgcattcattgaattcagtgacccccgtgatgctgatgatgcgcagtacaacctatatggcaggcaagtcgatggaagccgtattattcgtgaatttgctaaacgatttcctcgtggctctggaggtacacgtgcgtgcactgcgagatgacctccaccaggaacaggtcgttganttaactgtggaatggatggtcactgagcaagggactgcacggctggtgactggaagaacaaatgctaccgctgtggtgaatcgggccatatagagagaaattgccagaacagtccaaggaatctcaggcgtgataaaagctattcacggtctccatccccacgtggtggacgtgggcgcagccggatctacagcagaagccggagctataggcgaatcagatccccatctggatctcccagggtggacgccgtgaa

SEQ ID NO: 70770 - protein, 40 aa, Zea mays
  misc_feature: Ceres CLONE 1551010
MPRYDDRHGNTRLYVGRLAPRTGSRDLEYLFSKYGRIPEV

SEQ ID NO: 70771 - DNA, 731 bp, Zea mays
  misc_feature: Ceres CLONE 1551011
  misc_feature: Encodes the peptide sequence at SEQ ID NO. 70772
  misc_feature (505)..(505): n is a, c, t, g, unknown, or other
  misc_feature (528)..(528): n is a, c, t, g, unknown, or other
aagctggagctcaccgcggtggcggccgctctagaactagtggatcccccgggctgcaggaattcgtctcacccctagaaaaatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggttcctgccttgaacgaaaggatactgtcatccatgtccaggaggtctgttgctgcacacccttggcatgatctggagataggtcctggtgctccaaccatattcaactgcgtaaggccaccctgtcatgcttgactggtcctcttgtgatatgttcatgttaatagcatgatgtcttttgttctattggaaaataaaaagtctccctggactctaaaatcatgcctgtgacacatgaactgtttgtgtcacccatgttcctctggctcctggcacttnctgatgcatgcctcaatgccttngaaaaaatcctaggaccgactcctatttcttatgccgggtcattgaaatccaaagggggcgccaggttaattttgaacttgaaagaaaactgggctgttcaagggggaaccggggcctattctcaccgtggtttccccccccaaacttggttccttccccccccccttttgtaaaaacgggtcccctttgagtgtctcgggtt

SEQ ID NO: 70772 - protein, 60 aa, Zea mays
  misc_feature: Ceres CLONE 1551011
  misc_feature: SWISSPROT Homolog: EC 3.6.1.1 Inorganic diphosphatase
MAPAVEAVKETGTFQKVPALNERILSSMSRRSVAAHPWHDLEIGPGAPTIFNCVRPPCHA

SEQ ID NO: 70773 - DNA, 660 bp, Zea mays
  misc_feature: Ceres CLONE 1551015
  misc_feature: Translation starting site: 200
  misc_feature: SWISSPROT Homolog: EC 1.4.1.2 Glutamate dehydrogenase
  misc_feature (583)..(583): n is a, c, t, g, unknown, or other
  misc_feature (660)..(660): n is a, c, t, g, unknown, or other
ggagctccccgcggtggcggccgctctagaactagtggatcccccgggctgcaggaattcgtctcacccctagaaaaaaaaaaccatcattgcaaaagcgaagcaaagcaatcggaattctctgcgatttctctagatctcgactaccccccactagttttggttcctcctttcgttcgagagagcgattctggtggcaatggcgaagagcgagggtccggcgatcgggatcgacctcggcaccacctactcgtgcgtcggcgtgtggcagcacgaccgggtggagatcatcgccaacgaccaggggaaccgcaccacgccgtcctatgtcggcttcaccgacaccgagcggctcatcggcgacgctgccaagaaccaggtcgccatgaaccccaccaacaccgtcttcgatgccaagcggttgatcggcaggaggttctctgacccgtcagtgcagagtgacatgaagctatggccgttcaaggtcatcccagggcctggtgacaaacccatgattgtagtcaactacaagggcgaggagaagcagtttgctgctgaggagatctcctccatggtcctcatncagatgaaggagattgctgaagcctaccttggttccacatcaagaacgcagtggtgacagtgccggcctatttcacn

SEQ ID NO: 70774 - DNA, 834 bp, Zea mays
  misc_feature: Ceres CLONE 1551025
  misc_feature (244)..(244): n is a, c, t, g, unknown, or other
  misc_feature (263)..(263): n is a, c, t, g, unknown, or other
  misc_feature (316)..(316): n is a, c, t, g, unknown, or other
  misc_feature (342)..(342): n is a, c, t, g, unknown, or other
  misc_feature (586)..(586): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (690)..(690): n is a, c, t, g, unknown, or other
  misc_feature (691)..(691): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (707)..(707): n is a, c, t, g, unknown, or other
  misc_feature (710)..(710): n is a, c, t, g, unknown, or other
  misc_feature (721)..(721): n is a, c, t, g, unknown, or other
  misc_feature (723)..(723): n is a, c, t, g, unknown, or other
  misc_feature (724)..(724): n is a, c, t, g, unknown, or other
  misc_feature (725)..(725): n is a, c, t, g, unknown, or other
  misc_feature (727)..(727): n is a, c, t, g, unknown, or other
  misc_feature (728)..(728): n is a, c, t, g, unknown, or other
  misc_feature (823)..(823): n is a, c, t, g, unknown, or other
  misc_feature (824)..(824): n is a, c, t, g, unknown, or other
  misc_feature (831)..(831): n is a, c, t, g, unknown, or other
  misc_feature (832)..(832): n is a, c, t, g, unknown, or other
  misc_feature (834)..(834): n is a, c, t, g, unknown, or other
aaagctggaactccccgcggtggcggccgctctagaactagtggatcccccgggctgcaggaattcgtctcacccctagaaaaatcccctgcgcctgccctcccctcctgctgcgactgtcgcctccctttccccttcactccctccctctccccgcgggccgccagaggcaatttcgccctcgattcgaccccgattcgtccgcccgcgaccgggattccctccgccaagcgcgcatctgaancctgcgctccatgtgcccnctcgaatccaccatgaacggggccaatccaagggcgcccccacgccatagacnaccttgcctttgaaaataaagggggngaaaaaacccccccaaggtaagaaatgggaagggggggtttggcccccccacaaggcctaaaaggcccccccccgcgcttctttcttttttcctgggggaaattttcccacttgtttttttggtataaaaaacccaaaaaaaaagacccccccccctctcggggggcaaaaaaaaacccgcgcaccggggggggaaaaccttctttaaaaccccccaaaaaggggggcccccttttttttcccncggggggtcttttatccctccctcaaagaaaaacaaaaaacttcttttttctccccaccaaaaggggggagaannnnnnnnnnnnnnnnngggggctagggcgnnnnnnnnnnnnnnnnnnaanaaaaaaaatgngnnntnnctctccctctcacacaccatacattccaccaaaaaaaaaaaagagagggtagagggggggggaatattataagtgggggggtaaaaccggccccnnaattttnncn

SEQ ID NO: 70775 - DNA, 596 bp, Zea mays
  misc_feature: Ceres CLONE 1551026
  misc_feature (14)..(14): n is a, c, t, g, unknown, or other
  misc_feature (390)..(390): n is a, c, t, g, unknown, or other
ctccaccgcggtgngcggccgctcctagaactagtggatcccccgggctgcaggaattcgtctcacccctagaaaaaaccctctcagtctctcagtgctgatacttctctccactctcctctttctttccctgtcccgacagagttcgaggaagctgggtgggcctgatgcttctcccccacccccttctcttgtctagcgtccattcacttcgcagggcttttctttctgtttaagtaaaacggatccagcaacgcaccagttcctgaaacagaaacgtgatgatggattccgtaagcatgaagctgttaccttttgtgttccttctgttgcgatgccagcgggcatcttcttccccccgctgtcgagggtggggggggaagcattggnttaaaaataaagaccccaccttggtgacaaaagtgggggccctttggggattgggaaaggataatccaattgggccccccgcttacgggggccaatggttattttgcccaaaaataacaaaatgccccacaattattttttgggcccccccccgggttaaacaagaatcccttttccccccccccttttgcaaaagttaaaaaatg

SEQ ID NO: 70776 - DNA, 698 bp, Zea mays
  misc_feature: Ceres CLONE 1551027
  misc_feature: Translation starting site: 257
  misc_feature (394)..(394): n is a, c, t, g, unknown, or other
  misc_feature (397)..(397): n is a, c, t, g, unknown, or other
  misc_feature (649)..(649): n is a, c, t, g, unknown, or other
ggagctccccgcggtggcggccgctctagaactagtggatcccccgggctgcaggaattcgtctcacccctagaaaaaaccccgggccttgcgtggcgatcgagttgccaccagacaactcggctcggctcgtcgtccaccgaccctcctcctcgctccaagcttccctctcccctcctcctccgtcagctggggagctagctagggagcggcgccggcggctgatcgagcggacagacagctgaacgagccggaaatggcggcggggcgcgcgccgtggctcgccgccggcctcgtggcggtgctgatggtggtggccgcccgcgcgcggttcgtggtggagaagagcagcgtgcgggtgctggcgcccgagcgaggcggggccaccacaacnccnccatcggcaacttcggcgtgcccgactacggcggcacgctcaccggcgtcgtcatctacccggaacccaaggcccacggggggcgacgacttcgacgcccagttcaagggcaagtcccgcccgccccgtcatccctcctgctcgaccgcggaaaaaggctacttcccgcctcaaggggtgaaaacgcacaaccgcgctggcgcagacgacgtgcctaaatgccagcaagcggggagcaaccccctgtgtggnaatggagagggcccggggagcgtccccccgggacgcgcagagaaatggc

SEQ ID NO: 70777 - DNA, 666 bp, Zea mays
  misc_feature: Ceres CLONE 1551031
  misc_feature: Translation starting site: 150
  misc_feature: SWISSPROT Homolog: EC 2.7.4.3 Adenylate kinase
  misc_feature (287)..(287): n is a, c, t, g, unknown, or other
aaagctggagctccccgcggtggcggccgctcctagaactagtggatcccccgggctgcaggaattcgtctcacccctagaaaaagccaaaactgtctctcccacgtccttccgggtcctatcgctcctctccgtcgccggtggagctcatggcatcctccatggccgccgccgccaccgccaccgccctcccgctgccgtccgggacgacgcagaggccgtctgcccagggccgcctcctcttttcacgcgcgcccgcccgctccctccgcctccgccccgccggncgccggtcggcccgctcctcgcctcgggcccaccaggctgtggtggcagcgtttgctgatcctctcaggtcatgattcaggagctcccgcgtcccgcaaggcccacccatgccagctcatcaagaccaattttcaactggccccattctcccccgaaatttggttgcggcggaaaatccctgctggccttaaaaacgggaaacggggcacaggaattcttgggaaaagggccccccccggcccgaataaaattgcgcttaaaatagggaaaggaaacccttttgggaaaccaaaccctcaaaaaaaggttgggtttttggaccgggccccccaaaagcttttcccaggccctggggtcttgagaaccccttgaaaaccc

SEQ ID NO: 70778 - DNA, 675 bp, Zea mays
  misc_feature: Ceres CLONE 1551037
  misc_feature: Encodes the peptide sequence at SEQ ID NO. 70779
  misc_feature (359)..(359): n is a, c, t, g, unknown, or other
  misc_feature (441)..(441): n is a, c, t, g, unknown, or other
  misc_feature (452)..(452): n is a, c, t, g, unknown, or other
  misc_feature (545)..(545): n is a, c, t, g, unknown, or other
aaagctggagctccccgcggtggcggccgctctagaactagtggatcccccgggctgcaggaattcgtctcacccctagaaaaaacccgaagcacatcccgtcgcatcccatcccactaccacccatctcgtcgtccgccgattcgatccggttcttccaacccaggggctgtgatggcgacgaagaggagcgtgggcaccctcggcgaggcggatctgaaggggaagaaggtgttcgtgcgcgccgacctcaacgtccctctcgacgacgcccagaagatcaccgacgacacccgcatccgcgcctcccgtcccaccatcaagttcctcctcgagaagggcgccaaggtcatcctcgncagccacctgggtcgtcctaaaggtgtcacccccaagtacagcttgaaagcctcttgttccacgcatgtctgagctcttggnaattgaagtcntgatggccaaggattgcattggtgaggaattgaaaagttggctgcccctttgcagaagggggatttctgtccctgaaaaggtaaattcctcanggagagaaaaaaaccaactgagtttgctaaaaacctacaccgttgcggacctttagccaaaaagggtttgggccggccccaaagtcttggcttaaccggaggggttccaagattttgaacccggctgttt

SEQ ID NO: 70779 - protein, 85 aa, Zea mays
  misc_feature: Ceres CLONE 1551037
  misc_feature: SWISSPROT Homolog: EC 2.7.2.3 Phosphoglycerate kinase
  misc_feature (62)..(62): Xaa is any aa, unknown, or other
MATKRSVGTLGEADLKGKKVFVRADLNVPLDDAQKITDDTRIRASRPTIKFLLEKGAKVILXSHLGRPKGVTPKYSLKASCSTHV

SEQ ID NO: 70780 - DNA, 655 bp, Zea mays
  misc_feature: Ceres CLONE 1551040
  misc_feature: Encodes the peptide sequence at SEQ ID NO. 70781
ctccccgcggtggcggccgctctagaactagtggatcccccgggctgcaggaattcgtctcacccctagaaaaagtcgagagagtcgtccccccgcgtgctctccgcctgcggcctctgtatcccgcaaccaaaaactacccccaaaaaaagaagaaaaccccaaatcctcgagatctatcagtatcgagcgacttaccaatccgattgctagggtttagtttcgaaaaaatctgaaaaaaaattctggtcgaggggaggaggcgatgtcggcgcaagtggcggtggtgcctaatgggggcccgggcgctgtccccgcggtggtgtcgccgggagctgtcggcgtggctcagcctctcccgaccacgtcgctctacgtgggcgacctggagggggccgtctcggactcgcagctgtacgaactcttcagccaggcggggcaggtggtgtcggtgcgcgtttgcagggatgtcacctcgcgccgctcgctcggatacgcctacgtcaactacagcaatcccttggatgctgcgagagcattggaagtgctgaactttgctgctcttaacaacaagcctatccgggtgatgtattcaaaccgtgatccaagcagccgcaggagtggatctgctaacattttcataaaaatcttgaca

SEQ ID NO: 70781 - protein, 130 aa, Zea mays
  misc_feature: Ceres CLONE 1551040
  misc_feature (36)..(107): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MSAQVAVVPNGGPGAVPAVVSPGAVGVAQPLPTTSLYVGDLEGAVSDSQLYELFSQAGQVVSVRVCRDVTSRRSLGYAYVNYSNPLDAARALEVLNFAALNNKPIRVMYSNRDPSSRRSGSANIFIKILT

SEQ ID NO: 70782 - DNA, 727 bp, Zea mays
  misc_feature: Ceres CLONE 1551041
  misc_feature (444)..(444): n is a, c, t, g, unknown, or other
  misc_feature (511)..(511): n is a, c, t, g, unknown, or other
  misc_feature (553)..(553): n is a, c, t, g, unknown, or other
aagctggagctcaccgcggtggcggccgctctagaactagtggatcccccgggctgcaggaattcgtctcacccctagaaaaaccccattccttcccttccacgcgcccctccctcccatggtcctcatggccgccgtcgagaacgaccaccgccgcggagccaaggccacctctgcccagtcgaattccataggtcccgcgccgcggccgtcgtcccgcgcgcggctccacgatttctccttcctcaccctcagctggggcacgcaccgcgtgctccgctgctccaagagcggccccggctcgtcgccctcttccgcgtctccggagaccccgtccccggacaaggagagagcccaccgacccgagggcggcggctcgctgcggcagcgccagcgcttcgctcagcggccgtggaacctttcggacccgcgctcccgccacgnccgcccgacgcgccaggggggatcggacgaggagtctgaagccgcggagcgcgcgcctccgccgacngtggaggcgaagaaagcggcgcttctcatcgcccttgtccanccaggaaatcccaaaggacttccgcggcgattccggggacgcgggcccccgcgccggcccaagaagccccccgcgaacggggaaacgggagcttcgacttgttgtacccggggattggccttaccaaaattgggcccccggccccccctttttttaaaaaaaagggaatttttt

SEQ ID NO: 70783 - DNA, 745 bp, Zea mays
  misc_feature: Ceres CLONE 1551048
  misc_feature: Encodes the peptide sequence at SEQ ID NO. 70784
aaagctggagctccccgcggtggcggccgctctagaactagtggatcccccgggctgcaggaattcgtctcacccctagaaaaactcatccccttgcccacttctacagcccctctgctgcagcaagaaggaaagaagctagcgcttatagcttgtcagccatggccaccgccgccgcgtctagcctcctcaagtcctccttcgcgggctcccggctcccggccgccacgcggaccacaccggcgtccctcgtggtggccaccggcccgcgcggcgccggcgcggggcccatctgcgcgtccatgtccatgtcctcctccaacccgccctacgacctgacgtccttccggttcagccccatcaaggagtccatcgtgtcccgcgagatgacccgtcgctacatgaacgacatgatcacctacgccgacaccgacgtcgtcatcgtgggcgcctgctccgcggggctgtcctgcgcgtacgagctttcaaggaccccgccgtgagcatccgcatcgtggaccaatcggtgttcccccggcggcggccctgggctgggcggcaacctgtccctcgccatgggggtgcccaaaaccggcccaccttgtccctgaacaactggggggtgggctacaaccaggcccaaaaactccttggctataaagaccccccggtttttaaattcaccgggtttgaacccgtccctggtggccccccaaattaaattttgttaaacccgggggcgggg

SEQ ID NO: 70784 - protein, 113 aa, Zea mays
  misc_feature: Ceres CLONE 1551048
MATAAASSLLKSSFAGSRLPAATRTTPASLVVATGPRGAGAGPICASMSMSSSNPPYDLTSFRFSPIKESIVSREMTRRYMNDMITYADTDVVIVGACSAGLSCAYELSRTPP

SEQ ID NO: 70785 - DNA, 668 bp, Zea mays
  misc_feature: Ceres CLONE 1551049
  misc_feature: Encodes the peptide sequence at SEQ ID NO. 70786
aagctggagctccccgcggtggcggccgctctagaactagtggatcccccgggctgcaggaattcgtctcacccctagaaaaacgctattcactatatataatatgttggatgtagatgaaaggagggacgcaagcagttagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacgacccgctcgcgctcgaatcgtttctaaacatcactctgggtgacaaggcagggcgctccgtaagcttgaagatggatgtatccagagcctacttcgtggcttacgtagcagggcagcgctcgtgcctcctcaaggatcaggccgcacgtctcgtcgggcatctgtactacggtggcccctgggggaacaagttcggctcctgtcgtacgcgaccggggtccatcgaaggggcaataaccgtgctgttccgggaaacggaaagggaaagaatcctgggt

SEQ ID NO: 70786 - protein, 184 aa, Zea mays
  misc_feature: Ceres CLONE 1551049
  misc_feature: SWISSPROT Homolog: EC 3.2.2.22 rRNA N-glycosylase
MKGGTQAVSLMVHLAVPWLCLASWAALLPALASGNVGAAAPILRADYIKLNFSTASATPDKYKSFIASVRAGLVSKAGGNSSGIPVLVDEDDPLALESFLNITLGDKAGRSVSLKMDVSRAYFVAYVAGQRSCLLKDQAARLVGHLYYGGPWGNKFGSCRTRPGSIEGAITVLFRETERERILG

SEQ ID NO: 70787 - DNA, 668 bp, Zea mays
  misc_feature: Ceres CLONE 1551055
  misc_feature: Encodes the peptide sequence at SEQ ID NO. 70788
ctccccgcggtggcggccgctctagaactagtggatcccccgggctgcaggaattcgtctcacccctagaaaaagtgccacgggtcagataagcttttctctccccttcgcagctgcaaccgctcgccgcgtgctccctttgtactgaaccgcatcctccccgcgccgacctgctccggcgagttaaatatggccgtcctcctccgcagcacctccgccgccgcctcgactgctggcccctcctcggcgctgctcgccaccacctttcgccgctcccgcggctgccttctgccccgtgccgcgccgcagcgccgcttgtatgtggcccgcgcctcggcccagcccctcggagtctgcgctaaggagtcccatcacatccctgggccgcctcggagactgtcctttcacacagagggttttgtgactatagaggagaagcatctgcctaatgatctgaagctagttgatctaactaattagcaggattggttatttgaaatcaacccaaaagtaaaggggcctatccgggagctccaaggaaaaagggattgggggattctgatggtatacccccgcgcttaagaggaaaaattccccggaccccccctgtggcacctccaccaaaaaaggcttccgtggaacaaaaaatttttcccccttttattggt

SEQ ID NO: 70788 - protein, 96 aa, Zea mays
  misc_feature: Ceres CLONE 1551055
MAVLLRSTSAAASTAGPSSALLATTFRRSRGCLLPRAAPQRRLYVARASAQPLGVCAKESHHIPGPPRRLSFHTEGFVTIEEKHLPNDLKLVDLTN

SEQ ID NO: 70789 - DNA, 654 bp, Zea mays
  misc_feature: Ceres CLONE 1551056
ctccccgcggtggcggccgctctagaactagtggatcccccgggctgcaggaattcgtctcacccctagaaaaaacccacacccacaccacacctcacgtctcctcactacccgcgctctcaggcagcgcacctcgctcctcctcccccacagcgctttccattttcgtctatctcccgagaaccctcctgcgcctcccaaagctctcttgttcgttggctccccccccccccccccccgtgctggttaatcatccccttcgatttcgatcacatacatataatctctctcagctatcgcggccgcgcgcctgatcgacgtacgaccggtctggtacgtacgtgtgctcgcccgccatggctcgcggcgacggcgagctggagctgtccgtgggggtccgcggcaccggcggcccggcggcggcggcggcagaaccactgggcgccgatcagcctcggcagggtcatcctccccggcatggtcccccggtgcgtgcattacggctgggccctgcacctctccctcctcacgccctaggtgagaatctggggctctcacatgccctcacttcattcaggggggcttggcggcctattggcgggtttaggggccaaccgctgggtggcctgtacagcataggggaccgcaaaatgg

SEQ ID NO: 70790 - DNA, 694 bp, Zea mays
  misc_feature: Ceres CLONE 1551060
  misc_feature: Translation starting site: 115
  misc_feature: SWISSPROT Homolog: EC 3.2.1.23 Beta-galactosidase
ctggagctccccgcggtggcggccgctctagaactagtggatcccccgggctgcaggaattcgtctcacccctagaaaaaagtttccactgtgctccttctcgccgactccgccatgaccgcctcgccctacccgacgacgccgtggctgcggccaccgcctcctatggcatttctgagtctcctcctcctccttggctgcctctccccgtcgatctcactggcgggtgcggaggcggcgggggttctgagacaagtggttggtggggacgacggcgggacattcttcgagccgtttcacgtgacctacgaccaccgcgcgcttatccttggcgggaagcgcaggatgctcgtctctgcgggggctcactacccgcgtgccacgcccgagatgtggccgagtttgattgcaaagtgcaaggagggcggcgtggatgtaattgagacatttgtgtttttggatggggcatgagccgggccaaagggcagtattacttcgaagggagatttaatatggtcagggttgcctaagctggtttccacttaaaggtctatttcttttttctgcgaatcgggccccttatgctttgtgctgaatggaattttcggggggttttcccagtttggtttgccccgattgtcccttgggtatagaatttccccccctggacaattgaacccttacaagggttgga

SEQ ID NO: 70791 - DNA, 604 bp, Zea mays
  misc_feature: Ceres CLONE 1551062
  misc_feature: Encodes the peptide sequence at SEQ ID NO. 70792
gcggtggcggccgctctagaactagtggatcccccgggctgcaggaattcgtctcacccctagaaaaaattactcctcgcctcttccgcgcccaaacactaccgcctccctcccacccctagtccccctaccccccatccaatcctctgctcgccttgtctcgtcccggcagcggcgagcggcggcttgggcgcgcacacacaccaggtgttcgattggagtcctcgccgaagcggaagatgtacgtggtcaagagggacggccgccaggaagaacggtgcacttcgacagatcacggcgcgcctcaagagctcagctacggcctcagccagaacactgcgacccgtgctcgttcgcataagtctgtgcggggtctacagggcgtcaccacagcagctcgacaagtcgcgcccaaacagcgcggcatgacgcgtccaccccgataaacctccttgggggaagattgtgtgtccacctggcaagaacccaaagagtcttctcggagacaattaggacttgcactgcctttcacaaaaatccgggggaatgccccctcgggccctgaaattgttttaaaccctcaaaaaaaagccggtccttggaa

SEQ ID NO: 70792 - protein, 68 aa, Zea mays
  misc_feature: Ceres CLONE 1551062
MYVVKRDGRQEERCTSTDHGAPQELSYGLSQNTATRARSHKSVRGLQGVTTAARQVAPKQRGMTRPPR

SEQ ID NO: 70793 - DNA, 616 bp, Zea mays
  misc_feature: Ceres CLONE 1551065
  misc_feature (73)..(73): n is a, c, t, g, unknown, or other
  misc_feature (433)..(433): n is a, c, t, g, unknown, or other
ggagctccccgcggtggcggccgctctagaactagtggatcccccgggctgcaggaattcgtctcacccctangaaaagttgcggtggtacaaagcgacaggcgcctcacgctcgcgtccctcctccccttccccacctcttcccattgccaagcaagagagaaacgcacgcgagccgcgagcagaacagagcagcgcggcgccatcccgatctcgctatttcccttctcccccgatgcgatctcgccgaaccctaatccccacgcccgccgcccggccgtcgccggagccctagccccgaatgcggcggtgacgcgcggggtgccaccaccaccaccacttcagcgcccgcgcccgccaccaaccgtcctggccgggcgacaccggctggcctgggcgccgccaacaaggggggggcgccgctcggcccccncccccttcgggttggtcctggccctccccccccccccccccggggtttctcggcctctcccgggggtttttgggggggcttcccggcaacccttcctaggggggccgagggggccccccgaaaccgcccccccttccccaaaaccgggtcaggggggggccgggggggaacgggggagaaccc

SEQ ID NO: 70794 - DNA, 688 bp, Zea mays
  misc_feature: Ceres CLONE 1551067
  misc_feature: Encodes the peptide sequence at SEQ ID NO. 70795
  misc_feature (42)..(42): n is a, c, t, g, unknown, or other
  misc_feature (68)..(68): n is a, c, t, g, unknown, or other
  misc_feature (72)..(72): n is a, c, t, g, unknown, or other
tccccgcggtggcggccgctctagactagtggatcccccggnctgcaagaattcgtctcacccctagnaatntccaccaccaccacctcctcccccctccgcccttttctttccccttttcctcacgcccctctttccagtttgtgctgtctgctgtgctgtgctgtgctgtgctcgccggccggctggcctgatctttccaactccccccctcacccccctcctaacctcaccacgcctccagtagcgctagccagcagccacctccatgcgcgctagctagctcctggcacagctccagcttctccgatccacctccataattctgccgtgcggccaccagcagcagctccggccgggaaaggcgcaggagtccgccttgggttccttgcgcgccccccccaaattaagctaccttgctagctagaaagctcgctccacgcgccggccggccggcatgcagcagccggccatgccgcctccattctcgcctgctgcgggggggcagcacgccacgcccataagcagccgccccgccggaggccacgcccacacccaccccccccaggcatccagggccgacaaactccggccgggggggcccggcgggttttttccggggaagcagcaggcctgggtgcccccgttttggggacccacgaagggggggcccccacccggaggggag

SEQ ID NO: 70795 - protein, 77 aa, Zea mays
  misc_feature: Ceres CLONE 1551067
MQQPAMPPPFSPAAGGQHATPISSRPAGGHAHTHPPQASRADKLRPGGPGGFFPGKQQAWVPPFWGPTKGGPPPGGE

SEQ ID NO: 70796 - DNA, 667 bp, Zea mays
  misc_feature: Ceres CLONE 1551070
  misc_feature (346)..(346): n is a, c, t, g, unknown, or other
  misc_feature (391)..(391): n is a, c, t, g, unknown, or other
  misc_feature (392)..(392): n is a, c, t, g, unknown, or other
  misc_feature (398)..(398): n is a, c, t, g, unknown, or other
  misc_feature (404)..(404): n is a, c, t, g, unknown, or other
ggagctccccgcggtggcggccgctctagaactagtggatcccccgggctgcaggaattcgtctcacccctagactcgcctgcatgaagcaggaatcgctagtaatcgccggtcagccatacggcggtgaatccgttcccgggccttgtacacaccgcccgtcacactataggagctggccaggtttgaagtcattacccttaaccgtaaggagggggatgcctaaggctaggcttgcgactggagtgaagtcggaacaaggtagccgtactggaaagtgcggctggatcacctccgccgccgccctactcagcctccagcgtgatctgagtcctgaccaagcccntaacgccaccgccctcgcaaatctcctttcccttcgatccatggnnccgcgncgtcgncgcccccgcgcatcccggaagaaggagacctaccccgacaccaagcgccgcgaccaagtgcgcggggcccaaatcgccgctgggcgcggccttcccaaacccgtgggcaccttcgttgggcccccccgggatggaaaaaaaaagatcctttcggggcaaccagctctcgggaggtcttttccccaaagaaggggcccccatcctttccccgagggggcccccccacccccccccggggaatttttcccaaaaattattccccc

SEQ ID NO: 70797 - DNA, 628 bp, Zea mays
  misc_feature: Ceres CLONE 1551071
  misc_feature: Translation starting site: 174
  misc_feature (269)..(269): n is a, c, t, g, unknown, or other
  misc_feature (279)..(279): n is a, c, t, g, unknown, or other
  misc_feature (284)..(284): n is a, c, t, g, unknown, or other
  misc_feature (293)..(293): n is a, c, t, g, unknown, or other
  misc_feature (304)..(304): n is a, c, t, g, unknown, or other
  misc_feature (344)..(344): n is a, c, t, g, unknown, or other
ctccccgcggtggcggccgctctagaactagtggatcccccgggctgcaggaattcgtctcacccctagaaaaacccttccccttccgctcgagtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggantgaggaggangaaanatgaggacnatgacgatgantgacaggatgatgatgaactcgatggggatgccagtggcnagtcaaagcaaagcaggagtgagaagactagaaaaaagagccgcaagggccatggctgaagcttggcatgaagcccatcactggtgtcagccgcgtcactgtaaagaaagcaagaatatacctctttggtcatccccaaaccagatgtgttcaagaccccgatttccgacagtatggtcttatcggcagggttagatcggagacctcggctcccaggtgcaaaccagggagaaaagcatttcagggtcctgactgggcccgatgatcccaatccggaagggctg

SEQ ID NO: 70798 - DNA, 667 bp, Zea mays
  misc_feature: Ceres CLONE 1551075
  misc_feature: Encodes the peptide sequence at SEQ ID NO. 70799
  misc_feature (407)..(407): n is a, c, t, g, unknown, or other
  misc_feature (667)..(667): n is a, c, t, g, unknown, or other
ctggagctcaccgcggtggcggccgctctagaactagtggatcccccgggctgcaggaattcgtctcacccctagaaaaaaagaagagcacgcccactcctctccggctcctcttcttctccaccacaccacaggcaccggcaccagcaccgcctcctccctccctccctcttgccaccgcgcggccccccagccacagcacagcacagcaatggcgggcaacggcgccatcgtggagagcgacccgctgaactggggcgcggcggcggcggagctggcggggagccacctggacgaggtgaagcgcatggtggcgcaggcccggcagccggtcgtgaagatcgagggatccacgctccgcgtcggccaggtggccgccgtcgcgtccgccatggacgcgtccggcntcgccgtcgagctcgacgaggaggcccgcccccgcgtcaaggccagcagcgagtggatcctcgactgcatcgcccacggcggcgacatatacggcgtcaccaccggcttcggcggcacctccccacgccgcacaagagacgggcccgcgcttcaggtcgagctgctcaggcatctcaacgcccgaaatctctgcactggcagcaatggccacacgctgccctcggaagtcaccggggcggcaatgctggtgcgcatcaan

SEQ ID NO: 70799 - protein, 151 aa, Zea mays
  misc_feature: Ceres CLONE 1551075
  misc_feature: SWISSPROT Homolog: EC 4.3.1.5 Phenylalanine ammonia-lyase
  misc_feature (66)..(66): Xaa is any aa, unknown, or other
MAGNGAIVESDPLNWGAAAAELAGSHLDEVKRMVAQARQPVVKIEGSTLRVGQVAAVASAMDASGXAVELDEEARPRVKASSEWILDCIAHGGDIYGVTTGFGGTSPRRTRDGPALQVELLRHLNARNLCTGSNGHTLPSEVTGAAMLVRI

SEQ ID NO: 70800 - DNA, 672 bp, Zea mays
  misc_feature: Ceres CLONE 1551077
ccccgcggtggcggccgctctagaactagtggatcccccgggctgcaggaattcgtctcacccctagaaaaagaatcttgtaggatatgatgtgggcctttacgtttcttgtctttctgttctgtcgcgtccgtctgttcttgatattgtgccgagacagggatcgccatgttggactaaaacgcacagcacttgaaatagaaagccgacgttggggcgtccaagacctacccggtgcaggctggcaccgtactgtatagaagagcttcatcgtgatgagcaacggttcctgctagggtgaggaggtttctacctccaagagtggtaagcatggccgctccaaatgccagtttgtcgccgtacacatatttaatgggaaaaagcttgaagatattgttccttcatcacacaactgtgacattccacatgtgaaccgtactgagtatcagctgattgatatttctgaggatggatttgtgagccttcttacttcagatggcaacactaaggatgatcttagactcccacctgatgagactcttgtggaccagattaaggaagggttcgaacgcgcgaaggatcttgttgtgactgtacagtctgcgatgggggaggagcatatctgcgcgatgaatgatgtgggccccaagtaactttcattgcatttggaga

SEQ ID NO: 70801 - DNA, 669 bp, Zea mays
  misc_feature: Ceres CLONE 1551081
  misc_feature: SWISSPROT Homolog: EC 2.7.13.3 Histidine kinase
  misc_feature (70)..(70): n is a, c, t, g, unknown, or other
  misc_feature (395)..(395): n is a, c, t, g, unknown, or other
ctccccgcggtggcggccgctctagaactagtggatcccccgggctgcaggaattcgtctcacccctagnaaaattctttctcccgttcaccccgcgtgcacgctctttcccttcctcgtgccgacgaccgggcgaccgccgcgccccggcccgcgcccccttgtctcgggccactcgccggcaacgagcagccaccaggaaatgttgtgaggactgatgcaataactaagcttgctggatggacggatgtgattgcatcgagccactagggcctaccgatgatctccttgtcaagtatcagtacctctcagacttcttcatagccctcgcgtacttctctattccttttggaccccccccccctcggggggggggggggccttcttccccttcnaaatggggtcttggtcccgttttgggggggttttttgggttcccctgggggggggaacccccttctaataaaccctgtgggaactttccccccccaaattaccaaaagcccccgttgccaaatgggccttggcccctacacaaaaggttttcctacggcaacttgttttcccctctccaaacttgcgtttaaatgccttgttccaaacccccccccccactttttttggacgcgtgaagaacttgggggggttttgttcccctccacaataaag

SEQ ID NO: 70802 - DNA, 654 bp, Zea mays
  misc_feature: Ceres CLONE 1551086
  misc_feature: Encodes the peptide sequence at SEQ ID NO. 70803
agctccccgcggtggcggccgctctagaactagtggatcccccgggctgcaggaattcgtctcacccctagaaaatcctctctgcctccctcgtgccctcgccctcctttttttttagtttacccgccgtcccgcgcgccgccgtttcggttgctcggctaggggggactgggggagtgccagcgagtccatggcagcggcgagggcgtgcttcgtcgcgctggcgctggtggcggcgttcttcgtggccggatcggcggcagcggcggcggggaatgcccggagccgctcgcagctgacgctcaggcagcggcgccggcagctgctgcggcagcggcaggtgcgcacccaccctcagaggctcaacaaggcgccggtcgccaccatcgagagtccagacggagacatcatagactgcgtgcttatctcccacccagcccggctgggatcaccttttcctcaaaacccacactgttccaaattgccgcctgcatcccacccgggagggcctgacgaccacgaagtccaggttgcatcccagcggaacccccaaacaaccatccccccaaatgtggcatcaaaccggcaggggccccggggggcccattcccattagggggaaccaaggaagaggaattccttgagggccccccc

SEQ ID NO: 70803 - protein, 141 aa, Zea mays
  misc_feature: Ceres CLONE 1551086
MAAARACFVALALVAAFFVAGSAAAAAGNARSRSQLTLRQRRRQLLRQRQVRTHPQRLNKAPVATIESPDGDIIDCVLISHPARLGSPFPQNPHCSKLPPASHPGGPDDHEVQVASQRNPQTTIPPNVASNRQGPRGAHSH

SEQ ID NO: 70804 - DNA, 626 bp, Zea mays
  misc_feature: Ceres CLONE 1551186
  misc_feature: Encodes the peptide sequence at SEQ ID NO. 70805
  misc_feature (1)..(1): n is a, c, t, g, unknown, or other
  misc_feature (532)..(532): n is a, c, t, g, unknown, or other
ncgattgggtaccgggccccccctcgagccactgcagtggtaaaggcgagacgcacccgtggcacctgcacggccacgacttctgggtgctgggctacggcatcggccgcttcgacccggcggtgcacccggcgtcctacaacctcagggaccccattctcaagaacaccgtcgcggtgcacccctacggctggacggcgctgcggttcagggccgacaaccccggcgtctgggcgttccattgccacatcgagtcccatttcttcatggggatggggatcgccttcgaggaaggcgtcgaccgcgtcgctccgctcccgccacagatcatggggtgcgggaaaaccaggggtggccactaactgatggtgttcagaagcttaactgaaccacaccgttgatccatttcgttgttttgtttcttaattattacaatccatctaataagatttgtatgggcattttttttatcacaaaaaaaaaaaaaaaaaccagagctctgggaattcctgcagcccgggggatccactangtctagagcggccgccaccgcggtggaactccagcttttgttccctttagtgagggtaaatttcgagcttggcgtatcatggtcataactgttc

SEQ ID NO: 70805 - protein, 119 aa, Zea mays
  misc_feature: Ceres CLONE 1551186
  misc_feature (2)..(101): Pfam Name: Cu-oxidase_2 Pfam Description: Multicopper oxidase
  misc_feature: SWISSPROT Homolog: EC 1.10.3.3 L-ascorbate oxidase
DWVPGPPSSHCSGKGETHPWHLHGHDFWVLGYGIGRFDPAVHPASYNLRDPILKNTVAVHPYGWTALRFRADNPGVWAFHCHIESHFFMGMGIAFEEGVDRVAPLPPQIMGCGKTRGGH

SEQ ID NO: 70806 - DNA, 646 bp, Zea mays
  misc_feature: Ceres CLONE 1551193
  misc_feature: Encodes the peptide sequence at SEQ ID NO. 70807
  misc_feature (646)..(646): n is a, c, t, g, unknown, or other
cgattgggtaccgggccccccctcgagccctgcagtggtaaaggtcgccctcgtaatcaatctccgcctccctgcctgcttaccccgaccccgtcggcatctcggagaatcgcggcggtcaaagcccagcctaccccacctcgcgccgcgtcgccgcggtttccgcgggccagtgctctcgggagtcgggagctcagatcaggagggacgggctaggtagggttcgcgagcgagcgagggtgctgccgtccggcgccggtgtccgagtagcaagaggagagatggacgcgttcctgcagaggctcaagcggttggacgcgtaccccaaggtgaacgaggacttctacaagcggacgctctccggcggcatcgtcacgctcgtcgccgccgtcgtcatgctgcttctcttcatctccgagaccaggtcatatttttattcagcaacagagactaagttagttgtggacacatcaagaggagaaaggctacgagtaaattttgatattacttttctgagcattccttgcaccctcctcagcgttgatacaatggatattagtggagaacagcaccaggacattaggcatgacatcgaaaagatacgattagatgcacatggtaatgttattgaagcaagaaaagttan

SEQ ID NO: 70807 - protein, 121 aa, Zea mays
  misc_feature: Ceres CLONE 1551193
MDAFLQRLKRLDAYPKVNEDFYKRTLSGGIVTLVAAVVMLLLFISETRSYFYSATETKLVVDTSRGERLRVNFDITFLSIPCTLLSVDTMDISGEQHQDIRHDIEKIRLDAHGNVIEARKV

SEQ ID NO: 70808 - DNA, 595 bp, Zea mays
  misc_feature: Ceres CLONE 1551211
  misc_feature: Encodes the peptide sequence at SEQ ID NO. 70809
ggggtccgggccccccctcgagccctgcagtggtaaaggaatcgagcggtgactggcgaggcaaaagcattgcgaccacagacagcgcgcgcttcaaggcctttttttttgagataacaaggaggagatggcggtcacgatcacgtgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaagctggagctatggtgaagaagattcctctttaccagcacatcgcaaatcttgctggaacaaaactctggtgctccctgtacctgcgcttat

SEQ ID NO: 70809 - protein, 130 aa, Zea mays
  misc_feature: Ceres CLONE 1551211
  misc_feature (4)..(131): Pfam Name: Enolase_N Pfam Description: Enolase, N-terminal domain
  misc_feature: SWISSPROT Homolog: EC 4.2.1.11 Phosphopyruvate hydratase
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKLELW

SEQ ID NO: 70810 - DNA, 637 bp, Zea mays
  misc_feature: Ceres CLONE 1551232
  misc_feature: Encodes the peptide sequence at SEQ ID NO. 70811
  misc_feature (637)..(637): n is a, c, t, g, unknown, or other
cgattgggtaccgggccccccctcgagccactgcagtggtaaaggggctgaggaggccatcggacgcacaaggacagcaagcagagtgcagggccggagcgagcgaccgagagtgtgtgtgagagagagatggcgtccagcgcctcgtgtaccctgctgctgccaacgctctcgctcgcggtgatcctgctcgcgctgtgcgcccgcggcggcgaggccaggccgccgccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggcttcttcagcgccgccatcaagctgcccgccgactacgcggcgggcgtcgtcgtcgcgttctacctgtcgaacggcgacgtgtacgagaagacgcacgacgagctggacttcgagttcctgggcaacgtgcgcggccgcgagtggcgggtgcagaccaacgtgtacggcaacggcagcaccgacgccggccgggaggagcgctacgacctccccttcgaccccaccgacgacttccaccactactccn

SEQ ID NO: 70811 - protein, 169 aa, Zea mays
  misc_feature: Ceres CLONE 1551232
  misc_feature (44)..(169): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MASSASCTLLLPTLSLAVILLALCARGGEARPPPPLHGVRPLAFDEGYTQIFGSANLALLRDGRRVRLTLDESTGAGFASQDVFLHGFFSAAIKLPADYAAGVVVAFYLSNGDVYEKTHDELDFEFLGNVRGREWRVQTNVYGNGSTDAGREERYDLPFDPTDDFHHYS

SEQ ID NO: 70812 - DNA, 639 bp, Zea mays
  misc_feature: Ceres CLONE 1551234
  misc_feature: Encodes the peptide sequence at SEQ ID NO. 70813
cgattgggtacgggccccccctcgagccctgcagtggtaaaggggctcgttcttcctcttctcttctttgcgttttgggccggttttctgcatccacgattttgtggagtttgatcgtctcttaccaagaggggtgtaaccttgtttcatttgcgaaatttgagggcaccttgaagttgtttcgatcgctgggttgctttactcaggcttagttcatgggtgttcgtgtttttgagtattctttatttggtgttggcagattgccctggaacgcagtcggaggaggcggggaaggcggatgcctgcgctgggtgccccaaccagcagatttgcgccaccgcccccaagggccccgatcccgatgtggttgctattgttgagaggttggctactgtgaaacacaaattattagttttgtctggaaagggaggtgttggaaagagcacattctcagcccaactctcctttgccttagctgaaatggaccatcaggttggccttcttgacatagatatatgtggccctagcatcccaaaaatgttaggcctcgagggacaagatattcatcagagcaaccttggttggtcacctgtgtatgtcgagtccaaccttggcgtgatgtcgattggtttcatgctg

SEQ ID NO: 70813 - protein, 53 aa, Zea mays
  misc_feature: Ceres CLONE 1551234
MDHQVGLLDIDICGPSIPKMLGLEGQDIHQSNLGWSPVYVESNLGVMSIGFML

SEQ ID NO: 70814 - DNA, 648 bp, Zea mays
  misc_feature: Ceres CLONE 1551238
  misc_feature: Translation starting site: 365
  misc_feature: SWISSPROT Homolog: EC 2.5.1.6 Methionine adenosyltransferase
ccaattgggtaccgggccccccctcgagccactgcagtggtaaagggcgcgctgctgccgggttggatctgacacgagactgagtgaccatgctcacgaagatgcggagataacaagttaccatctcatcccaactacgcctcgatcggatctcttccgactcagatacgcccgatcaccccgcgccgccacgtataatagaatatggcagctgaccacacattcctcttcacctccgatgccgtcaacgacggacacgctgacaagatctgcgacgaggtctaagatgacaatcctgaatcttgacttcgctgaagacgcatgacagcaaggttgcttcgttagacctgcacccactacccacatggtcatggtcttcggtgagatcaccaccaatgccaatgttcactacaagaacattgccatggagacctgccgcatcattgaatatgtgacgaaaaaggtcgggcttaactgcctaccacagcaaggagatcgtgaacattgagcagctctcccctgatattgctaagggtgtgcaagggcaattcacctaccgccccaaagaaataggagctggcgaccagtgacacatgttcttgcttgccacagattagacacctgaattgatgccactcagacatggcc

SEQ ID NO: 70815 - DNA, 649 bp, Zea mays
  misc_feature: Ceres CLONE 1551250
  misc_feature: Encodes the peptide sequence at SEQ ID NO. 70816
cgattgggtaccgggccccccctcgagccactgcagtggtaaaggagagcgagcagcagtaggcagcggcgcgggcgaggagcagaccagcacccagcagccctcggcggggggcggcagctgcagcttcgccagccgccgcctttccacgtctcctctgcctctcgtcctaatgcccttccgcttctcccccccaccccgctcgcgctcccgcttccgcttcctcgccacttatttcgttccgcacccgcagccgcggccgcgttcgcgttgggggcacgcaatggagtagtacgagaaggtggagaatatcggggagggcacgtacggggtggtgtacaaagcgctggacaaggccaccaacgagacgatcgcgctcaagaagatccgcctcgagcacgaggacaagggcgtcccgtccaccgccgtccgggagatctctctcctcaaggagatgaaccacggcgacatctgcagattacatgatgttgtccacagcgagaagcgcatataccttgtcttcgagtacctggatctggacctcaagaagttcatggactcctgcccggagtttgctaagaaacccactttgatcaagtcatacctctaccagatactccgctggtgttgcgaactgtcattctcataa

SEQ ID NO: 70816 - protein, 64 aa, Zea mays
  misc_feature: Ceres CLONE 1551250
  misc_feature: SWISSPROT Homolog: EC 2.7.11.22 Cyclin-dependent kinase
MNHGDICRLHDVVHSEKRIYLVFEYLDLDLKKFMDSCPEFAKKPTLIKSYLYQILRWCCELSFS

SEQ ID NO: 70817 - DNA, 688 bp, Zea mays
  misc_feature: Ceres CLONE 1551277
  misc_feature (242)..(242): n is a, c, t, g, unknown, or other
  misc_feature (688)..(688): n is a, c, t, g, unknown, or other
cgattgggtaccgggccccccctcgagccactgcagtggtaaagggatttgatcccgcaggccgcagcgcagcggccgtgtccgctgccgccaccagccaccggccacagccaggcagccagctcgcgtcgaagaagacgacgtggcccgccaagctcccctgccaaaagaaacaggagggcccgcgtcgtcgcctagtcggcgcgtggtgggagtggtatggagagggatcccgcaacggnaggtgtacctgctggtccgggtggaattactctgttgcggtcgggtgcaacacctattcatgtgacgattgggctttcccttgatggtggaatgagccttgtctaccggcgtcgcgacgttaacctgcgcggcaaatatatgccccgttaaacccacgggggctttgtaccaaagcttgccataaccaacgcagctacggtatcgatgttctctcctgatgggggcttctggaggaatatacaatgtgttggaactgaaaaaatctggacaaaataaaaccacccttgggggtattgggtaaaattgtcggttacccaatccggccgggtgggtattgccgtctcttattggttgaccagaggcccggggtgtaagctaccccttggaatttttgggggggacaggcacataaacacccttttactgtagatcaacaaaagaaaan

SEQ ID NO: 70818 - DNA, 681 bp, Zea mays
  misc_feature: Ceres CLONE 1551293
  misc_feature (232)..(232): n is a, c, t, g, unknown, or other
  misc_feature (235)..(235): n is a, c, t, g, unknown, or other
  misc_feature (238)..(238): n is a, c, t, g, unknown, or other
  misc_feature (240)..(240): n is a, c, t, g, unknown, or other
  misc_feature (242)..(242): n is a, c, t, g, unknown, or other
  misc_feature (245)..(245): n is a, c, t, g, unknown, or other
  misc_feature (254)..(254): n is a, c, t, g, unknown, or other
  misc_feature (266)..(266): n is a, c, t, g, unknown, or other
  misc_feature (271)..(271): n is a, c, t, g, unknown, or other
cgattgggtaccgggccccccctcgagccactgcagtggtaaagggatttgatcccgcaggccgcagcgcagcggccgtgtccgctgccgccaccagccaccggccacagccaggcagccagctcgcgtcgaagaagacgacgtggcccgccaagctcccctgccaaaagaaacaggagggcccgcgtcgtcgcctagtcggcgcgtggtgggagtggtatggagaggggcnccnccncngncgncgcggggcncggctgcgcccngcgcnccccgtcccgctccgcgccgccggctccccggcgggcgcccgctgcgctgctgccctgggtgcggcctggggcgggccttcgctgttccctcctgtggcccgcgcggagtttctcgccccctcccctggactaagggggtttgtgcggcctggttgtggagccttttcttcgttgtggactgcgggctctataaagcaaacaaaaaggctggacctgactaggtcccccaataaattggtgcacaacgtccaagaaaagttggccccagggtggaagatccttcattttaaaggttctgtctggtgacggcattggggtacaggggaggattgccaatcggttgggaatcaaaaaaggaggtggttttcttttatgtcttttgatttttttcggcgtttaacgaccaaca

SEQ ID NO: 70819 - DNA, 661 bp, Zea mays
  misc_feature: Ceres CLONE 1551322
  misc_feature: Encodes the peptide sequence at SEQ ID NO. 70820
cgattgggtaccgggccccccctcgagccactgcagtggtaaagggaccttcttgagcccgaagcaaaaggcactgctcatcgatccgccaccacgccacaaaatcctctcctactccggcagttctgctcgccgccgcctccacgatgccggaagacgtgcagatgaacgactcggagccccagcctgcggcctcagctcccgccgtcggggcgccggcgctctccacactacaccatctgaaggagatcgcgtccgtgatcgaggccggttctctgtccaaggaggtccgccggatatcccgcgccttccgcctcaccgtcgcgctccgtcgccgcctcgccgcgcgggacgtctccgccttcctcgccttcgcgctacccgcgtcctccgaagcctacggacgcctcactgccctggtgccccaggaggatgatactgagatggatgttgatgctgcagctccagcaactcagatttcaatcaacatggtctccctgagattgaaatatatgctacttgctcgtactgatttttcctattgatcagtagaaatttgttgatgctaagggatgcgcaagtgggggctttgctcccctgaaaacctaaccgggaaacgggttgtggtttgggctcccgattggacttttcaatacctttt

SEQ ID NO: 70820 - protein, 132 aa, Zea mays
  misc_feature: Ceres CLONE 1551322
MPEDVQMNDSEPQPAASAPAVGAPALSTLHHLKEIASVIEAGSLSKEVRRISRAFRLTVALRRRLAARDVSAFLAFALPASSEAYGRLTALVPQEDDTEMDVDAAAPATQISINMVSLRLKYMLLARTDFSY

SEQ ID NO: 70821 - DNA, 657 bp, Zea mays
  misc_feature: Ceres CLONE 1551326
  misc_feature: Encodes the peptide sequence at SEQ ID NO. 70822
cgattgggtaccgggccccccctcgagccactgcagtggtaaaaggaccgccgcagaccgggagtagtcgacgcgccgtcactgaatcctcagatcacggctagccgtaatcacgccactctgctgactcccggcgagccatgggcaaggagaagactcacatcaacattgtggtcattggacatgtcgactctggcaagtcgaccaccactggccacctgatctacaagctcggcggtattgacaagcgtgtgattgagaggttcgagaaagaggccgcggagatgaacaagcggtcattcaagtatgcctgggtgcttgacaagctcaaggccgagcgtgagagaggtatcacaattgatattgctttgtggaagttcgagaccaccaagtactactgcactgtcattgatgcccctggacaccgtgacttcatcaagaatatgattactggcacttcccaagctgactgcgctgttcttatcattgactccactactggtggttttgaggctggtatctccaaggatggacagacccgcgagcatgctctccttgctttcacgcttggagtgaagcagatgatttgctgttgcaacaagatggatgccaccacacccaagtactccaaggcccgttatgatgagattgtgaagg

SEQ ID NO: 70822 - protein, 172 aa, Zea mays
  misc_feature: Ceres CLONE 1551326
  misc_feature (5)..(172): Pfam Name: GTP_EFTU Pfam Description: Elongation factor Tu GTP binding domain
  misc_feature: SWISSPROT Homolog: EC 2.7.7.4 Sulfate adenylyltransferase
MGKEKTHINIVVIGHVDSGKSTTTGHLIYKLGGIDKRVIERFEKEAAEMNKRSFKYAWVLDKLKAERERGITIDIALWKFETTKYYCTVIDAPGHRDFIKNMITGTSQADCAVLIIDSTTGGFEAGISKDGQTREHALLAFTLGVKQMICCCNKMDATTPKYSKARYDEIVK

SEQ ID NO: 70823 - DNA, 456 bp, Zea mays
  misc_feature: Ceres CLONE 1551355
  misc_feature: Encodes the peptide sequence at SEQ ID NO. 70824
  misc_feature (205)..(205): n is a, c, t, g, unknown, or other
  misc_feature (363)..(363): n is a, c, t, g, unknown, or other
  misc_feature (364)..(364): n is a, c, t, g, unknown, or other
  misc_feature (369)..(369): n is a, c, t, g, unknown, or other
  misc_feature (456)..(456): n is a, c, t, g, unknown, or other
ccgattgggtaccgggccccccctcgagccactgcagtggtaaaggagacatgaccaggtgctgggatccaaatcctgatgtccgtccgccattcactgaagttgtgaggatgctggagcatgctgagatggagatcctgagcactgtccgcaaggcccgatttcggtgttgcatgtcccaaccgaatgactaccgactgaatcnaacaagagagtttgaatgaactccatggaagcgtaattgagtgtatttatcatgggtcccaaactccctcactgagtgaaagcaacctgagttattggttgtttgggggtatacccagggggtaaacccctttttttttttttataaaaatatttttnncgggnccctaaaaaaaaaaaacaatttgcctttttaaaaaatctaaaaattttttttggggggaccttctttttttgggtgcgaaaaaaaan

SEQ ID NO: 70824 - protein, 73 aa, Zea mays
  misc_feature: Ceres CLONE 1551355
  misc_feature (68)..(68): Xaa is any aa, unknown, or other
DWVPGPPSSHCSGKGDMTRCWDPNPDVRPPFTEVVRMLEHAEMEILSTVRKARFRCCMSQPNDYRLNXTREFE

SEQ ID NO: 70825 - DNA, 663 bp, Zea mays
  misc_feature: Ceres CLONE 1551386
  misc_feature: Encodes the peptide sequence at SEQ ID NO. 70826
cgattgggtaccgggccccccctcgagccactgcagtggtaaaggagtctcatttcgcaagtacctccaacaaccaccaagcccaacgacgaccccttgtcattggctcttctgcatccacaattccacacatcgctcgccacgcccacacctacccaccactcgatcctaccggctcccacgttccggtctcgccccaatcggccgggccgctacgctccatggcgctcgacctcctccggccaggcgtccccggcatgcagccggtcggcgacctccgcactgccaagtccgcgatcctgttcggggtggtcaacggcctcttcttgccgccgttgctggagccctgcctctgcaccgccagcgccctgtgcgacggcggcggcggcgaccacgcggagcagaggtactaccagctcgcgaactgcgtgctcaccatgctcggcgtcgccctcctgttcgtggacatggcgctgtcgcgggcggtccatcaggcctcgccgctgtggccgcccacgctcagagcgacggtgtggctcaccaagaccttgacctgcggcacgctccaattcggcgtcaacctcgtgtacttctgcctcaagatgctgtgcgctaggctcttgctcgttttcgcctgacttcgttcgccattgttttcactag

SEQ ID NO: 70826 - protein, 138 aa, Zea mays
  misc_feature: Ceres CLONE 1551386
MALDLLRPGVPGMQPVGDLRTAKSAILFGVVNGLFLPPLLEPCLCTASALCDGGGGDHAEQRYYQLANCVLTMLGVALLFVDMALSRAVHQASPLWPPTLRATVWLTKTLTCGTLQFGVNLVYFCLKMLCARLLLVFA

SEQ ID NO: 70827 - DNA, 706 bp, Zea mays
  misc_feature: Ceres CLONE 1551389
  misc_feature: Encodes the peptide sequence at SEQ ID NO. 70828
ggagctccccgcggtggcggccgctctagaactagtggatcccccgggctgcaggaattcgtctcacccctagaaaaaacccacccacccgcctcgcctccatccacagcgaccacgcccatcttcgctctgtccgctcacccccacctctccgcccccgtctccgtccgcacccgtccgcctccgacttccccgtggcccagccggatccggagccgaactcgaccttgttcaggaaggagagcccgaaccgcggcgggcgggagggctctttttagcttgccccgcctgaggccagccgccccatgggccagtcgcctgagcgcgctacgtatcagctcatcgaccggcgggaaggctgtagcgtcggttggacgtcgtgagcgtgcagagcaattaagcaaaccagggcttgggtaaatcattattgaaagcatctcccttttacctgtaaccttgcctacaatatctgttaagatgagttcactaggtaaagttgtttcagatagtggagatgcatgttcagtcttagctagtcaagtcacatcattaaatcccaatgcagcggagtttgtaccgtcatttgttaaaccatcttttggagatgggacagttctagatcagtcagatttcaaggggttcttctggaaaaacaattctagattggccttgagccatccgagtctagtaactcagatgatgaggg

SEQ ID NO: 70828 - protein, 76 aa, Zea mays
  misc_feature: Ceres CLONE 1551389
  misc_feature (20)..(37): Pfam Name: PAM2 Pfam Description: Ataxin-2 C-terminal region
MSSLGKVVSDSGDACSVLASQVTSLNPNAAEFVPSFVKPSFGDGTVLDQSDFKGFFWKNNSRLALSHPSLVTQMMR

SEQ ID NO: 70829 - DNA, 682 bp, Zea mays
  misc_feature: Ceres CLONE 1551390
  misc_feature: Encodes the peptide sequence at SEQ ID NO. 70830
ctccccgcggtggcggccgctctagaactagtggatcccccgggctgcaggaattcgtctcacccctagaaaaagaccctctcctggataggaggagcagcagccagagggacatcaaactgtgctgcctgcgtgtgtgccttctttcttgcctctcccttcttcaacctttgctagcttgccagggagggagagtccatgaattccagcagaagcctcctctcttcgcccctctttgctagctcgtctccaaacttcaggagcagtgcttccgtctcctcctccccatccccatcccgcaccacagttccaatgatacatgacaccagcagcagcagagcatccacggcgtgccactactcgccgtcgcttgtggcagaggagcagcttcacggttccaaagacaccttgaccttgaagggcgagaaggctttgctcgagttgcttctaggcatggctctggaccagcacgttgacggcaggaagctcattacccaacaggaggctgaggatagtgatttcgagagctatttgagagaagcaacaagccgagtgctttaccagccaacattcattgaaagagatgatgatgatgattctgtttcggagagctcttcaccatcattggcccaaacagctgggaactttgaatccttgcaaactaaacaaagaacaccacccc

SEQ ID NO: 70830 - protein, 123 aa, Zea mays
  misc_feature: Ceres CLONE 1551390
MIHDTSSSRASTACHYSPSLVAEEQLHGSKDTLTLKGEKALLELLLGMALDQHVDGRKLITQQEAEDSDFESYLREATSRVLYQPTFIERDDDDDSVSESSSPSLAQTAGNFESLQTKQRTPP

SEQ ID NO: 70831 - DNA, 781 bp, Zea mays
  misc_feature: Ceres CLONE 1551392
  misc_feature: Encodes the peptide sequence at SEQ ID NO. 70832
  misc_feature (781)..(781): n is a, c, t, g, unknown, or other
ccccgcggtggcggccgctctagaatagtggatcccccgggctgcaggaattcgtctcacccctagaaaaagcagacgtcgattagcctgaactgccccgtgtccacctggctctgcacctcctctccctgcgttgtgtcaccgttgacagaagaagcgctcacctatcacgattcgattctgagcttccaagaatcgacggtcaagcttcgtcgaccaaatgatccaattcttagagttctaccagatcgaagatcctgagcatctgtttggtgaaggttgcctttggctgaaactctgctctcgtaaagaagatggagaacagtgtttaggcggattctccaggagttccaagacttcgacgaagctcaggattagggctagggccttcccccccccacggggggggccttggatgaggttgtttaacttgggctacgtcttaaatttggcggaaaattaattttcgtgggaaaaatgaccccaaagttgggagggtgggttcctcacgtctgttgattgtgacaaaaaaaagcactcggagaaaaaccgggggctccaaagaacaaaataaaggaaagcctgcaagctccccccttaggatcctggcccccttttttcttctcgggggggtatagttttcacgatctttgtgtatgcttgtttttttaaggagtaaaccgccaccttaacatagggaaggggaatataagcgcagaatgtttctttcgagaaagtttcccctccttcggaaacccccccctcttgcgggggatgggcn

SEQ ID NO: 70832 - protein, 80 aa, Zea mays
  misc_feature: Ceres CLONE 1551392
MIQFLEFYQIEDPEHLFGEGCLWLKLCSRKEDGEQCLGGFSRSSKTSTKLRIRARAFPPPRGGPWMRLFNLGYVLNLAEN

SEQ ID NO: 70833 - DNA, 722 bp, Zea mays
  misc_feature: Ceres CLONE 1551394
  misc_feature: Encodes the peptide sequence at SEQ ID NO. 70834
acccgcggtggcggccgctctagaactagtggatcccccgggctgcaggaattcgtctcacccctagaaaaagtgcccgcggtgctagtgacggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgacgccgtcgaccccgacgacgccggtgacgccgtcgtcgtcgacgacgccgcgcggcgccggcaacgtgtggcgcagcgtcttccacccggggagcaacctggccacccagggcatgtgcgcctacctctttcgacggccgcagcccaactcccccaccgtctacgactggctctacagcgacgagaccatgagctaccaccgctagatcgggcgagatggatggacagtgaagaggccatgtttgctgggcccttgtgttatctaaaagcacgcatgctctattatagctagcctccaccatttatatacttggggttggggaataggtggttctggtccggcgggggccacgccccttttaatttgaccttgtttttgaagggaagggtttattgggccgcccccccaagtatttagaggtgg

SEQ ID NO: 70834 - protein, 115 aa, Zea mays
  misc_feature: Ceres CLONE 1551394
  misc_feature (5)..(115): Pfam Name: Auxin_repressed Pfam Description: Dormancy/auxin associated protein
MLDKLWDDVVAGPRPETGLEKLRKATTARPLVINKDADGGSYKRAQSTPSTPTTPVTPSSSTTPRGAGNVWRSVFHPGSNLATQGMCAYLFRRPQPNSPTVYDWLYSDETMSYHR

SEQ ID NO: 70835 - DNA, 719 bp, Zea mays
  misc_feature: Ceres CLONE 1551395
  misc_feature: Encodes the peptide sequence at SEQ ID NO. 70836
ctccccgcggtggcggccgctctagaactagtggatcccccgggctgcaggaattcgtctcacccctagaaaaagagacgcggacaagtctctgccacctcaccacgggacccagcctgcctcctcttctctctcacggctgacgactgaggcgaaccaaccaaccgtctctccacatacactcgggtgccaaagtacttcttcaggttcttcgacccgaaccaacccccattattccattatagacgtctgcgatgcagacaatggatgcgactaccaggacttttccactcggatgtagtactccacctccatcttgggggggtgtctcccggctgaagctggtcctaccgcctccctcaggggagacctgctggttgtgcccacaagatccgatcctcagcctctcgggtcggatgagcatctgacactctgagggtaacgaataccaggcatcatagctgtacaacctgatctcccatcattccacccttgtcatctgactattccatctgggaagattcgctgagtcgctccttttaggcttgtcattttagtagagaaaagctacgataactctaggtgctttctgcacgatctcatcatacttgcaccagctatgatgcagctcaagactcctgcatagaccaagctctatgcagggctcatgacacatgcagatttggatccatactgtgatctagtaccaggctcgcctg

SEQ ID NO: 70836 - protein, 57 aa, Zea mays
  misc_feature: Ceres CLONE 1551395
MQTMDATTRTFPLGCSTPPPSWGGVSRLKLVLPPPSGETCWLCPQDPILSLSGRMSI

SEQ ID NO: 70837 - DNA, 709 bp, Zea mays
  misc_feature: Ceres CLONE 1551397
  misc_feature: Translation starting site: 435
  misc_feature (635)..(635): n is a, c, t, g, unknown, or other
ctcaccgcggtggcggccgctctagaactagtggatcccccgggctgcaggaattcgtctcacccctagaaaaagccgagctcagtagcgagagcttgtaacctaagcgggggcattaaggtggtgtggatgtttcctgacggattctgggcctgggcctgtatgtgccactggccggcctgcccgttccaagttggttgtggctggtggggctcgggcgaaggcctgggcctctttagacctgaagcggcaggcatggcgtgaggctggcttcacagagcagcgatcactgcccgcttccaacggtgggaggataacaggccgctgcattgcaagcccaactcggtccagagcctcattaaacagaaaactggtaccatccgccgccgcagccatccgcttgttctcttcggttcagttctcgagtttccaggatgaaggtaatagctgcctatctgcttgctgttctgggtggaaacacttccccgactgctgatgatgttaagagcattctggaatcagttggtgctgaagctgatgaagaaaactagagttcctgctcacagaactcaaagacaaggaccatacagaagtgattgcagctggaagggaaaggttatcctctgtgccttcangtggtggtgcaattgacatgggagctccagcagctgtagctggcggtggcgcagcacctgctgaagagcaaaga

SEQ ID NO: 70838 - DNA, 733 bp, Zea mays
  misc_feature: Ceres CLONE 1551399
  misc_feature (411)..(411): n is a, c, t, g, unknown, or other
ggagctccccgcggtggcggccgctctagaactagtggatcccccgggctgcaggaattcgtctcacccctagaaaaaatacggaggcagccgccggtaagccgcgcgcgcgtgcagtcacccatccgtccgtccgtccgtccgtcgtccgccgtccaccgccagcgcgcgctcgccaccgcacccagctagcagcacaagaaaagtctggtggcgtcggcggcggcggcggcggccggcttgccacagtccaatccttggaccggccaaaaagcagttgaaggcgcgagcgagcaagctagcgcgcccttcgtcgctacgagcctacgacgcgcgatcgagccgggcattgctgacctcgagttaagttgggcgaggagaggtggttcattccagcagggatcccccacntgagcccagtcgatctgaccgtccttggtatctgggggggttgttctgtactctctctttaatttgtgagtcgtgacaggttcttgaggtgcaattgttaagagttttagttgtaaaggaagaaagggattggctaatatggcgttggcagggaccttccaaagtagtggctgggatgtatccgcctttgggattttctgggtgaatggccgtctttcccccccgtcccggttcaggcctggttgggcagcaccgcctggggtccctcccttggggcaaatgcaaagggtcccggttccccggtcttttccccgggaggaac

SEQ ID NO: 70839 - DNA, 713 bp, Zea mays
  misc_feature: Ceres CLONE 1551400
tccccgcggtggcggccgctctagactagtggatcccccgggctgcagaattcgtctcaccccctagaataaacctcagactatctcgtcgcttccgctccacatgatcttctgcgccacctacaaccgtgcgaccgtctcgtgctgccggcgactccgatccgctgacccgtcccgtcccactacaccttaccgccgctcgcagctatgtcaccttcggagcctacgcgagaggaggagcgtgtacatggtcaatctggcatatctagcgtatcggtacgaggagatggtcgagttcatggagcgcgtctcgcgctcctcctgcggcgccggcggatggtaggagctctccgtggacgagcgcaacctgctgtccgtcgccctacaagaacgtcatcggcgcccgcatggcctcgtgtcggatcatctcctccttcgagcattacgacgagggtctcgcgtaacgaggctcacgccgcctccatccgagcctaccgctccatgatcgagaccgatctcgctccgcatctgcgacggcttcttcgcactgctcgagtctcgcctcgtccgatcagcttgcggattcgagtccaaggtcttctacttcaagatgaggggtgactaccacgtgtaccttgctgagctcatgtctgtgcactatagatggagctgctgatacttcatgaatgtctacgagctgctctagctgcaca

SEQ ID NO: 70840 - DNA, 729 bp, Zea mays
  misc_feature: Ceres CLONE 1551406
tggagctccccgcggtggcggccgctctagaactagtggatcccccgggctgcaggaattcgtctcacccctagaaaaactccttttccgctccagacacagcagcccctcttgtaccagtaaaccgtgctgctatcccccgctagccgccgcgctgctgcggctcgcctccctcctccccagtccccacgccccgccgccgccgccgccacctcctctcgctccctccttttaccccgagcttaagctcgcgcgtacctgcctacctatccgtacgagaggaagaggggacaaggcccggtcggtctgtcggtcggtcggggggctctctgatctcgccgctgcctccccagacattcgttcgttcgttgggatctcgcgccatggccgccgtcgcgccacccacggcccctgcgcctgcatcggttcctgctcctgctgctgccagcggccctgtcgcggatcgtatccttcgttcgctgccgtgcgccataagttattgacttccggggatttcgctgcttgctcccgcgcctggtcaaaaggtttatttgccttgctaagtacttgaacgttagctgggtagggggaaaaaaggggttttcccttccaattggggcgtgcaaaaggaaaccctgggaaaagggctctgaccaaacgggaaacccgcctcttttaccatttacaacgggaaagaacacaaagggagaaatcctttttcttttaccg

SEQ ID NO: 70841 - DNA, 712 bp, Zea mays
  misc_feature: Ceres CLONE 1551407
tggagctccccgcggtggcggccgctctagaactagtggatcccccgggctgcaggaattcgtctcacccctagaaaaaaatcaaaccgagctcaggtcatacctcaacgcaccatggccgatcgcatggtcgcaactcgctggagaagagttataacacaggacaaccccggccccggggggcaggcctcggaatcttgcgtgacacggcggccagttctgtcaatgctgccctccctcctcccctctgggggtggttgacttgtacgcatcacggctagcgttccagccccccggcgcggacccagatctgcacaagtggagcccacggggaccgtggcctccgctgtcgcgaccagccccgctcctcacaggggccgcggtgcgctgccctctgcagaaggaagcccctcagatatagtcttcgacgctctcggcggccacctctgaaccgcctctgtctctcacctgcttcctttcccagcaattagtccagttcggctactccctcggaccccgacgagttctgaacgcgagagtaactgacagacatattggcatggagatgaagctgaccatctggacggtgcccgcctacttctccgctactcgggagacgccaactatccgcgcacgcgttgactgatgagatgcctcggcgactgctgtgcgtctggtttcaagctacgcttatactcgttctacttgagtc

SEQ ID NO: 70842 - DNA, 688 bp, Zea mays
  misc_feature: Ceres CLONE 1551408
  misc_feature: Encodes the peptide sequence at SEQ ID NO. 70843
  misc_feature (656)..(656): n is a, c, t, g, unknown, or other
  misc_feature (688)..(688): n is a, c, t, g, unknown, or other
ctcaccgcggtggcggccgctctagaactagtggatcccccgggctgcaggaattcgtctcacccctagaaaaatcaagtttaggaaaggaagcaccggagcaggcgaaacggcgccgacgacaatggcagcaacaagggcttccccggtgcttctcttgctgctgctcaccgtccagctgagcttgctcttccgcctccccgactccccctccaccctcgccctcgccctcgccctcgccgcggaaccagaccaacagaacgccaagcagcatcgccagcccgcgctgctggtgcagtcgacgtgcaactccaccagcttctacgacctctgcatcgccgcgctcgccgccgaccccgccagctccaccgccgacgtcccgggcctgggcggcatcgccctgtccgccgccgcaaacaacgccctcggcacgggcgcctttcctcggcaacgcagcgacgccgcggccaccccgcagggggaccgggggcttcttcgggcctgggccgggaaatacgccccccgcccgcgacgcgctcgtgcagggcccccccgtccctccgcgaagaaggcctacaacttctccttcttgcacgtgaaccccccccgggaaataccccccggggtgccccacgcttgttccggccccggagcanaaaaaggggggggggaaaaaaaactccctacn

SEQ ID NO: 70843 - protein, 188 aa, Zea mays
  misc_feature: Ceres CLONE 1551408
  misc_feature (178)..(178): Xaa is any aa, unknown, or other
MAATRASPVLLLLLLTVQLSLLFRLPDSPSTLALALALAAEPDQQNAKQHRQPALLVQSTCNSTSFYDLCIAALAADPASSTADVPGLGGIALSAAANNALGTGAFPRQRSDAAATPQGDRGLLRAWAGKYAPRPRRARAGPPRPSAKKAYNFSFLHVNPPREIPPGVPHACSGPGAXKGGGEKKLPT

SEQ ID NO: 70844 - DNA, 697 bp, Zea mays
  misc_feature: Ceres CLONE 1551410
  misc_feature: Translation starting site: 154
aagctggagctccgcgcggtggcggccgctctagaactagtggatcccccgggctgcaggaattcgtctcacccctggagaaaatcccctgctcgattctcccccgccgattatcccttcccgtgctccgcaaccgcttgatgagatgaatatatggccggcattggcgatggcccggctatcggcatcgatctcggcacgactgtctcttgcgtcggcgtgtggcagctccaccgcgtcaagatcattgccgacgaccgtggttaccgcgccacgccctcagtcttcgccttcaccgactcctgagcgcctcatctgatatgcggccttgaaccctgtccccacgaaccccatgcccaccgtcttgcatgccgcccgtctcatctgcaggaggctcagcgtggctcctgtccatgccgagatcgtgctgcggcccctacgcgtcatctctgggcctgtcgagaatcccaagaatgtcgtccttcccacaggtgtggcagctctctttgcacctgacgagatctccggcatcgctcttatcttgatagctgcgcttgctgtagctggcttagcagccatatcaagacgctgtggtcgctgtccctgcggacatcatgactcacagagcacgactcgacgatgctggtgtcatcgatgactttatgtgctgcgtatcatcaaccagcacactttgcat

SEQ ID NO: 70845 - DNA, 724 bp, Zea mays
  misc_feature: Ceres CLONE 1551411
  misc_feature (400)..(400): n is a, c, t, g, unknown, or other
  misc_feature (517)..(517): n is a, c, t, g, unknown, or other
  misc_feature (540)..(540): n is a, c, t, g, unknown, or other
acccgcggtggcggccgctctagaactagtggatcccccgggctgcaggaattcgtctcacccctagaaaaaccccgccccaccaaacactcccgcagacccacccgtccccgtccgtccacagccagctccgcctcccatccagcgcccgtccacagccaccacagttccagtgagatcgagcgaggtaagcttagatctgagcgatttctctcgcgcgtcgcaggtaaagttcactcgacttcgactctctcatcctcttctgttcttcctggttccgtcttcttcctcgagcagacagcgagagacccgtggccttttagatcccgggcttcagatctgctgtttcttcttcggtttggttctagttctagcagtgtactactactagtcgttaggntggtagccaagagaggttctttttcacacctcccttgcgcaagtgagtcctgtcctgagcggatctacccacactggcatctgttttttactgtggctgttggggtccgccagtttncctcgttggtccttggtttgctngggggggggaaaacaaaaaccaaaaaaaccggctaaagggtggcgggctaaaatctggcagggaaaggaacttataaaaacccccagccttttatccgggaagcccttgggcccgggaatcattccggtcccccccccgcaaaaaaaattagccctttgtgcggttttcctttccccagggggg

SEQ ID NO: 70846 - DNA, 738 bp, Zea mays
  misc_feature: Ceres CLONE 1551412
  misc_feature: Encodes the peptide sequence at SEQ ID NO. 70847
ctggagctccccgcggtggcggccgctctagaactagtggatcccccgggctgcaggaattcgtctcacccctagaaaaaaaaaaaggtgccaccctccccaagccctcgcgccgactaaaaaggcgacccctcgaccgtgggaacgagcaaaggacaaatatcctcgctcgcagtcgcagctactacgccgccgcacctccgcccgccaccttcttcccgggtccagcgatgtcgggggcgatcgggggcgccgaggtccacggtttccggggcgcagcggcacagctcccgcggtcccgggtgctcgggaggccgatccgggtggcgccacccgccgcggcccggccgggcggtgcgtcctcgggtagcatacccgccgtctccgcgcctgctaagaaggacgcttctgaagttaagcgaagcaaggttgagataatcaaggaaaagagcaacttcctccggtaccctttgaacgaggagttggtctcagaggccccaaatatcaacgagagtgctgttcagctgatcaagtttcatggaagctaccagcaaactgaccgagatgtccgtgggcagaagaataactcgtttatgctccggacaaagaacctttgtgggaaagtgtcaaaccaacttttatctagctatgggatacactagcttgatgagatttggcattgggaacatgtcggcctgacgaccaagcaaaaatttccagttgggggggtgttcttta

SEQ ID NO: 70847 - protein, 143 aa, Zea mays
  misc_feature: Ceres CLONE 1551412
  misc_feature: SWISSPROT Homolog: EC 1.8.7.1 Sulfite reductase (ferredoxin)
MSGAIGGAEVHGFRGAAAQLPRSRVLGRPIRVAPPAAARPGGASSGSIPAVSAPAKKDASEVKRSKVEIIKEKSNFLRYPLNEELVSEAPNINESAVQLIKFHGSYQQTDRDVRGQKNNSFMLRTKNLCGKVSNQLLSSYGIH

SEQ ID NO: 70848 - DNA, 693 bp, Zea mays
  misc_feature: Ceres CLONE 1551414
  misc_feature: Encodes the peptide sequence at SEQ ID NO. 70849
ctggagctccccgcggtggcggccgctctagaactagtggatcccccgggctgcaggaattcgtctcacccctagaaaaaaagcccggccaccaccgtacacccaaaccccatcccatccccccgaacgcagaagatcccgtgccaaccaacggcggcggcggcgacggtgtgtggactctagactaggagccaatccaagccatccacccgtagccccgccccgctgccggcaatggcgcggctcgtgctctccgagtgctgcggcctcgcgccgctgcgcctgcgcgccggccggggcgccattgcggcgccgtcgccccccgcgctctccgcagcggcggcgccgggccgccccgcgcccgcgggcatccaccgtgactgggcgctccgcgtctccgcgcccacccgcctcacctccgccgtcgaggaggacaagaggagctccccccttggggagggggacgagcacgtggcggccagcggcgccgcgggcggggagttcgacccgggggcgccgccgccgttcgggctggcggagatccgcgcggccatccccaagcggtgctgggtcaaggacccctggcgctccatggcctacgtgctgagcgacgtcgtcgtcttcctggggctcgccgcggccgccgcgcgcctcgacagctggctcgtctggccgctctactgggccgcgcag

SEQ ID NO: 70849 - protein, 153 aa, Zea mays
  misc_feature: Ceres CLONE 1551414
  misc_feature: SWISSPROT Homolog: EC 1.14.99.33 Delta(12)-fatty acid dehydrogenase
MARLVLSECCGLAPLRLRAGRGAIAAPSPPALSAAAAPGRPAPAGIHRDWALRVSAPTRLTSAVEEDKRSSPLGEGDEHVAASGAAGGEFDPGAPPPFGLAEIRAAIPKRCWVKDPWRSMAYVLSDVVVFLGLAAAAARLDSWLVWPLYWAAQ

SEQ ID NO: 70850 - DNA, 678 bp, Zea mays
  misc_feature: Ceres CLONE 1551419
  misc_feature: Encodes the peptide sequence at SEQ ID NO. 70851
ggagctcaccgcggtggcggccgctctagaactagtggatcccccgggctgcaggaattcgtctcacccctagaaaaaatgttttttggcagctttctcagtgaatcagtatcaccgcagaacctttttggacacccagatgtcgagagatgcccatttctgaggaatatcaatggagctacaaccttttccctctcttctgctttgccagtagctgctcaaggaggcaagggtccaatttttgaggaagggtcaggctttgagtcagcattcaagcttttccatggccgagatggaatagttcccctttcagaaagatcatatgtatctgatgaaaaccacaatgagagcattgacgtcaagttatatacttagttaggctcaatttagagtacacttatgtagagtacacttatttatattgaaccgtcggagttcctacatatgtatcaagttatatacttagttaggctcaatgttagcatcaacagttgatgagcaactttaaatttagagtacacttatgaatgagttatttgacaatgcttatttatgaaaaaaaaaaaaaaaacgagacgctcgaggtacccattcgccctatagtgagtcgtattacgcgcgctcactggccgtcgttttacacgtcgtgactgggaaaaccctgcgttacccaactaa

SEQ ID NO: 70851 - protein, 98 aa, Zea mays
  misc_feature: Ceres CLONE 1551419
MFFGSFLSESVSPQNLFGHPDVERCPFLRNINGATTFSLSSALPVAAQGGKGPIFEEGSGFESAFKLFHGRDGIVPLSERSYVSDENHNESIDVKLYT

SEQ ID NO: 70852 - DNA, 773 bp, Zea mays
  misc_feature: Ceres CLONE 1551420
  misc_feature: Encodes the peptide sequence at SEQ ID NO. 70853
ctagaactagtggatcccccgggctgcaggaattcgtctcacccctagaaaaagtcctcctcttcggattagcgcggccagagagagatgcgggtgggagttgggatacctcggaggcggcgacaacaggatcgcagtggtcagtagccgggtcggccggtggccgcagattctcaccagtggcgccatccctcgccgtcgcccggtgctccagcccagggcaggagaggaggccactctgactgtcactctgagcttcgcgtcacctgagtacatgacggacgacatgggagaagttgaggacatgtacacccaagaaggggaccgtcggacatgaaagggaatctcgtccgtgaagaagggcaccgggcaattggaagaacccccgcccctacatctcttcccgaaatgagatggctgcgaagaggcttgggctttactattgggtcctggagcaaacaacccctgggtggaaacttagcatgaaagaccccgtgtttgggccaaggttgcaaactccgttctgcttcccaaaccaaccgttccaaccaacatgtgaaagggcgaccgtgcctaacttcaaggccggctcattcgggcggcccttccttcccccgaaagcctttggatgggggaaggttttctgggaaccatcgagggatcttgcttggaaccattctaacgattttccggggcttgggcgcctcgcctcacaaatgaaccctccctccgggtgaaaagggggcttggcttccctcaactcctagggacgg

SEQ ID NO: 70853 - protein, 107 aa, Zea mays
  misc_feature: Ceres CLONE 1551420
MAAKRLGLYYWVLEQTTPGWKLSMKDPVFGPRLQTPFCFPNQPFQPTCERATVPNFKAGSFGRPFLPPKAFGWGKVFWEPSRDLAWNHSNDFPGLGRLASQMNPPSG

SEQ ID NO: 70854 - DNA, 732 bp, Zea mays
  misc_feature: Ceres CLONE 1551429
  misc_feature: Encodes the peptide sequence at SEQ ID NO. 70855
  misc_feature (732)..(732): n is a, c, t, g, unknown, or other
ggagctcaccgcggtggcggccgctctagaactggtggatcccccgggctgcaggaattcgtctcacccctagaaaaaatctcgcctcccccacagcatcggagaacggagggaaccagggagctccggccgcctagaaccggagctcccaaatagatcgatccatccgtcgttgagcggacacggcaatggaagcccacgcctcgcggggccgccgcaccgtatgcccccttctcgtttttttctttatttcgacccttttttgaatgagatggcgcgcagatccgtgttcccgctagtaccagacttgagatctgagacccgaggtcccaattatgtcaatcttgtgcccgtatttgtggcagctggaggagatccggcagaagagagccgccgagaggatgcagcacgccctcccgatcgcggcgtctcacgtcgactctcacgggaaccaaagagccggagctgagcttcttgctcgagttcaagaacttgaaaatgggaacacggaattggtgagggaaaacaaaatgctcttgtccaagattgatgagaagggagttgagaaggatgcccttgtaaacggtttgaatgatctcgagcggaatgtagttccctctttgaaaaaaaacttgaatgacatttctttggagaaagatgctgctgtagttgctaaggaagatgctctagctcaactcaggagcatgaagaaaccgctcaaggaagcaaaan

SEQ ID NO: 70855 - protein, 132 aa, Zea mays
  misc_feature: Ceres CLONE 1551429
MSILCPYLWQLEEIRQKRAAERMQHALPIAASHVDSHGNQRAGAELLARVQELENGNTELVRENKMLLSKIDEKGVEKDALVNGLNDLERNVVPSLKKNLNDISLEKDAAVVAKEDALAQLRSMKKPLKEAK

SEQ ID NO: 70856 - DNA, 493 bp, Zea mays
  misc_feature: Ceres CLONE 1551444
  misc_feature (245)..(245): n is a, c, t, g, unknown, or other
tggagctccacccgcggtgggcggccgctctagaactagtgggatcccccgggctgcaggaattcgtctcacccctagaaaaactgtccgctcacccccacctctccgcccccgtctccgtccgcacccgtccgcctccgacttccccgtggcccagccggatccggagccgaactcgaccttgttcaggaaggagagccccgaacgcggcgggcgggaggctctttttagcttgccccgcctgnaggcagcccgccccatggggccagtccgcctgagcgcgctacgtataagctcaatcaaccggcgggggaagggcttggggtaaatccttttttggaaagcctcctccccttttttaaaatgggaaacctttggccataaaaatattatctggttgtaaaaaaaagagttccccccaaaaaaaaaagggtgtttttcccaaaaaaaggggggggaaaaacccccttttttttccccccccccctccctt

SEQ ID NO: 70857 - DNA, 664 bp, Zea mays
  misc_feature: Ceres CLONE 1551445
  misc_feature: Encodes the peptide sequence at SEQ ID NO. 70858
  misc_feature (215)..(215): n is a, c, t, g, unknown, or other
  misc_feature (349)..(349): n is a, c, t, g, unknown, or other
ctccccgcggtggcggccgctctagaactagtggatcccccgggctgcaggaattcgtctcacccctagaaaaaaccgagttcgtcggtcgtcacctgatattttttccgacggacacacaagcatatatacatacacgccgacatagggatgatggcttcctctagtcctcagcgtgcagccggcgccgccgtcgccggcgtgctgctggtggnctgcgctgccgccctgtgctcgtgcggcgccatggcgcagctgaccgcggactactacgactgcacatgccctgacgcctacaacatcgtgaagcaggtcctgatcgaggcgcacaagtcacgatcgtgcgcantctgacgccagacctcaccccgtcctccactttcacgactggcttcgtcccagcgctgcgatgggctcggtgcttcctggacgccgttccgggggggcgccaactccactgaagaagctggcgccggccaaaaaacaaactcggcccgagggttccccggttggtggacaaaatgaaaagccggccctggaagaacccctgcccccgggtttttttctggggccaaaaattcttctccctctcccaaaaaaattccgggggcaaaagggggacctaaccggccccgcgcggagaaaatttttttccccccgtggg

SEQ ID NO: 70858 - protein, 66 aa, Zea mays
  misc_feature: Ceres CLONE 1551445
  misc_feature (22)..(22): Xaa is any aa, unknown, or other
MMASSSPQRAAGAAVAGVLLVXCAAALCSCGAMAQLTADYYDCTCPDAYNIVKQVLIEAHKSRSCA

SEQ ID NO: 70859 - DNA, 663 bp, Zea mays
  misc_feature: Ceres CLONE 1551449
  misc_feature: Encodes the peptide sequence at SEQ ID NO. 70860
  misc_feature (663)..(663): n is a, c, t, g, unknown, or other
ctccccgcggtggcggccgctctagaactagtggatcccccgggctgcaggaattcgtctcacccctagaaaaaaatgtcaaatctctcgcgagcgaggcagacccacgggccgcggccatctcacggtggaagcagccaagcagccggcctggcgcccctccccttccgtcccgccgctgctgccgtgcctcgtgcctgccagcggcggatgccgccccgccccgctgctgaccaccgccgctgctgagcatggccgccgctcccgcgggcgctcagaaccgctgcgtcttcgttggcaacataccatatgatgcgacggaggagcagctcgtgcagatttgcgaagaagtcggcccagtcgtatccttcagattggtgattgacaaagagaccggcaagccaaaaggttatggcttttgcgagtacaaggatgaggaaactgctttaagtgcacgccggaaccttcagggttacgagattaatggtcgtcagttacgtgttgattttgctgaaagtgggaggaacactgatagaaatagagaaaagggtcgtggaggaccagggatggcatctaatggttggtttggttttttttgttcaccatttagtttatgtatattctttcaatttctatgcgtattttatgtttatggatgctatn

SEQ ID NO: 70860 - protein, 137 aa, Zea mays
  misc_feature: Ceres CLONE 1551449
  misc_feature (13)..(84): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAAPAGAQNRCVFVGNIPYDATEEQLVQICEEVGPVVSFRLVIDKETGKPKGYGFCEYKDEETALSARRNLQGYEINGRQLRVDFAESGRNTDRNREKGRGGPGMASNGWFGFFCSPFSLCIFFQFLCVFYVYGCY

SEQ ID NO: 70861 - DNA, 623 bp, Zea mays
  misc_feature: Ceres CLONE 1551452
  misc_feature: Encodes the peptide sequence at SEQ ID NO. 70862
acccgcggtggcggccgctctagaactagtggatcccccgggctgcaggaattcgtctcacccctagaaaaaaccaatcgcatcgcagcagcacgagcagcacgccgtgccgctccaaccgtctcgcttccctgcttagcttcccgccgcgccatggcgtcgaccaaggcacccggccctggcgagaagcaccactccatcgacgcgcagctccgtcagctggtcccaggcaaggtctccgaggacgacaagctcatcgagtacgatgcgctgctcgtcgaccgcttcctcaacatcctccaggacctccacgggcccagccttcgcgaatttgtccaggagtgctatgaggtgtcggccgactatgagggcaaaggagacacgacgaagctgggcgagctcggcgccaagctcacggggctggcccccgccgacgccatcctcgtggcgagctccatcctgcacatgctcaacctcgccaacctgggcgaagaggtgcagatcgcgcaccgccgcccgcacagcaagctcaagaaaagggggtccgccaaagaggggctcgccaccaccgagtccaacatcggaggaaacgctcaagcgcctccgtgtccgagggccggaag

SEQ ID NO: 70862 - protein, 156 aa, Zea mays
  misc_feature: Ceres CLONE 1551452
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLGEEVQIAHRRPHSKLKKRGSAKEGLATTESNIGGNAQAPPCPRAG

SEQ ID NO: 70863 - DNA, 662 bp, Zea mays
  misc_feature: Ceres CLONE 1551455
  misc_feature: Encodes the peptide sequence at SEQ ID NO. 70864
  misc_feature (662)..(662): n is a, c, t, g, unknown, or other
tccccgcggtggcggccgctctagaactagtggatcccccgggctgcaggaattcgtctcacccctagaaaaagctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccggggtcgagaagaagcttgaaagcctcccagctatggttagtggggtttattccgatgataataaccttcagcttgaggccaccacacagttccgcaaattgctctctatagagaggagtcccccccattcgaagaagttatcaaaaccaggggtaggttcccagaatttgtgcagtttcctcccccggagagggattttccccccaactcccaattttgaaaggttgcgctggggcttcttcaccaattn

SEQ ID NO: 70864 - protein, 145 aa, Zea mays
  misc_feature: Ceres CLONE 1551455
  misc_feature (4)..(92): Pfam Name: IBB Pfam Description: Importin beta binding domain
MSLRPSERVEVRRNRYKVAVDAEEGRRRREDNMVEIRKSRREESLLKRRREGLQAQVPAPPSGVEKKLESLPAMVSGVYSDDNNLQLEATTQFRKLLSIERSPPHSKKLSKPGVGSQNLCSFLPRRGIFPPTPNFERLRWGFFTN

SEQ ID NO: 70865 - DNA, 584 bp, Zea mays
  misc_feature: Ceres CLONE 1551458
aagctggagctccccgcggtggcggccgctctagaactagtggatcccccgggctgcaggaattcgtctcacccctagaaaaaaccgagcagcaacaagccaacaactaaaggcagggcgcggcacaccgcgacaccgtacccggcctagacacttggagaaaagagaagcagcgcagcggcatgggcaccagtcccgtcatccctgcgacgatgctcgtcgtcgctctccttgtcgctagtagtatgtctgcttcggggccacggcaccgaacccaacccgacggggccattcgtttccccaggaacttttggtgctttttggtcaaacctggggaagtccttttactttttccccaaggaaccttttttaggcccccccggggggctttaacaccttggggaaaagcccccccccctcccaaaatggaagaagtccccggcgggaaaagttttttttccggggagggaatttttaccctttaagccccccggtttacaccccgggggggggggggggggaattttccccccgggaaaggggaaaaccctcccccctctcctttgggaaacctttggtttttc

SEQ ID NO: 70866 - DNA, 677 bp, Zea mays
  misc_feature: Ceres CLONE 1551460
  misc_feature: Encodes the peptide sequence at SEQ ID NO. 70867
tggagctccccgcggtggcggccgctctagaactagtggatcccccgggctgcaggaattcgtctcacccctagaaaaaaccgcatcgaccggacggtctctctctcgtctctcccgacgcgcctccacggccggccccgccccggctcgctagcctcctcccactcccagtaccagcccccgcccctccagcaccaccagcagctcgccttcggaccatgagacgggtcggaggagacctgcagggcgacggcacgacgcctcggtccgcggcggcggggcaggccatgatggagcttcaggccaacgggtcggccgccgtcgggggcgccatggtggtggggctcagcccgctcagcgaggccctgtggcgggacagcaaggcgctcccgccgggggccggccccgccgcgctcatcggcgacgtgtccgccaggctcacgtggaaggacctctgcgtcaccgtggctctgggccccggcaagacacagaccctgctggacgagctcaacgggcactccgaagcccagggcgctgaccgcgcttctggggccctcgggggtcctgcaaattccacccagtttcgaaacccattaaaggaggttttcgcctacaaattcttactttcccgggaaaagtgctacctcaacgggacgcaaaggcccaatgccttcctt

SEQ ID NO: 70867 - protein, 153 aa, Zea mays
  misc_feature: Ceres CLONE 1551460
MRRVGGDLQGDGTTPRSAAAGQAMMELQANGSAAVGGAMVVGLSPLSEALWRDSKALPPGAGPAALIGDVSARLTWKDLCVTVALGPGKTQTLLDELNGHSEAQGADRASGALGGPANSTQFRNPLKEVFAYKFLLSREKCYLNGTQRPNAFL

SEQ ID NO: 70868 - DNA, 687 bp, Zea mays
  misc_feature: Ceres CLONE 1551467
gctctggaactagtggatcccccgggctgcaggaattcgtctcacccctagaaaaagaaagagaggtcgcagacggaacccttccaccctcccgacaccaccttcgattcctctgcgatttccccccgcgcgctcgccgattccttgatcgactcccgcgtgattcgctttctggtcggattctgtctcgcgcaagcattgcagaccggaatccaggccctggcatcaggcttggtcggccccgagtacggcgcgaggagagtatctgcgtgggggaagcccggttggtgcgcctcgggttggtatgcccgagcgacatggtgtggtgcgggcacagagccgggtcattccaagccggggacacggctccgatgcctggggcgccttgatcttagacgagggtaggtgggggcggtgggcgcccccgcacggcctgggtgctgacggtcgcccgccgggggcgcggtcgtacgtgtgcgagggaaaataggcaagcgagactgctgcttagtaagcaccattgttcgtagggggttggaccaccgcggggtcctctgcccgtctctgggctagtccgttttggggctgggccaggatgatacttgtagggcgggtcgcggggggggaagccccgggtgggcgtgtgggcggcagcggcgaggggcgggtggaagggtgagatacgtc

SEQ ID NO: 70869 - DNA, 656 bp, Zea mays
  misc_feature: Ceres CLONE 1551469
  misc_feature: Translation starting site: 245
  misc_feature: SWISSPROT Homolog: EC 3.6.5.5 Dynamin GTPase
ctccccgcggtggcggccgctctagaactagtggatcccccgggctgcaggaattcgtctcacccctagaaaaaacccgcacagattcggctcaacaggcaacagcaccagcgctcgaacgccgcgtccaggcaacccatccttccgaccccgagcgatcccgccgcctcccgcgtctagccgtcgacgagcaccgcagcctgacacagccgcgggcgaaccatcgcgtgcggcctcgcccgggatggcgaccatggagagcctgatcgggctggtgaaccgtatccagcgcgcgtgcaccgtcctcggcgaccacggcggcggcggcggcgagggctccctctgggaggcactcccctccgtcgctgtcgttggtgggcagagttccgggaagtcgtcggtgctcgagagcatagtgggggagggacttcctgccccgtggatctggcattgtcacgaggcggcctttagtgctgcagctccacaagacagatggtgggcacgagtatgctgagttcctccacgccccgcggaagcgtttcaccgactttgctgctgtgaggaaagagattgctgatgaaacagatcgcataactgggaaaactaaagctatttcaaacgttcccatccatttgagtatatattcaccacatgtt

SEQ ID NO: 70870 - DNA, 676 bp, Zea mays
  misc_feature: Ceres CLONE 1551470
  misc_feature (360)..(360): n is a, c, t, g, unknown, or other
  misc_feature (361)..(361): n is a, c, t, g, unknown, or other
  misc_feature (398)..(398): n is a, c, t, g, unknown, or other
  misc_feature (428)..(428): n is a, c, t, g, unknown, or other
ctggagctccccgcggtggcggccgctctagaactagtggatcccccgggctgcaggaattcgtctcacccctagaaaaagccttcctctctctctctcgcctcttcttcttcttcctcccctccccttctccccccatctgcggcggggttgattcgatttcgattcccttccccatccatcgcccacctcccctacagacagccaacgcaatccgctccccgaggcgcctccctgaccctgactccctccaccccacaacgtgcgcgctcactcgcgggcggggccgggccgggccggcaggcacactcaccgtcaccacccttattaattcctcttccgcgtccgcgcttcaaaccnntctcccgtcctccgcctcgtcccccctctaccactcntccccagcacccgggcggccgcattgctcngcgcagcaccgtgtccgggtagggcccctctgggcctctgcatttcgattgcctcccctgcctgtgctttgggcttggcccgtttccaaggagggggaagggaaggaagaattttaatttggttccggaggggaaaaatttggccggaaacgggggtcccgggaaaccaccgaatcgcgaaaaatcaggggtttggcgggaaaccccagttccccctttggggcctccccccctacccgggggggggg

SEQ ID NO: 70871 - DNA, 646 bp, Zea mays
  misc_feature: Ceres CLONE 1551472
tggcggccgctctagaactagtggatcccccgggctgcaggaattcgtctcacccctagaaaaaatgccgtaacccgcaggctcccggcatctcgctcttgcctccaaaattcaccttcgccgatttccgccgtgggccgccgcgatggcgttgcggacgcctcgtaccacctccgtcgcattctccgctgactcccccctcggcggcgtcccaatacgctcctcaacagcctgctccgttcccacgccacctcctctcgctccgctgtgaccaccgaggaccaccagagcgggacgccgcggaactcgtcggccacgtcctggccgtcgcgcatgctgacgacgaggctgttgccctcccgggcgccctcggcgcggagctcgcacgcgtcctgcgagcgcgcggcgccgctgaggtacgccttcacctcctcgtaggtgttgtcgttgtcggagacggggccatagcgtgagtagcgcacctcgccgccgggctccgagatgtcgatggtcacgtaggggtccacgacgttgagcaggcaccgggcgcgccggcggaggaacaagttgaagtaggtccggaacagaggacagggagggacctaaaattcaagcccaaaggaccaaagcccgaagtttcttttct

SEQ ID NO: 70872 - DNA, 649 bp, Zea mays
  misc_feature: Ceres CLONE 1551474
  misc_feature: Encodes the peptide sequence at SEQ ID NO. 70873
  misc_feature (505)..(505): n is a, c, t, g, unknown, or other
ctccccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaagacggcggcgaaggccaagccagcggcggcgtccgggagcccgtggtacggccccgaccgcgtgctgtacctgggcccactgtccggcgagccaccgagctacctgacgggcgagttcccgggcgactacggctgggacaccgcggggctgtcggcggacccggagacgttcgccaagaaccggggagctggagtgatccactcccgctggggcatgctgggcgcgctcggctgcgtccttccccgagctgctcgccngcacggcgtcaagtcggcgaggccgtgtggttcaagccggctccaaatcttcagcgagggcgggctggaatacctcgggaacccgagcccctccacccgcaaagcaccctgctttttgggcctgccagtccggcccatgggccc

SEQ ID NO: 70873 - protein, 168 aa, Zea mays
  misc_feature: Ceres CLONE 1551474
  misc_feature (65)..(156): Pfam Name: Chloroa_b-bind Pfam Description: Chlorophyll A-B binding protein
  misc_feature (121)..(121): Xaa is any aa, unknown, or other
MASSTMALSSTAFAGKAVNVPSSSAFGEARVTMRKTAAKAKPAAASGSPWYGPDRVLYLGPLSGEPPSYLTGEFPGDYGWDTAGLSADPETFAKNRGAGVIHSRWGMLGALGCVLPRAARXHGVKSARPCGSSRLQIFSEGGLEYLGNPSPSTRKAPCFLGLPVRPMG

SEQ ID NO: 70874 - DNA, 601 bp, Zea mays
  misc_feature: Ceres CLONE 1551481
  misc_feature: Encodes the peptide sequence at SEQ ID NO. 70875
  misc_feature (138)..(138): n is a, c, t, g, unknown, or other
  misc_feature (152)..(152): n is a, c, t, g, unknown, or other
  misc_feature (169)..(169): n is a, c, t, g, unknown, or other
  misc_feature (182)..(182): n is a, c, t, g, unknown, or other
  misc_feature (191)..(191): n is a, c, t, g, unknown, or other
  misc_feature (192)..(192): n is a, c, t, g, unknown, or other
  misc_feature (213)..(213): n is a, c, t, g, unknown, or other
  misc_feature (221)..(221): n is a, c, t, g, unknown, or other
  misc_feature (271)..(271): n is a, c, t, g, unknown, or other
  misc_feature (292)..(292): n is a, c, t, g, unknown, or other
tggagctccccgcggtggcggccgctctagaactagtggatcccccgggctgcaggaattcgtctcacccctagaaaaagggttccgccatcgcgtcgcgaacggcggccagaaaaaagaaaaagaaaaaaaaaaacnagctcgccgcaccnaatctcccctaccatantcgatcgaccctngcaaggttnntaatccaacagaattccaccnggaaattntggtgaagtgctaatcgcttggcggcttgcctgcccgggtctcgtggctnttgtgctgctcccgctgtggntgaggaaccctaggatggcgggggtttcgatggcggcggcgcctgagggggtgctgcaccgccggattgagtttcatcttgcacggagaccgcatggctctgtggcggtgggcggcggcgggttccggatggagacgctgaacccggacgccgctggtaaggtggggcccggggaggcggtcgggagcagcgagggggatgcgaggaggccggagaagggaacagtggcgggatcgatccggagctcagcgtcgcaaggatctacctcgggagaattggtgctggattggaaaatctggggaatacctg

SEQ ID NO: 70875 - protein, 98 aa, Zea mays
  misc_feature: Ceres CLONE 1551481
  misc_feature: SWISSPROT Homolog: EC 3.1.2.15 Ubiquitin thiolesterase
MAGVSMAAAPEGVLHRRIEFHLARRPHGSVAVGGGGFRMETLNPDAAGKVGPGEAVGSSEGDARRPEKGTVAGSIRSSASQGSTSGELVLDWKIWGIP

SEQ ID NO: 70876 - DNA, 552 bp, Zea mays
  misc_feature: Ceres CLONE 1551484
  misc_feature (219)..(219): n is a, c, t, g, unknown, or other
  misc_feature (220)..(220): n is a, c, t, g, unknown, or other
  misc_feature (294)..(294): n is a, c, t, g, unknown, or other
  misc_feature (295)..(295): n is a, c, t, g, unknown, or other
  misc_feature (296)..(296): n is a, c, t, g, unknown, or other
  misc_feature (297)..(297): n is a, c, t, g, unknown, or other
ctggagctccccgcggtggcggccgctctagaactagtggatcccccgggctgcaggaattcgtctcacccctagaaaaaattcccagcgggcgcgctcgctctctctttctccctcccctcctcgtggcgacgattgggggcagtcgctgccgccgtacgccaggtgcccagatcttcttcatgcccttctccagcgacgagtatcagaaaggtacgnncccatcgcttgggtcttctcttctgctgtgcgaaacgagcacgcaaaccctaatttgctactattttataattnnnntcggatttgaatctttttcgagagtaactggccggtttatgcccccaatttaattttttgggccaaacacaggggggctgggtaccctgtttttaaagggccccccggggaataaaaaaaaaacccaaaccctttttccaaaaaaaaaaaatttcccatggctttttttcccccgtttttaaatttttgggcccccctttttttttttttttaaaaagggggggtaacaccgggaaaaaaaattcttcctctatc

SEQ ID NO: 70877 - DNA, 642 bp, Zea mays
  misc_feature: Ceres CLONE 1551491
  misc_feature: Encodes the peptide sequence at SEQ ID NO. 70878
  misc_feature (327)..(327): n is a, c, t, g, unknown, or other
  misc_feature (336)..(336): n is a, c, t, g, unknown, or other
  misc_feature (346)..(346): n is a, c, t, g, unknown, or other
  misc_feature (517)..(517): n is a, c, t, g, unknown, or other
ctccccgcggtggcggccgctctagaactagtggatcccccgggctgcaggaattcgtctcacccctagaaaaaattccgtctcgcgttcctctcgtcggctcgtcgctctccgagccgcgaaatggcgcctcctacctctgcatcggcgcggccgctatccctccccctcaccgtccctctctcctgtcaccgctcccacttgctccccgcgcccaacgctcgcctcctcacccggcgccgcgtcgcgctcgcgccgacccggcctggcgccacgctcctatccagcctcagtgacgcccgggaggaggacgaggatgatagtggnttctatgangaggatgagncacaggaatttcgagatgaggaggaacaggggtacgacggggagaacgaggagctggtcgaggtgggatacgtgtcgggcccccacagggggggtggccgggaaacttctttcgtaagggcaacgcaccggacttttccgggagcctccgcatagcccacgccggggaacnaaaatggctgaagggcctccagctgcttgggaaagcaccgggccaggggaatttcaaaccttggtccgggggaagggcccccaccggggaaaaaaaaaattggaatccgccacctttttattggc

SEQ ID NO: 70878 - protein, 125 aa, Zea mays
  misc_feature: Ceres CLONE 1551491
  misc_feature (71)..(71): Xaa is any aa, unknown, or other
  misc_feature (75)..(75): Xaa is any aa, unknown, or other
MAPPTSASARPLSLPLTVPLSCHRSHLLPAPNARLLTRRRVALAPTRPGATLLSSLSDAREEDEDDSGFYXEDEXQEFRDEEEQGYDGENEELVEVGYVSGPHRGGGRETSFVRATHRTFPGASA

SEQ ID NO: 70879 - DNA, 530 bp, Zea mays
  misc_feature: Ceres CLONE 1551492
  misc_feature (153)..(153): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (290)..(290): n is a, c, t, g, unknown, or other
ctccaccgcggtggcggccgctctagaactagtggatcccccgggctgcaggaattcgtctcacccctagaaaaaagctcaggcgagcagcggagccgagcagagcctcgagatcccgcccaccatttgccctccggccgacgcggagccgantcgcttcaccggcagcgaggacgatgggttccccgtcgcgggaggactccacgcggcagcggcagcnnnnccgcgtcggtgtgtccgctccagctacggactcgaatcccgcgaactcttgctggagctactgctcnagcgctccccgaggggcctcccgccctgctatcaaggaaaaagggcccttgcacttacccaagtggaccccttgcgcctccggggggggccttcccggctggggggggagggggacacggtgtggggctttccccaatgcccccatttcccttgtttttccctgggggggggggggggggggcgcccccccccccgggggggaaagtttttttttcccccccgaaagtaaaccccccccg

SEQ ID NO: 70880 - DNA, 649 bp, Zea mays
  misc_feature: Ceres CLONE 1551496
  misc_feature: Encodes the peptide sequence at SEQ ID NO. 70881
  misc_feature (140)..(140): n is a, c, t, g, unknown, or other
  misc_feature (191)..(191): n is a, c, t, g, unknown, or other
  misc_feature (215)..(215): n is a, c, t, g, unknown, or other
  misc_feature (217)..(217): n is a, c, t, g, unknown, or other
  misc_feature (240)..(240): n is a, c, t, g, unknown, or other
  misc_feature (243)..(243): n is a, c, t, g, unknown, or other
  misc_feature (245)..(245): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (294)..(294): n is a, c, t, g, unknown, or other
  misc_feature (301)..(301): n is a, c, t, g, unknown, or other
ggagctccccgcggtggcggccgctctagaactagtggatcccccgggctgcaggaattcgtctcacccctagaaaaaatcccagatcaggattagccgaccacccgccgaaggccagagagaaatatctcatcttctcntcaccggatcggttcaatcgagagcgagggagaaagggaggtggtgcgtcnaggggggccgagattttgccgttngnagccagataggggtatgagctgnttngngcacnnngcgcgcttccgaagtgcccgcccgccaggacggcctcctcgnctttcgncttcttccctttcgattcccaatacgacccgtaggttttaattttaggtgggaggaaatttggggaaccaaccccttttaaaacgggccctccccttttcggtgtttccggggccttttttggctttttccgcccccctttttctccaaaactcccccctatttttttccccccccccccggaaaaaaccccgggggctgggggtgtgaggaaccccaagaggggcccccaaaaaagaggggggggccttttttgtccccccacccccctaaaaaagggggggggggaggacccccccccccccccccccttttttttttcccccgggggggggggctcccgcggggg

SEQ ID NO: 70881 - protein, 31 aa, Zea mays
  misc_feature: Ceres CLONE 1551496
GAPRGGGRSRTSGSPGLQEFVSPLEKIPDQD

SEQ ID NO: 70882 - DNA, 600 bp, Zea mays
  misc_feature: Ceres CLONE 1551500
  misc_feature: Encodes the peptide sequence at SEQ ID NO. 70883
  misc_feature (188)..(188): n is a, c, t, g, unknown, or other
  misc_feature (448)..(448): n is a, c, t, g, unknown, or other
  misc_feature (449)..(449): n is a, c, t, g, unknown, or other
  misc_feature (454)..(454): n is a, c, t, g, unknown, or other
  misc_feature (456)..(456): n is a, c, t, g, unknown, or other
ctccccgcggtggcggccgctctagaactagtggatcccccgggctgcaggaattcgtctcacccctagaaaaatgagggcaaaggagacacgacgaagctgggcgagctcggcgccaagctcacggggctgcccccccgcgaacgcatccctcgtgcgagctccatcctgcacatgctcaaactcgncaacctggcccaggaggtgcaaattccgccacgcccgcccaaaaaaaagctcaaaaaaggtggttcccccaaaaaggttcccccccccccctttccaaatctaagaaacccttaacccccttttttcaaaagggaaaaccccccagaaagtgttttgggggtttaaaaaaaaaagggtgttcttttttccccgccacaaaaaaaccccccccccttttttttaaaaaaaaccccccgttttttttttcccccctcagaannaacanantttttccaaacaaaaaaaagagttttttttttgtttgaaaaaaaaaaaccaccccccccccccccacaaaaaaaagggggggggccccccccccccccaaaaaaaaagggggggggggggggcccacccccctcgggggggggg

SEQ ID NO: 70883 - protein, 42 aa, Zea mays
  misc_feature: Ceres CLONE 1551500
  misc_feature (5)..(5): Xaa is any aa, unknown, or other
MLKLXNLAQEVQIPPRPPKKKLKKGGSPKKVPPPPFPNLRNP

SEQ ID NO: 70884 - DNA, 676 bp, Zea mays
  misc_feature: Ceres CLONE 1551506
  misc_feature: Encodes the peptide sequence at SEQ ID NO. 70885
  misc_feature (373)..(373): n is a, c, t, g, unknown, or other
tggagctccccgcggtggcggccgctctagaactagtggatcccccgggctgcaggaattcgtctcacccctagaaaaacgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgacatgccccgatgagtaggaagggcgcggcggccgccgcaaaacccggggcgcgagcccgggcggagcggccgtcggtgcagatcnttggtggtagtagcaaatattcaaatgagaactttgaaggccgaagaggagaaaggttccatgtgaacggcacttgcacatgggtaagccgatcctaagggacgggggaaacccggcagatagcgcgatcacgcgcgtcacccgaaagggaatcgggttaagatttcccgaagccgggacgtggcggcagacggcgacctttaggaagtccggagacgccggcgggggccttcggggaagagttatcttttctgctttacggccccgccaacccctggaatcggttcagcgggaaggtagggg

SEQ ID NO: 70885 - protein, 40 aa, Zea mays; identical to SEQ ID NO: 66130
  misc_feature: Ceres CLONE 1551506

SEQ ID NO: 70886 - DNA, 674 bp, Zea mays
  misc_feature: Ceres CLONE 1551514
  misc_feature: Encodes the peptide sequence at SEQ ID NO. 70887
ggagctccccgcggtggcggccgctctagaactagtggatcccccgggctgcaggaattcgtctcacccctagaaaaagcgcacactcccccgcggccgcgcccccgatctcgccgggccggtggccctcgccgccggcgacacccaccgcccaatcgcccacgcccggggggcgatggaggcggccttcgacgcctacttccgcgccgcagatctggaccgcgacggccggatcagcggccaggaggccgtcgccttcttcaagggctccggcctgccccagcccgtcctcgcgcagatttggacgtatgctgataaaaaccggtctggttttcttgggcgtgaagacttcttcaatgcactcaaacttgtcacagtagctcagagcggccgagaattgacacctgatattgttagatcagcattattcggcccagctgctgcgaaaatccctgctcctcggataaatgtttctacagctgctcctcaggcaagtagcgtagctaacctcccgaatgccactcaagcaccaggtcctgttcagcagactcctgtcgtaagagggacacaagggcttcctggtatatcgtcaaatccacaagtcaggccaccacaacctccaaatgcaaacactgcgccccctgctcatggtcagggagttgcctcaaggccac

SEQ ID NO: 70887 - protein, 166 aa, Zea mays
  misc_feature: Ceres CLONE 1551514
MEAAFDAYFRAADLDRDGRISGQEAVAFFKGSGLPQPVLAQIWTYADKNRSGFLGREDFFNALKLVTVAQSGRELTPDIVRSALFGPAAAKIPAPRINVSTAAPQASSVANLPNATQAPGPVQQTPVVRGTQGLPGISSNPQVRPPQPPNANTAPPAHGQGVASRP

SEQ ID NO: 70888 - DNA, 656 bp, Zea mays
  misc_feature: Ceres CLONE 1551515
  misc_feature: Encodes the peptide sequence at SEQ ID NO. 70889
agctccccgcggtggcggccgctctagaactagtggatcccccgggctgcaggaattcgtctcacccctagaaaaaacgcaacgcaaccagagggggaggggggggaaagccggagccgactgcccgcaccacccacaggaacgccgcggggcaggggggcaggaggaagacgccggcggcggcggcttaaaagggcagggcgccattacctgcttccctgtcttccccttcccctcatgtactacagtactgcgctgcgccctttcatttacccggagtagtaaacgagaagaggaataattgtgtcgcaaactaatccgtttcgccgctgcctgctgcttgagccaatcttccgcgggtcggggccgatgacctgccaactggtctgtttcacttgccattttggataggatcgctcgttttggaattaactttatgctaacagaatctaggtgtcattaagctagattaagcttgctgcttgacttagtagtgtaaatctgtaaagaaaattacctggtttgggtttagtctctataaaagaaatggaacagaggaatgttctggcattgggtgaacatgttctaaaagctactgtttggaagcggaagcataagactgctatggagcaccctgaaggcaatgatgtgatggt

SEQ ID NO: 70889 - protein, 36 aa, Zea mays
  misc_feature: Ceres CLONE 1551515
MEQRNVLALGEHVLKATVWKRKHKTAMEHPEGNDVM

SEQ ID NO: 70890 - DNA, 663 bp, Zea mays
  misc_feature: Ceres CLONE 1551520
  misc_feature: Encodes the peptide sequence at SEQ ID NO. 70891
  misc_feature (332)..(332): n is a, c, t, g, unknown, or other
  misc_feature (344)..(344): n is a, c, t, g, unknown, or other
  misc_feature (421)..(421): n is a, c, t, g, unknown, or other
  misc_feature (452)..(452): n is a, c, t, g, unknown, or other
ctggagctccccgcggtggcggccgctctagaactagtggatcccccgggctgcaggaattcgtctcacccctagaaaaaaacgcctcctccagtccttcttcgtaagccttcaaaccgacgaatttgagcaactgcacccagagcgcgatccattgccggggaagaagcaacttgttgcgagcctcctctatggcgagctccgaccatggttccaccaccgcccccaaggacgtgccgggcagctacggcctgccgctggtgggcgccgtgcgcgaccgcctcgacttctactacttccaggggcaggacaagtacttcgagtccccgcgntggagcgctacnggctcccaccgtgggtgccgcatgaaaccgtgcccgccggggccccttcatggcgcgcgaccccgcgggtggtggcnggtcctgggacgccagagcttccccgtgctnctcgacatggacagggtggagaaagaggacttgttcacgggcacctaaatgccgtccacttccttcacggggggttaccggggtctgctcgtaactggaaccccctcgagcccccccccaccaaggggaaggaagtggttttttccccccgggtttcccggaaggaaaaaagggatcccacctttcgcgtccaaatttcccccggcccccc

SEQ ID NO: 70891 - protein, 102 aa, Zea mays
  misc_feature: Ceres CLONE 1551520
  misc_feature: SWISSPROT Homolog: EC 4.2.1.92 Hydroperoxide dehydratase
  misc_feature (77)..(77): Xaa is any aa, unknown, or other
MASSDHGSTTAPKDVPGSYGLPLVGAVRDRLDFYYFQGQDKYFESPRWSATGSHRGCRMKPCPPGPLHGARPRGWWXVLGRQSFPVLLDMDRVEKEDLFTGT

SEQ ID NO: 70892 - DNA, 661 bp, Zea mays
  misc_feature: Ceres CLONE 1551521
  misc_feature: Encodes the peptide sequence at SEQ ID NO. 70893
  misc_feature (484)..(484): n is a, c, t, g, unknown, or other
  misc_feature (485)..(485): n is a, c, t, g, unknown, or other
  misc_feature (501)..(501): n is a, c, t, g, unknown, or other
  misc_feature (503)..(503): n is a, c, t, g, unknown, or other
  misc_feature (504)..(504): n is a, c, t, g, unknown, or other
  misc_feature (635)..(635): n is a, c, t, g, unknown, or other
ctccccgcggtggcggccgctctagaactagtggatcccccgggctgcaggaattcgtctcacccctagaaaaaactcccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaagtgtgtgggggaagggcactacgacttcgnncacgtgctcgctttcntnncgcgtctcgcctttcacatctccgtctacatcatgtccaggcccaggcccgtgtacctcatcgacttcgcatgctacaagccggccgacgagctcaaggtgtccaaggcggagttcatcgacctggcgcgncagtccgggcagttcgacgaagacag

SEQ ID NO: 70893 - protein, 157 aa, Zea mays
  misc_feature: Ceres CLONE 1551521
  misc_feature: SWISSPROT Homolog: EC 2.3.1.119 Icosanoyl-CoA synthase
  misc_feature (99)..(99): Xaa is any aa, unknown, or other
  misc_feature (105)..(105): Xaa is any aa, unknown, or other
  misc_feature (106)..(106): Xaa is any aa, unknown, or other
MAREEQALLSTEIVNRGVEPSGPDAGSPAFSVRVRRRLPDFLQSVNLKYVRLGYHYLISHGVYLATIPVIVLVCGAELGSLSRDELWRKCVGEGHYDFXHVLAFXXRLAFHISVYIMSRPRPVYLIDFACYKPADELKVSKAEFIDLARQSGQFDED

SEQ ID NO: 70894 - DNA, 642 bp, Zea mays
  misc_feature: Ceres CLONE 1551524
  misc_feature: Encodes the peptide sequence at SEQ ID NO. 70895
ctccccgcggtggcggccgctctagaactagtggatcccccgggctgcaggaattcgtctcacccctagaaaaaaaaacccgactccgtttgacgcggctccgatggtcacaaccggcgccctcgtcgccggcgccgcagtcaacacctgagacctcgtcctgcctgcctgggaagggcgtgagcttgccgctgccgcgatccgagtacgagcccccgcggatgcattatcagcatgccggtagccgcagccgcatgccgccgttcgcacgcggcggcggcgcctacagccgcggacagaaacagttctacccgccgccacctcctcccctcccggcggccgcgctgcctctgctgccgcagaacaagcatgaggtgctcatggaagccggccgcctcgctgccgagtacctggtggcgaagggcgtgctccctcctggctccttgcagcagcgcggcagcacagtcgtcgctgggtggggtggggccagctaccgcctccacctccaccgccgctttcggtgacacaggaagccccagcataccatatcgccaggaatagccggcggcagatcgatgatgagcgtggtattcgtaacgcccgctcacggcgggaaccgtggtggcgactacagtagcagca

SEQ ID NO: 70895 - protein, 100 aa, Zea mays
  misc_feature: Ceres CLONE 1551524
MHYQHAGSRSRMPPFARGGGAYSRGQKQFYPPPPPPLPAAALPLLPQNKHEVLMEAGRLAAEYLVAKGVLPPGSLQQRGSTVVAGWGGASYRLHLHRRFR

SEQ ID NO: 70896 - DNA, 694 bp, Zea mays
  misc_feature: Ceres CLONE 1551525
  misc_feature: Encodes the peptide sequence at SEQ ID NO. 70897
  misc_feature (450)..(450): n is a, c, t, g, unknown, or other
  misc_feature (453)..(453): n is a, c, t, g, unknown, or other
  misc_feature (467)..(467): n is a, c, t, g, unknown, or other
  misc_feature (475)..(475): n is a, c, t, g, unknown, or other
  misc_feature (476)..(476): n is a, c, t, g, unknown, or other
  misc_feature (502)..(502): n is a, c, t, g, unknown, or other
  misc_feature (507)..(507): n is a, c, t, g, unknown, or other
  misc_feature (591)..(591): n is a, c, t, g, unknown, or other
tccccgcggtggcggccgctctagaactagtggatcccccgggctgcaggaattcgtctcacccctagaaaaaaagcgaaagctcaagcaaatacaagctctcagttagacaacactcaaaccagccacggacagcctcaaaatcccgagcaggagctcgctcgtagccccgagaacccgaaatctctgcatcctccgcgagatcgagcccgtgtatccgcccgagaaccagatgcagttcgccatggcgtactacgtcatcaactactccaagctccgcatctgggagttcgtggagtacgagaggatggtgtacctggacgcggacatccaggtgttcgagaacatcgacgagctgttcgagctcgagaaggggtacttctacgcggtgatggactgcttctgcgagaagacgtggagccacaccccgcagtacaggatcggctactngcnacagtgcccggacnaggtggcnngtggcgacaccgagctggggcctcgnccccngctctactttcaacgccgggatgttcgcgcccgagcccagcatggccaacggcaagggcactcctggaaaaccctcggggttantccgccaaccccctttgaaaaagaggactccctgaaactggttctctaggaaccattaggggggcatcccctaaagtgggaaaacccggggggccccaggggt

SEQ ID NO: 70897 - protein, 131 aa, Zea mays
  misc_feature: Ceres CLONE 1551525
  misc_feature: SWISSPROT Homolog: EC 2.4.1.186 Glycogenin glucosyltransferase
  misc_feature (69)..(69): Xaa is any aa, unknown, or other
  misc_feature (70)..(70): Xaa is any aa, unknown, or other
  misc_feature (75)..(75): Xaa is any aa, unknown, or other
  misc_feature (78)..(78): Xaa is any aa, unknown, or other
  misc_feature (88)..(88): Xaa is any aa, unknown, or other
  misc_feature (116)..(116): Xaa is any aa, unknown, or other
MAYYVINYSKLRIWEFVEYERMVYLDADIQVFENIDELFELEKGYFYAVMDCFCEKTWSHTPQYRIGYXXQCPDXVAXGDTELGPRPXLYFQRRDVRARAQHGQRQGHSWKTLGVXPPTPFEKEDSLKLVL

SEQ ID NO: 70898 - DNA, 680 bp, Zea mays
  misc_feature: Ceres CLONE 1551527
  misc_feature: Translation starting site: 154
  misc_feature (40)..(40): n is a, c, t, g, unknown, or other
  misc_feature (188)..(188): n is a, c, t, g, unknown, or other
  misc_feature (227)..(227): n is a, c, t, g, unknown, or other
  misc_feature (236)..(236): n is a, c, t, g, unknown, or other
  misc_feature (243)..(243): n is a, c, t, g, unknown, or other
  misc_feature (307)..(307): n is a, c, t, g, unknown, or other
  misc_feature (383)..(383): n is a, c, t, g, unknown, or other
  misc_feature (384)..(384): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (390)..(390): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (405)..(405): n is a, c, t, g, unknown, or other
  misc_feature (406)..(406): n is a, c, t, g, unknown, or other
  misc_feature (435)..(435): n is a, c, t, g, unknown, or other
  misc_feature (453)..(453): n is a, c, t, g, unknown, or other
tccccgcggtggcggccgctctagaactagtggataccgngggctgcaggaattcgtctcacccctagaaaaaatcctctgctctgctccggtccgttccgctccttcctccccctatctagctagccttcccgttcctgcatcgcggcggagatgggcgcctccaccacgccgctcgcgtcgggggnggcgctgcttctgctgctgctcgcgccgctcgccgcggnggcggacancatgtcnatcgtctcctacggcgagcggaaccaggatgatgccccgcggatggtaccccattggatgggcnccttttttcctgacctacaacgccctccgcgaggaggattttttttcccccccccccgggggaaagccgggggggnntnnnancccccnnnncccccnnttaattaaaaataaaaaacattcccctcnggggggggggggggggcnaacctccccaaaaaaaagaccccccccccctccccgggggtccgagcaccccccaaaaggaaaagaaagccccgttaaaaggaccaggcccgcgggaacaagggggtctggggacttttgtgatgtgggggtcgcaggggcccccccggggaattggggcccgggtccctcttggggggggttggtaccctcctccgccacagctgacggggcggtgagccctacgc

SEQ ID NO: 70899 - DNA, 622 bp, Zea mays
  misc_feature: Ceres CLONE 1551528
  misc_feature: Encodes the peptide sequence at SEQ ID NO. 70900
  misc_feature (195)..(195): n is a, c, t, g, unknown, or other
  misc_feature (235)..(235): n is a, c, t, g, unknown, or other
  misc_feature (236)..(236): n is a, c, t, g, unknown, or other
  misc_feature (255)..(255): n is a, c, t, g, unknown, or other
ctccccgcggtggcggccgctctagaactagtggatcccccgggctgcaggaattcgtctcacccctagaaaaatccacaacactcatcgatctacacacatacatagtttcttctactacacgacgacaaacatggggaagcctgcgaagatcggagagtggggtggatacgccggcgatcgtcgggatctganggctactccggacccggctgatcgagtgaaggtcacggcnngacacagcagctgcatccngctcatctccttcatctacattggaagcgatggcaaacccgtacgaggactctctgaaccctagtccccttgctcttctcaggcgcccgccaatcccttccgtggtccccaaccgcttagtgagaaaaaaagattgcccgcaaaggccataggccccgttatttgattctatatctggacgacgtatctttgggttggggtgtgggacacccaaccccgtttagaatttttttccaaccaacccgggtaacccgaccccccccctcttaagttgcttttcccgattccgaaggcctttttcggaaatggggccaaaaccccggttccctttaaccccccttaaaccccttttttttttcccaagcct

SEQ ID NO: 70900 - protein, 61 aa, Zea mays
  misc_feature: Ceres CLONE 1551528
  misc_feature (21)..(21): Xaa is any aa, unknown, or other
  misc_feature (35)..(35): Xaa is any aa, unknown, or other
  misc_feature (41)..(41): Xaa is any aa, unknown, or other
MGKPAKIGEWGGYAGDRRDLXATPDPADRVKVTAXHSSCIXLISFIYIGSDGKPVRGLSEP

SEQ ID NO: 70901 - DNA, 627 bp, Zea mays
  misc_feature: Ceres CLONE 1551530
  misc_feature: Encodes the peptide sequence at SEQ ID NO. 70902
tggagctcaccgcggtggcggccgctctagaactagtggatcccccgggctgcaggaattcgtctcacccctagaaaaagttttctgcggccgtcgatggagctccacctcgccaccatcgcccaccgcccgcctttgccggtaccggcgcggggccaccacctccgccgccgcctccaccacctcccggctcctctctccttccaaaacacctactccccctccctttcctccccgcatcatcatcgcctttctcccacccttcgccgccacctccgcctgcctcttctcgcctcccaagcgcccaattctaacccggagcctgaacctgagcccgagcccactggtgcgaagctactgccgctcgtcatctccatcgccatcggcctcgccgtgcggttcctcgcgcccgcgcccgtcgaggttagcccgcaggcgtggcagctcctctccatcttcctctccacaatcgcggggctggtgcttggccctctccctgtcggcgcatggggcttcctcggggtcacagccggcgttcgcactcgaaagcttcccttttaacgcgcctcttccgcttcacaaaggaggccatctggctcatcggcattttcttcttcttccggcggg

SEQ ID NO: 70902 - protein, 154 aa, Zea mays
  misc_feature: Ceres CLONE 1551530
MELHLATIAHRPPLPVPARGHHLRRRLHHLPAPLSFQNTYSPSLSSPHHHRLSPTLRRHLRLPLLASQAPNSNPEPEPEPEPTGAKLLPLVISIAIGLAVRFLAPAPVEVSPQAWQLLSIFLSTIAGLVLGPLPVGAWGFLGVTAGVRTRKLPF

SEQ ID NO: 70903 - DNA, 690 bp, Zea mays
  misc_feature: Ceres CLONE 1551532
  misc_feature: Encodes the peptide sequence at SEQ ID NO. 70904
  misc_feature (653)..(653): n is a, c, t, g, unknown, or other
tccccgcggtggcggccgctctagaactagtggatcccccgggctgcaggaattcgtctcacccctagaaaaaactggtcctcctctccactctctcttctccctcaataattctctccacccctgcttgctgcacctgcgagcactacccaatcagggcggagtgggagcagacgagggaatcccatgtctccgcccctctctggagcagatcattctcagaccgacgtcgtagctgctgcgatacaaagctagctgaccctacctagctagcctgatccgcccgcagtccgatcgccatcgacgggtgtggaggcccctgactcccccctgctgacccgggcgcttagcattcgcggcggcgaccgtcgctgggttcccatacacatgctgcaactcgtaatggtgctcgtcaatcaccctggccacctgcatgccgcgtctctcgtgtgtcaccctggggctcacctcgactctctctctgcgaagcacgtgagtgtgcctttctggattctccgtgtcacaggcacgcctagctagcacggtttctgcgaggtaggtcttctcgcgacatgacagaaagcaccgcgctgctcctatacggactcatctccagttacctgacgagactacgaccggctgctggatccggnagatcgacgtgaccgtctcgagtgccatcaaggcccc

SEQ ID NO: 70904 - protein, 50 aa, Zea mays
  misc_feature: Ceres CLONE 1551532
MLQLVMVLVNHPGHLHAASLVCHPGAHLDSLSAKHVSVPFWILRVTGTPS

SEQ ID NO: 70905 - DNA, 667 bp, Zea mays
  misc_feature: Ceres CLONE 1551533
  misc_feature (37)..(37): n is a, c, t, g, unknown, or other
  misc_feature (58)..(58): n is a, c, t, g, unknown, or other
  misc_feature (70)..(70): n is a, c, t, g, unknown, or other
  misc_feature (326)..(326): n is a, c, t, g, unknown, or other
  misc_feature (384)..(384): n is a, c, t, g, unknown, or other
  misc_feature (396)..(396): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (456)..(456): n is a, c, t, g, unknown, or other
  misc_feature (566)..(566): n is a, c, t, g, unknown, or other
  misc_feature (569)..(569): n is a, c, t, g, unknown, or other
  misc_feature (572)..(572): n is a, c, t, g, unknown, or other
  misc_feature (577)..(577): n is a, c, t, g, unknown, or other
ctccccgcggtggcggccgctctagaactagtggatnccccgggctgcaggaattcgntctcaccctagnaaaaaagcaagcagctgctctcgtgtgacatctagtcgtcgccagtcagtcacctctccagcctccagcaccaaccatccaccaccgagctagcagctgtctgctcgcctcccccacctaggctaggactaggagccaccaaactctgccccgccatgccgggcctcgccgcctcaggcaactcgcccccggcggcggcgccggccccccgccgtctctggtcgccgctgcccccgcgcgcgccgccgtccccatngccctccgcctccacgcgcgctagtccccccccccctggggggggggggggagaattntttgacaacccnaacccnnntcctttcttcttgaacaaggccccaaccccaggggggcgggggaggcctctntcccctcctccccccctgtaattccccaagcgggcccctaggcgcctcaaagccacccactaggggcccccacttcaacttcgcataaagagctaatcggcggccgccgnaanaangcgcnccccctccccccttatcgggcgcgtgcgcggttaatggaggaggccagtcctaagaatccccgttggagacgttggcccaccctcaggga

SEQ ID NO: 70906 - DNA, 682 bp, Zea mays
  misc_feature: Ceres CLONE 1551534
  misc_feature: Translation starting site: 119
  misc_feature (313)..(313): n is a, c, t, g, unknown, or other
  misc_feature (325)..(325): n is a, c, t, g, unknown, or other
  misc_feature (372)..(372): n is a, c, t, g, unknown, or other
aaaagctggagctcaccgcggtggcggccgctctagaactagtggatcccccgggctgcaggaattcgtctcacccctagaaaaacacactgacctagcaccagctcgatctcacaggatggttacgctatgccatccgattcggatccgagcaagcgggagcaccgcgagctggcggaggagaaatgcggcggcggcggcgaaggtcctctgctccgtgcagcaaatgccgccgcccgcgccggcggccacggctgcccagagcacgatcaaagtcgttatcgtttgggcaacgaaagagatccggaggacngccgtcgttgcngtgagcagggcacggggatggagctcgcgggcgcgatcgactcccantgcattggccaagacaccggacacattaatggcatggaccaacccctggaaatccctgtggctgacgacctcaccatgggtcttggctccctaaccccaatccagagcaacccggctggggggtcgaattccacgagcctttcacctggttaccacaatggcaacaaggcaccggccttgggctgagacaaactccctctacttccgaaaaatcgagcttaaaacagggactgaactggccagcgttctgcaaaaaagccaacgtggggctgcttgggtgcccccacccttgcccatttgggtcccgtgc

SEQ ID NO: 70907 - DNA, 690 bp, Zea mays
  misc_feature: Ceres CLONE 1551540
  misc_feature: Translation starting site: 556
  misc_feature: SWISSPROT Homolog: EC 4.3.1.5 Phenylalanine ammonia-lyase
  misc_feature (296)..(296): n is a, c, t, g, unknown, or other
  misc_feature (475)..(475): n is a, c, t, g, unknown, or other
  misc_feature (479)..(479): n is a, c, t, g, unknown, or other
ctggagctccccgcggtggcggccgctctagaactagtggatcccccgggctgcaggaattcgtctcacccctagaaaaaaaaaaggaagagcctagctagctttccccagctcttcttccacagcactgtctgtctcgcaattagctgtactaatccgctagtggcactgctgctactctcgtgtactcccagctatctcctctctatactcttgtacgtacgcacgtgtcgcaaccgcaatggagtgcgagaccgggcttgtccgctccctgaacggcgagggcctgtgcatgntcggcggcggcggcggcgccgcgcgccgacgccctgaactggggcaaggccgcggaggacctgtccgggagccacctggacgaagtgaagcggatgggtggtggaagttcccgcgagccgctggtgaagatccaggggcgccagcctgagcatcgggcaggtgggccgccgtggccgcnggcnccccggcggcaaggcccgccgtggagctggaacgagtccccccgcggcccgcgtcaaggccaacagcgaactggtcatgaccagcatgatgaacggcccccgacaagttagggggtcaccaccggttttcgggcccaccttcaaaaggaggaccaagggaggccgggccctcccaaggggagccaaaaaaattccccaaaggggggcgcgt

SEQ ID NO: 70908 - DNA, 663 bp, Zea mays
  misc_feature: Ceres CLONE 1551543
  misc_feature: Encodes the peptide sequence at SEQ ID NO. 70909
ctccccgcggtggcggccgctctagaactagtggatcccccgggctgcaggaattcgtctcacccctagaaaagtccgctcctgttccgtcgtttcgtcgactaacctccaaagttttttcctctccacaactcggcaactacggagctgcctccaactcatttgcttaccatccctaccgcctggctcagatctcgatgcggcgcaagcttcccggcgacgcgccgctgtcggcggcggggcctggtcatgcgttgtccgcatccgcgccgtccgaggtggacctcgctcagctctccgccgccatcgcggccggggaagaccttggccccttcgtgcgccgggccttcgcgtgcggccgccccgagccgctgctcgcctcgctccgcggggcggcgcgggaccgcgagggcgagatcgaggagctctgccccgcacacttccacgattttatccggcgcgtcgacgactttcggtcccttctttgccacgccgaaccgctcaagggctccctctcggggtcccactccgggccttttttcctgggggggcccctttgctcgcctcccctggaatctttcttggccggggggtttggtttggggggaaacctccccctcgggggttagcctcccccccgaaccctgggtagggggtgtcccg

SEQ ID NO: 70909 - protein, 143 aa, Zea mays
  misc_feature: Ceres CLONE 1551543
MRRKLPGDAPLSAAGPGHALSASAPSEVDLAQLSAAIAAGEDLGPFVRRAFACGRPEPLLASLRGAARDREGEIEELCPAHFHDFIRRVDDFRSLLCHAEPLKGSLSGSHSGPFFLGGPLCSPPLESFLAGGFGLGGNLPLGG

SEQ ID NO: 70910 - DNA, 663 bp, Zea mays
  misc_feature: Ceres CLONE 1551547
  misc_feature: Encodes the peptide sequence at SEQ ID NO. 70911
  misc_feature (245)..(245): n is a, c, t, g, unknown, or other
  misc_feature (363)..(363): n is a, c, t, g, unknown, or other
tccccgcggtggcggccgctctagactagtggatcccccgggctgcaggaattcgtctcacccctagaaaaacaacccgtttgtgtcgtaggcgttttgcactagcgtttccgtgaggtgggcgaaggcgtccgtgaccgaccgaccgaccggagcttcatgcgccaggggcggcggcttcaccccgtcgtttgatgggcaacgcatgcagcggcgcccttagatccaagtacctgcacagcttncagcacgccgcgtcgcagcgccacgactccgagtacagcgccagcgcccagcgcgacgaactcgcccaggaagcccacaacgcccgccaccagggaaagcccaagggccggggccccncccgcccccccccctaaggggcccgcccgcttgggcccaacccccgaaaccctggggtcctgggtttgggcaaaaaaaacccccaaacctccccggaacctttataccctttttgacaaaaaactccggggaggggggaaaatttttgacccacctttatcttttttaacaaagatttcccccccgggggatacaccaaaccccccccggaagatccctctttcccaaagggggaagatttttttcccccaaggggggagggtgctcaaaaaaaatggcgcccccggaaggaaataaaaa

SEQ ID NO: 70911 - protein, 61 aa, Zea mays
  misc_feature: Ceres CLONE 1551547
  misc_feature (17)..(17): Xaa is any aa, unknown, or other
  misc_feature (57)..(57): Xaa is any aa, unknown, or other
MGNACSGALRSKYLHSXQHAASQRHDSEYSASAQRDELAQEAHNARHQGKPKGRGPXRPPP

SEQ ID NO: 70912 - DNA, 654 bp, Zea mays
  misc_feature: Ceres CLONE 1551548
  misc_feature (369)..(369): n is a, c, t, g, unknown, or other
  misc_feature (434)..(434): n is a, c, t, g, unknown, or other
  misc_feature (458)..(458): n is a, c, t, g, unknown, or other
  misc_feature (459)..(459): n is a, c, t, g, unknown, or other
  misc_feature (469)..(469): n is a, c, t, g, unknown, or other
  misc_feature (470)..(470): n is a, c, t, g, unknown, or other
gcggtggcggccgctctagaactagtggatcccccgggctgcaggaattcgtctcacccctagaaaaagcttatatcaccattcaccagctagcttctcaccaccgccaccgccaccgccggctcctgctgccaccgcccgctggctggcttagcgcgtaggctgtgactgactgactgactgactgcgagaccacagcaccggaggacgcccgcgcgcgcgaaccgcagcgcagaggcaggggaaccttgtccgcggctcggccggcatgaagctcccgctgctgcgtccgctgtggccgggcctggggcctgcggcggcggggccgcccgacgcggcgccggagccggccaagccctcgctgccggnccacgtgctgctgctgcacgcgctcttctgcgcacatccatggccgtcggcttccgcttctcccngctcatcgtcttcctcctcttccnntgccacccgnnccataacccggcgcgcacctcgtctcgctcgtgtcctccgcccgcgtggcgctcgcggggggcaaacgccccggcacgaataccaggaccacccacaccacaacatcggttgggaccacacccaccaccgtgggcgccaactttgggggggcccatccggaacaacaacacaagggccagggcg

SEQ ID NO: 70913 - DNA, 721 bp, Zea mays
  misc_feature: Ceres CLONE 1551549
  misc_feature: Encodes the peptide sequence at SEQ ID NO. 70914
aagctggagctcaccgcggtggcggccgctctagaactagtggatcccccgggctgcaggaattcgtctcacccctagaaaaaatccattccattccagtactcgctcatcttgctccgccttctgcttctgcgcatcctccaaggatcgtgatggccatggccacgcaagcctccgctgccacgcgccacctggtggccgcctccgcctgggcgccgtcggcgaagccgcggcagccgagctcacagctcgcgctgctgccgtcgtcctcccgcgcgccggccccgctccgcgcgaccgccggggaggcggtgaccgaggaggcgcccaaggggttcgtggccccgcagctggaccccagcacgccgtccccgatcttcgggggcagcacgggcgggctgctccgcaaggcgcaggtggaggagttctacgtcatcacgtgggtgtcccccaaggagcaggtgttcgagatgcccaccggcggcgccgccatcatgcgggaggggcccaacctcctgaagctggcgcgcaaggagcagtgcctcgcgctcggcaccaggctgcgctccaagtacaagatcacctaccagttctaccgcgtcttccccaacggcgaagtgcagtacctccaccccaaggacggcgtctacccggagaaggtcaaccccggcagggagggcgtcggccagaacttcggcagcatcggcaagaacgtcaaccc

SEQ ID NO: 70914 - protein, 189 aa, Zea mays
  misc_feature: Ceres CLONE 1551549
  misc_feature (65)..(189): Pfam Name: PsaD Pfam Description: PsaD
MAMATQASAATRHLVAASAWAPSAKPRQPSSQLALLPSSSRAPAPLRATAGEAVTEEAPKGFVAPQLDPSTPSPIFGGSTGGLLRKAQVEEFYVITWVSPKEQVFEMPTGGAAIMREGPNLLKLARKEQCLALGTRLRSKYKITYQFYRVFPNGEVQYLHPKDGVYPEKVNPGREGVGQNFGSIGKNVN

SEQ ID NO: 70915 - DNA, 727 bp, Zea mays
  misc_feature: Ceres CLONE 1551550
  misc_feature: Translation starting site: 223
  misc_feature: SWISSPROT Homolog: EC 1.2.1.13 Glyceraldehyde-3-phosphate dehydrogenase (NADP(+)) (phosphorylating)
  misc_feature (714)..(714): n is a, c, t, g, unknown, or other
aagctggagctccccgcggtggcggccgctctagaactagtggatcccccgggctgcaggaattcctctcacccctagaaaaagtcatcttgtcttgatcctctggtccgtggccatggcgtcctccatgctctccgctaccacccgtgccactccagcaggggggcggcctgtccgagttctccgggctcaggagctccgcgtcgctgcccatgcgccggaatgccaccctccgacgacttcatgtccgccgtctccttcaggacccacgcggtcggcacgagcggcgggccgcggcgggcgccgacggaggcgaagctgaaggtggccatcaatgggttcggccgcatcgggcgcaacttcctgcggtgctggcacgggcgcggcgacgcctcgcccctcgacgtcatcgccatcaacgacaccggaggcgtcaagcaggcgtcccacctgctcaagtacgactccacgctcggcatcttcgatgccgacgtcaagcccgtcggcgacaacgccatctccgtcgacggcaaggtcatccaaggtcgtgtccgaccgcaaccccagcaacctgccgtggggcgagctcggcatcgacctcgtcatcgagggcaccggcgtcttcgtcgaccgcgagggcgcggggagcacatcccagcgggggcccaagaagtgctcatcacggcgccccgcagggcgactccccaacctacntcgtcggcgttaa

SEQ ID NO: 70916 - DNA, 695 bp, Zea mays
  misc_feature: Ceres CLONE 1551552
  misc_feature: Encodes the peptide sequence at SEQ ID NO. 70917
  misc_feature (365)..(365): n is a, c, t, g, unknown, or other
  misc_feature (456)..(456): n is a, c, t, g, unknown, or other
  misc_feature (523)..(523): n is a, c, t, g, unknown, or other
aaagctggagctcacccgcggtggcggccgctctagaactagtggatcccccgggctgcaggaattcgtctcacccctagaaaaaagaagggagcagaagccaaccggctcgtccgcccgttgcctgtcgtcgctatggccgccgtggaggtgtgcgtgaaggccgccgcggggaaccccgacacgctcggcgattgcccgttctcgcagagggtgctgctcacgctggaggagaagaaggtcccgtacgaggtgaagctcgtcgacctcggcaacaagcccgaatggtttctgaacatcagcccagagggtaaggtgcctgtgttcaacggtggagatggcaaatgcattgctgattctgatgntatcaccccagtcattgaggagaagttcccgactccttctctggtcacccctccagatatgcatcagtgggatcaaagattttcccagccntttgtcaagttctgaagagcaaggatgctagtgatgggtcagaagaaggccttctggatgagctgcngcgcctggatgatcatctcaagctcatggccccttactaaatggggagaacggttcccccactgatcttaccctggggccaagcttttcccccctacgaatccccctggagcttttcaagggtggaagaatcccggaaacctaaccagttgtcatggcctccccaaggggtc

SEQ ID NO: 70917 - protein, 111 aa, Zea mays
  misc_feature: Ceres CLONE 1551552
  misc_feature (16)..(84): Pfam Name: GST_N Pfam Description: Glutathione S-transferase, N-terminal domain
  misc_feature: SWISSPROT Homolog: EC 2.5.1.18 Glutathione transferase
  misc_feature (77)..(77): Xaa is any aa, unknown, or other
MAAVEVCVKAAAGNPDTLGDCPFSQRVLLTLEEKKVPYEVKLVDLGNKPEWFLNISPEGKVPVFNGGDGKCIADSDXITPVIEEKFPTPSLVTPPDMHQWDQRFSQPFVKF

SEQ ID NO: 70918 - DNA, 650 bp, Zea mays
  misc_feature: Ceres CLONE 1551556
  misc_feature: Translation starting site: 267
ctccccgcggtggcggccgctctagaactagtggatcccccgggctgcaggaattcgtctcacccctagaaaaagtctcttgtcgctgcagcctcgtcccgtccgatccttccaagtctctcttcttgctgcaggctgccccaagcccaggctcaatccggctggacgaggagacggcattgctcgcatcgcctgccctgccctgccccccatgcgtgttgtgcgcatgaacagaggctaggctaccaacaacgcatagcatagccatggatcccgagttcggcgtcggcacggcgccacaaaaggggcggcgggcgtggcggacgacgctgctgctggcgtaccagagcctcgggggtggtgtacggcgacctcagcatctcgccgctgtacgtgtacaagagcaccttcgccgaggacatcacgcactcggagaccaaccagagatcttccgcgcgctctccttcgtcttctggacgctcaccctcgtcccgctcctcaagtacgccaccatcgtcctgcgcgccgacgacggcggcgagggcggcacgtttcgcgctctactccctcattctgccgccccgccaatgtaagcctccttccccaacccgccaggcccccaaaaaggaacctcccccctacaggggtgg

SEQ ID NO: 70919 - DNA, 773 bp, Zea mays
  misc_feature: Ceres CLONE 1551562
  misc_feature: Encodes the peptide sequence at SEQ ID NO. 70920
  misc_feature (432)..(432): n is a, c, t, g, unknown, or other
  misc_feature (447)..(447): n is a, c, t, g, unknown, or other
aaagctggagctccccgcggtggcggccgctctagaactagtggatcccccgggctgcaggaattcgtctcacccctagaaaaatgtcgctgctcgccgtcgcctcctccactcgcgccgcggcagtgcggccgctgtgcgcctcggcggcctcggacgaggcggtgccggcgcctgctgtggcggataccgcagggcggaggccggtgaaggtgatcctaccaaagaagaaaccgcagaagtggtcgacggggatggcaccgggtgagtacggcggcgggccggccaccatcaagccgcgcaagtactggtgggggaaggaggaccgcgaccccgtggggaacaccgacgacttcatctggaacaaggacttcctcccccacatggaacgcgtcatcgccaacggcggcgccgatgcagaacccaccatcnacccgccttgcgccngtggatgaaggagggggagtcccggttttctgaccatccacccgcccattgagcctttgcagcgttggaaggttgattctgaagccgggagctttcaggccccccaacacggcccaatttttggaaacccccaggtttaaaggcttccctggaaaaagaaccggccaatttggggccttaaaacctttaaaattggaaccccccccctcctcaaagggagggcgatgtccccctcctccccgggggaacccggcaaattgggggaaaaaagagcgccaaaggctcccccccggggggggagatggtgttttacttcctagggaggc

SEQ ID NO: 70920 - protein, 123 aa, Zea mays
  misc_feature: Ceres CLONE 1551562
  misc_feature (117)..(117): Xaa is any aa, unknown, or other
  misc_feature (122)..(122): Xaa is any aa, unknown, or other
MSLLAVASSTRAAAVRPLCASAASDEAVPAPAVADTAGRRPVKVILPKKKPQKWSTGMAPGEYGGGPATIKPRKYWWGKEDRDPVGNTDDFIWNKDFLPHMERVIANGGADAEPTIXPPCAXG

SEQ ID NO: 70921 - DNA, 667 bp, Zea mays
  misc_feature: Ceres CLONE 1551565
  misc_feature: Encodes the peptide sequence at SEQ ID NO. 70922
ctccccgcggtggcggccgctctagaactagtggatcccccgggctgcaggaattcgtctcacccctagaaaaagagcaccgagctcaaacacacatcaagaaagcaagaaagaaaagactgtagctagctagccaccgcgcgcgcgcacgagtagtctagctagaatacactcgcgttcaaaacaaacacacagcgtcgtgctgcgtgatctctgaccgcgtcgacaactaccgcagcaccaagcagctgatggcggccaccgtatcttcctgcctgagcctcgtccccaccgtgcaccaccgggccggcgggttccccagcagtgtggcactgacgaacacgcttcagcgccgtcgtcgttctcgccgctatcttgtcgtcgcctcggcgacgagagccgaacaggaggccgcccctgtgacgatcgaggacgtggacctcagctctcatcaggccgcggccgacgacggggagctcgccgcgcggtggcggggaggtcacggcagcacaactggggagggtctgctggaccccatcgacggcgtgctccctcaggagctcatccgctacggcgagttcgcccaggcacctacgacagcttcgactacgaccgcttctcccccttatggcggaagctgcaagtaacccggcgaagacttcctccc

SEQ ID NO: 70922 - protein, 131 aa, Zea mays
  misc_feature: Ceres CLONE 1551565
MAATVSSCLSLVPTVHHRAGGFPSSVALTNTLQRRRRSRRYLVVASATRAEQEAAPVTIEDVDLSSHQAAADDGELAARWRGGHGSTTGEGLLDPIDGVLPQELIRYGEFAQAPTTASTTTASPPYGGSCK

SEQ ID NO: 70923 - DNA, 693 bp, Zea mays
  misc_feature: Ceres CLONE 1551567
  misc_feature: Encodes the peptide sequence at SEQ ID NO. 70924
  misc_feature (399)..(399): n is a, c, t, g, unknown, or other
  misc_feature (465)..(465): n is a, c, t, g, unknown, or other
  misc_feature (661)..(661): n is a, c, t, g, unknown, or other
  misc_feature (662)..(662): n is a, c, t, g, unknown, or other
aagctggagctccccgcggtggcggccgctctagaactagtggatcccccgggctgcaggaattcgtctcacccctagaaaaaatctgcagttctcgacctctcctcctacctcctcttcactcccttcctccctcttgcatcactatcaccaccaacaacaaggctaacgcacaccaatccaacaaggagaacaaaaaacaattaatcgtgttttgagcttttgatatcacctcgttcgagttaagtgcgtgaagaggcaataatggtggcagtggaggttgtgccggcgtccgcggagtccccgattccgatcgaggctaagaccgcggtgacgtcggaggcggaggcggaggcggaggccgagggcgaagtggaggcggagatgaagggtgatgcngcagccacggcgggagaaacggcggaggaggaggaggaggaaaaggtgtacaagagcgacctgaanaagctggagaacctcatgtccaagcttaacccctccgcgcaggagttcgtgccgtcgtcgcgccgcacggccccagccgccgtggcggcggcgaaaccggcgggaggaagggtgctctcagcccaacccgccgtgttcgtggtcgcccccaaaactacggcgctggcggggggcacctggagaaagcggcggcggnngcaaaatcatccattggcgccgggacaagaa

SEQ ID NO: 70924 - protein, 143 aa, Zea mays
  misc_feature: Ceres CLONE 1551567
  misc_feature (71)..(88): Pfam Name: PAM2 Pfam Description: Ataxin-2 C-terminal region
  misc_feature (67)..(67): Xaa is any aa, unknown, or other
  misc_feature (133)..(133): Xaa is any aa, unknown, or other
MVAVEVVPASAESPIPIEAKTAVTSEAEAEAEAEGEVEAEMKGDAAATAGETAEEEEEEKVYKSDLXKLENLMSKLNPSAQEFVPSSRRTAPAAVAAAKPAGGRVLSAQPAVFVVAPKTTALAGGTWRKRRRXQNHPLAPGQE

SEQ ID NO: 70925 - DNA, 744 bp, Zea mays
  misc_feature: Ceres CLONE 1551574
  misc_feature (656)..(656): n is a, c, t, g, unknown, or other
aagctggagctccccgcggtggcggccgctctagaactagtggaatcccccgggctgcaggaattcgtctcacccctagaaaaacatcctcttaatcatatgggtctacacactctctaaacactgcctctgctgcaacatgaagaaaaaatgtgatctcctcctgatctctcgttgacaggtatggtgaccacagactcgtcgagccctctcaagtcctccttagcatgttccatgatccctacaaggacgcccagcaccacacgatcgaccgagctctctgtctgcttcgtcatggatgtcatatcattggaacgtacatatattactctaccacactaccctacatactgactcccttctcgttctgatcctttccctagtttatcttgtttttcgacatgaataaacgctgcttgattgattgtatcactgactggcagtgtcaagagctcttcctgagcagcagggaacacaacactgtcactgcctgaccagcttgctagtgaccgttgctctagatccgttcatccggagcggtcctgtgacgccggacagcggcgacgtgaattagacgatcatgtacactctgtcatgatgacttcgtaggccgggcctacctcttcatacgaggactctagaagttgcgtaaggancagcgaccagcagtaccgttctgtcatcagcaaaggacgcgtactgcaggcacctacaaaatgagcgcagtcctaggcgctgcacaac

SEQ ID NO: 70926 - DNA, 744 bp, Zea mays
  misc_feature: Ceres CLONE 1551576
  misc_feature: Translation starting site: 286
  misc_feature (413)..(413): n is a, c, t, g, unknown, or other
  misc_feature (414)..(414): n is a, c, t, g, unknown, or other
  misc_feature (424)..(424): n is a, c, t, g, unknown, or other
  misc_feature (487)..(487): n is a, c, t, g, unknown, or other
  misc_feature (503)..(503): n is a, c, t, g, unknown, or other
aaagctggagctcaccgcggtggcggccgctctagaactagtggatcccccgggctgcaggaattcgtctcacccctagaaaaaatcgtgagcgtgggttcattaaaaataactctattcttttttacaacaaaaaccctagacgcatccgcaagctgcgactcactcgccctcgtccgcagcgcccacgaaacgcgccgccgccgccgtgacatcgcagcggcgtcggcgtcgtctcggccgctccccgccgtagggccattttcgctcgagctgccggagaccatgtcgagcggtctagacatgtccctggacgacctcatcaagcagtctaagtcccgacccaaggccaaccccgcgtcctcgtcggggcctgccccgcgcgcgcaccccgctcgcgccgcgccctaccnnacggtcgctnccaaggcccgtgccaccgccgactcgccttacggggtctactccgagcaaatcgccgctatangcggcggccgcgccgnttgccggccaaagcaggtcgctcgaaaacgggaatgaacttgccatctccaatcttgactccgggggtcccgggtcaaaaatgcccagaaccctttcctcaagttgggggagcccaaggttttttcatgaactttgcaaggggggggaaaaccaggggaacccgccaaatttttttttccaagaaaaggggacccttggggcccttaaaaaaaaaaaggttgttccttttagggggaacca

SEQ ID NO: 70927 - DNA, 698 bp, Zea mays
  misc_feature: Ceres CLONE 1551581
ctggagctccccgcggtggcggccgctctagaactagtggatcccccgggctgcaggaattcgtctcacccctagaaaaaatccaagcgataaccggtagaaaccgccccggaaacaatttcggggcatggccaccgcatctcaggttgccgccaccttcctctcgttgatttcctcctccactgaccaccccgccacttcgtccatctccctcgggacaacctctgttctacccgactcccttcgggccgctggcacaggtggcccacggctcgcctaccgcctccggggccgccgcgtcggtgccgccgacgcccagctccccaccacggatccacaggtagtttcaggtgacaacaagatcagatggtcatcaacggctgtgccgccttttgcgatggcagagctgacaggcccgcaagatgacgaaccctacaacaagctgctgatggcacctcatgagcattcctgctcaatgaaccactggtgtagcagaacttttgcgggcgagaggaatcacacttctcaaagtgctgcaagatgcatcgaatgtgattgggaaggcagatacgctctcacttactctcgtgcatccgccattgagagatcctgaacatcgagtccttgattgcgctgtcaaagagaatctacatcatgtgaggatggagaagcaacatgcattcacttgctactgggga

SEQ ID NO: 70928 - DNA, 717 bp, Zea mays
  misc_feature: Ceres CLONE 1551587
  misc_feature: Encodes the peptide sequence at SEQ ID NO. 70929
  misc_feature (419)..(419): n is a, c, t, g, unknown, or other
  misc_feature (560)..(560): n is a, c, t, g, unknown, or other
aaagctggagctccccgcggtggcggccgctctagaactagtggatcccccgggctgcaggaattcgtctcacccctagaaaaatcccctcctccgcacaaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgccggcggcggggaggagctctcggtggaggagcgcaacctgctgtccgtcgcctacaagaacgtcatcggcgcccgcagggcctcgtggncgatcatctcctccatcgagcagaaagaggaaggccgcgggaaaacgagcgcacgccgcatccatccgcgcctaccgctccaagatcgaggccgagctcgcccgcatctgcgacgggatcctcgggctcctcgactcccanctcgtcccatccgccggggggggccgaagtcaaagttccttctacctcaagaatgaaggtgactaccccaggtaccttgcttgaattcaagtcaggtccaaaaaagaaagattctcccgaaaagccctggaagcctacaaagctgctcaggaatttc

SEQ ID NO: 70929 - protein, 135 aa, Zea mays
  misc_feature: Ceres CLONE 1551587
  misc_feature (71)..(71): Xaa is any aa, unknown, or other
  misc_feature (118)..(118): Xaa is any aa, unknown, or other
MSPSEPTREESVYMAKLAEQAERYEEMVEFMERVARYAGGAGGGEELSVEERNLLSVAYKNVIGARRASWXIISSIEQKEEGRGKTSARRIHPRLPLQDRGRARPHLRRDPRAPRLPXRPIRRGGPKSKFLLPQE

SEQ ID NO: 70930 - DNA, 702 bp, Zea mays
  misc_feature: Ceres CLONE 1551591
  misc_feature: Encodes the peptide sequence at SEQ ID NO. 70931
  misc_feature (696)..(696): n is a, c, t, g, unknown, or other
ctccccgcggtggcggccgctctagaactagtggatcccccgggctgcaggaattcgtctcacccctagaaaaatccgcatctcgcattctcgccggtgctgctgcaattaacgccgcctccggccaactacccgaaacctacctccgccgccgtcgtcaccaccgtcaacatggcgagccaaggggagccctcggcctctgctatcgatccgaaggagaagaacgacttctcgacggcgatcctggagaggaaagagtcaccgaaccgccttgtcgtcgacgaggcctccaacgacgataactccgtcgtcgctctgcaccctgagaccatggagaggctgcagctcttccgcggcgacaccgtgctccctcaagggaaagaagaggaaagacattttttcacccccccctttgcggaagaaaccctgttgaggaggccaagggttcgggatgaaccagggttttcccgccaaaacccaatgggtgaagggcttggtgaatttggttttctttgtcccccttttgccccccaatgtaaagaaatggggaaaccggggtccccctgcccttccaatttgattgaaaccgtttttaaggggctctacccgggaaaccttgtgttgaataaccttcctttaaaaaacctttttttccgtataaactctttcgcgggctcttttgaatgaaaacgggancccctg

SEQ ID NO: 70931 - protein, 171 aa, Zea mays
  misc_feature: Ceres CLONE 1551591
MASQGEPSASAIDPKEKNDFSTAILERKESPNRLVVDEASNDDNSVVALHPETMERLQLFRGDTVLPQGKEEERHFFTPPFAEETLLRRPRVRDEPGFSRQNPMGEGLGEFGFLCPPFAPQCKEMGKPGSPCPSNLIETVFKGLYPGNLVLNNLPLKNLFFRINSFAGSFE

SEQ ID NO: 70932 - DNA, 691 bp, Zea mays
  misc_feature: Ceres CLONE 1551592
  misc_feature: Encodes the peptide sequence at SEQ ID NO. 70933
ctggagctccccgcggtggcggccgctctagaactagtggatcccccgggctgcaggaattcgtctcacccctagaaaaagcaactctgcgagtgccagaaaaaaaatactgccacccaccaccgcgccgccgcgccatggcttccccatccccttcctcgcccctccagccggaccagcagccacctcctccgaatgttcaccaccaattccaatccctaccgccttctatgccgccaccgccgccgtcaacggcgctgccaaaggcgctcgacctggaggttaccgtcctctgcgtgaagcacctgaagaatgtcaactggcgccgtggcgacctccgtgcctacatcgtgttgaaccttgactcctcccgacgcgccgctacccgcccctacaacggcggccagggctaaccagactgaaactagcgcctcgacgtcactcttccgcacacctctacaatgaagaacctccgtctgcttgtcactcgaaggtttccttctaacttctccgattcggcatgacgatgcgtagatcagctcggtctcgtgacgtctacctcgtctgcccagaaagccataccctacctgagatctagcacggtcggatcatgtgatactgcgactcgtccatcatgcggacgaccacagggagatatcctgatacacacaccatcaggagctctcgacgt

SEQ ID NO: 70933 - protein, 91 aa, Zea mays
  misc_feature: Ceres CLONE 1551592
MASPSPSSPLQPDQQPPPPNVHHQFQSLPPSMPPPPPSTALPKALDLEVTVLCVKHLKNVNWRRGDLRAYIVLNLDSSRRAATRPYNGGQG

SEQ ID NO: 70934 - DNA, 660 bp, Zea mays
  misc_feature: Ceres CLONE 1551595
  misc_feature: Encodes the peptide sequence at SEQ ID NO. 70935
ctggagctccccgcggtggcggccgctctagaactagtggatcccccgggctgcaggaattcgtctcacccctagaaaaaaaagcaaagcagcttctctctctctgtctctctctctcgcctccctctcgacgacgatctcaggcgctcgcggggagtcgagtcgagaccagcctcgttccttcataaaaagctcacttagttgttgtccccgcatctttttttagctgttcttgtttgattacatcatcttattttgtgcttgaatctaacctgccattaagtttttatcgcttcgttatttctctgttgtgcttgtcttgttcttttgttgctctaaccatggacgcaggctcccgctcgatctcctcggcgaagaaccgcgccgccgccgccgccgccgcgccccggccgccgctgcaggaggcgggctcccgcccctacatgccatcgctgagctcgggaccccgcaacccgtcggccaagtgctacggcgacaggttcatcccggacaggtcggcgatggacatggactgggcgcactacttgcttactgagcccaggagggacaggagaacgcgtcgggcatggcggcgtccccgtccaaggagcgtacccggagctgctcgcggagagctgctcaacaccgggaacggatcct

SEQ ID NO: 70935 - protein, 106 aa, Zea mays
  misc_feature: Ceres CLONE 1551595
MDAGSRSISSAKNRAAAAAAAPRPPLQEAGSRPYMPSLSSGPRNPSAKCYGDRFIPDRSAMDMDWAHYLLTEPRRDRRTRRAWRRPRPRSVPGAARGELLNTGNGS

SEQ ID NO: 70936 - DNA, 659 bp, Zea mays
  misc_feature: Ceres CLONE 1551596
  misc_feature: Encodes the peptide sequence at SEQ ID NO. 70937
  misc_feature (459)..(459): n is a, c, t, g, unknown, or other
agctccccgcggtggcggccgctctagaactagtggatcccccgggctgcaggaattcgtctcacccctagaaaaaagtccccagtcccccactgggagcggcagccagcacgaggaaggagcagcgcgagggcaggcgccatgggggtccgctcggcggccacgaagctgcacatcccaccatccgccgcccgccgccccacgttcctgccattcgtggccgtcctcctcctctgctctgcctcctatctcatcggcgtctggcagcacggcggcttcgccactccatccgacaaacccgccgccgtctccaccgctacggccgtcgcctgcaccaacatcgccgccgccccgaaagagagaccgggtccgcgccagctccccgtccctcgacttctccgcgcgcaaggcggccgcggggaagaaccgctccaacctagaacggcaacggccgctccngggcggggccgggagggcgtctaacccggggtggcccccaggaaccccaaatacccccctggcaaggatggaaagggtccctccgttcccccgggaccccctggggtccccaaggcgcactccccggttaaaaagggagggcttctgtttcctttttcccccccccccgggaacccccccccctttctcggggggccccc

SEQ ID NO: 70937 - protein, 113 aa, Zea mays
  misc_feature: Ceres CLONE 1551596
MGVRSAATKLHIPPSAARRPTFLPFVAVLLLCSASYLIGVWQHGGFATPSDKPAAVSTATAVACTNIAAAPKERPGPRQLPVPRLLRAQGGRGEEPLQPRTATAAPGRGREGV

SEQ ID NO: 70938 - DNA, 720 bp, Zea mays
  misc_feature: Ceres CLONE 1551597
  misc_feature: Encodes the peptide sequence at SEQ ID NO. 70939
  misc_feature (593)..(593): n is a, c, t, g, unknown, or other
aaagctggagctcaccgcggtggcggccgctctagaactagtggatcccccgggctgcaggaattcgtctcacccctagaaaaacccgaagtctgaacatactagaagcgtaaccctaagtctcggaccccaaccctcgaggaaggcgaccggagatggcggcgtcgtctgcggtggagaagctcaaggtcctctgggactcgcaggtcaacgacgaggagcagtgggcgctcaattataagctgctgaaggctgctggtctgtttgcgggatccatcttcctgatgcggaacttcggtgatctgatggccatttagtacgcttatcagcgttgtttacttggatcctatgagtgttgttttgatgttccaataattcctgctatgaatatgagagctattgtgctcccacatagactagatctgtagcgatagtgcttgatctgttacactctgtcagcatagcgatcagaccctttcatatcggcatgtaccgtggatattttggatcgatggtatcattctgcacccttataatttttgatgggtcattatcttttttcggtaccaaaaatgggcaaacactgccctggncttcaagggttccggtttaattgcccccccggtgggacgggttcccgcccccggggccccttccccacggggcgcgcttacccttgggggcccatcacaaatcccttgccctggtttttaacgcccc

SEQ ID NO: 70939 - protein, 53 aa, Zea mays; identical to SEQ ID NO: 49007
  misc_feature: Ceres CLONE 1551597

SEQ ID NO: 70940 - DNA, 669 bp, Zea mays
  misc_feature: Ceres CLONE 1551599
  misc_feature: Encodes the peptide sequence at SEQ ID NO. 70941
  misc_feature (287)..(287): n is a, c, t, g, unknown, or other
  misc_feature (291)..(291): n is a, c, t, g, unknown, or other
  misc_feature (294)..(294): n is a, c, t, g, unknown, or other
  misc_feature (297)..(297): n is a, c, t, g, unknown, or other
  misc_feature (333)..(333): n is a, c, t, g, unknown, or other
  misc_feature (336)..(336): n is a, c, t, g, unknown, or other
  misc_feature (341)..(341): n is a, c, t, g, unknown, or other
aaagctggagctccccgcggtggcggccgctctagaactagtggatcccccgggctgcaggaattcgtctcacccctagaaaaacctcatccgtatctccctccctcttctcggcggccgtggcggcgccggaggactatgcgcggcctccaccgctgcccgcaccagctcctcctggtctctccaccgccgcggtccgcccccgcgtgccgccagtcggccaccgcctcatcgcggggcctcaggagctcccctcgcgtcttctccgcacccggggctcgggtagncgcngcngcncgcgaccaaaagtggggccacgtggaggggatgaanacngtggnaaaggagggcctaggggaaggcgctccccaggacccgggacccccgtggagtgccccatgttcccggccgtccctgggcttggcctactccctaacaattcccccgcaattgggaatattttcgttggctttttccccgtgccaaaagccttttccccctaaaaaagggggacaaaaaaccccccgggaaaaccggggggggccccggttttacggggtttccaaattttccgggccccgtaaaaaccccccccttttccccaaaggggggggaagttgtgccccccccaggggcacctttttggggggggaaaaaaacaaaaataat

SEQ ID NO: 70941 - protein, 177 aa, Zea mays
  misc_feature: Ceres CLONE 1551599
  misc_feature (50)..(50): Xaa is any aa, unknown, or other
  misc_feature (65)..(65): Xaa is any aa, unknown, or other
  misc_feature (68)..(68): Xaa is any aa, unknown, or other
MRGLHRCPHQLLLVSPPPRSAPACRQSATASSRGLRSSPRVFSAPGARVXAAARDQKWGHVEGMXTVXKEGLGEGAPQDPGPPWSAPCSRPSLGLAYSLTIPPQLGIFSLAFSPCQKPFPPKKGGQKTPRENRGGPRFYGVSKFSGPRKNPPLFPKGGGSCAPPRGTFLGGEKNKNN

SEQ ID NO: 70942 - DNA, 690 bp, Zea mays
  misc_feature: Ceres CLONE 1551602
  misc_feature: Encodes the peptide sequence at SEQ ID NO. 70943
  misc_feature (690)..(690): n is a, c, t, g, unknown, or other
tagctggagctccccgcggtggcggccgctctagaactagtggatcccccgggctgcaggaattcgtctcacccctagaaaacatggatctctactggcagacattgctcaagcgacgaataactatcatgagtaccagatgatcatgcacattgtgtggaagagggtcagtgacactggtaaaaattggcgtcatgtttacaagggattgattgttttggattacctggtggcgcatggcactgaacgagttattgatgacatcagagaacatgcttatcagatatcagcactagctgatttccagtacattgattcttctgggagagatcaaggtagcaatgtacgaaggaaatctcagagccttgtcagtttagttgatgataaagaaatgatacaggaagttacacagaaagcactctctaccaaggacaagtacaggagtgcgtttgcccccagtggcaggagcccaggtggatatggtggtgggttataataatgaccgctatgaaggcagctatgggcgttgatttgaccacccgaatttggaaatggggagggggagacttttggattccggggaacaataaacagaattttgggggaacctggaagggccccccccatcggggaaggaaaatctttttttccccaaatattcttaatgaaccccttttgggcaaaaaatan

SEQ ID NO: 70943 - protein, 118 aa, Zea mays
  misc_feature: Ceres CLONE 1551602
  misc_feature (1)..(86): Pfam Name: ENTH Pfam Description: ENTH domain
MIMHIVWKRVSDTGKNWRHVYKGLIVLDYLVAHGTERVIDDIREHAYQISALADFQYIDSSGRDQGSNVRRKSQSLVSLVDDKEMIQEVTQKALSTKDKYRSAFAPSGRSPGGYGGGL

SEQ ID NO: 70944 - DNA, 651 bp, Zea mays
  misc_feature: Ceres CLONE 1551603
  misc_feature: Encodes the peptide sequence at SEQ ID NO. 70945
tacccgcggtggcggccgctctagaactagtggatcccccgggctgcaggaattcgtctcacccctagaaaaaaccgtccacctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaacccccgagagatccccgtgggtgaggctggtgctgagtatgtcgtggagtccacccggtgtcttcactgacaagggacaggctgctgcacatctggaggggtggtgccaagagggttgttatctctgccccaagcaagatgcacccatgttttgttggttgttgtcattaggaacaagaccccctcccatgttaactttggttccaatgctagctgcaccaaatttgccttggctcc

SEQ ID NO: 70945 - protein, 105 aa, Zea mays
  misc_feature: Ceres CLONE 1551603
  misc_feature (4)..(103): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDITLKDSKTLLFGEKPVTVFGIRNPREIPVGEAGAEYVVESTRCLH

SEQ ID NO: 70946 - DNA, 619 bp, Zea mays
  misc_feature: Ceres CLONE 1551606
  misc_feature (215)..(215): n is a, c, t, g, unknown, or other
  misc_feature (216)..(216): n is a, c, t, g, unknown, or other
  misc_feature (219)..(219): n is a, c, t, g, unknown, or other
  misc_feature (280)..(280): n is a, c, t, g, unknown, or other
  misc_feature (295)..(295): n is a, c, t, g, unknown, or other
  misc_feature (308)..(308): n is a, c, t, g, unknown, or other
  misc_feature (597)..(597): n is a, c, t, g, unknown, or other
ctccccgcggtggcggccgctctagaactagtggatcccccgggctgcaggaattcgtctcacccctagaaaatccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcnncangcgagggcgtgcagatccagatccggtgggcgggaaggacttgatcgcccccaccaccatnggccggcgcggtgtncggcgctcttccntgctgggaactttaaaagggccccccgtttttccctttctggggccaactacccgcgggaatttttccccccccccggggggaagggttttttcaaaaatccccccaaaaagggggggggtttccaaaggggccccccccctggggggtcaaaaaaaacacccggggggcccttttaattgtgtttccccccccccaacaaaaaaaagtgtttttttttttctccccaaaaaggggggggttttttagaaaaaaaaaaaatattgggtctatgtgggggggcgggcctnatacctctatttttcccttccg

SEQ ID NO: 70947 - DNA, 716 bp, Zea mays
  misc_feature: Ceres CLONE 1551607
  misc_feature: Encodes the peptide sequence at SEQ ID NO. 70948
  misc_feature (610)..(610): n is a, c, t, g, unknown, or other
atagctggagctccccgcggtggcggccgctctagtactagtggatcccccgggctgcaggaattcgtctcacccctagaaaaaagcacatcccattcccctcgtctcatctcaagagcgactaccgagagagaggaagagaacaagcgataagctcatctcgcacgcaagatgcgggctccaaggggcgcaagcggctgccgcggcggccaggatcatgcggaactgatccctggcatccccgacgacgtgtgcgtggactgcctggcgcgcgtcccccacgcctcccaccgcgcgatgcgccgggtctgccgcggctggcggagcgccgccgcggagccggccttcgcgtcggcgcgcgccgcggcgggcgccaacgaggacctcgtgtaactcatgcagctcgggaacccgtcccgctacgacaggcccaacgacggcgactactgggccggcagcaccccggcgtacggcgtggcggtgtacaacgtgacaaccgcctaatggcggcgagagcgcggcgcgccccccgagccgccggtgttcgcgcattgcgcgacggtgaggactcacgtggccgtgctgggcggctgggaccctcgcatcttcnagcccgtggggcacgtgcacgggcatgacgacaaacagggcggcggcgaccccgccgcgaccatgatgtcggaacgcttcttgcttctctgacgataggatggcgt

SEQ ID NO: 70948 - protein, 73 aa, Zea mays
  misc_feature: Ceres CLONE 1551607
  misc_feature (18)..(65): Pfam Name: F-box Pfam Description: F-box domain
MRAPRGASGCRGGQDHAELIPGIPDDVCVDCLARVPHASHRAMRRVCRGWRSAAAEPAFASARAAAGANEDLV

SEQ ID NO: 70949 - DNA, 612 bp, Zea mays
  misc_feature: Ceres CLONE 1551608
  misc_feature: Translation starting site: 375
  misc_feature (248)..(248): n is a, c, t, g, unknown, or other
  misc_feature (337)..(337): n is a, c, t, g, unknown, or other
  misc_feature (414)..(414): n is a, c, t, g, unknown, or other
tggagctccaccgcggtggcggccgctctagaactagtggatcccccgggctgcaggaattcgtctcacccctagaaaaaaaagcgaaaggagagaaggaatccgatccatccaagccaagccaaggcagagaagaagaagaagaggaggaagaagaagcatcggcagcatgtcggaggggactgccaactgcgtggacatcctgatcgccatcatcctgcctccgctgggggtgttcctcaagtacngggtggcggccacgagttctggatctgcctcctcctcaccttcctcggctacatccccggcatcatctacgccatctacgccatcaccnaagaacactagctagtcatccttgccgacgacgatccatgtctctgtatctgcgtctggtcatatgcctgatgccgnactgtgctggatgtagttgctttgatttcagtcgtggtttgctaccgtacccaccccatgcatcatctggtcacggcgacggcattatcatagtaataaacaggtccgaaattgatttcattcaaaaagcttggagcactcattcacctactttacctcaaggtctaaagctaccctttttgctttgctcccccgaca

SEQ ID NO: 70950 - DNA, 732 bp, Zea mays
  misc_feature: Ceres CLONE 1551609
  misc_feature: Translation starting site: 581
  misc_feature (693)..(693): n is a, c, t, g, unknown, or other
aaagctggagctcaccgcggtggcggccgctctagactagtggatcccccgggctgcaggaattcgtctcacccctagaaaaacaagcaccagaccaattaactagcttcttctagctctagctaggctcgtctgctgcaagaaggtaacagtaacagcaaggcatggagggggaaggaggaggacgtccgcctgggcgccaacaagttctcggagcgccagcccatcggcacggcggcgcagggcacggacgacaaggactacaaggagcccccgccggcgccgctcttcgagcccggggagctcaagtcctggtccttctaccgcgccggcatcgccgagttcgtcgccaccttcctcttcctctacatctccatcctcaccgtcatgggcgtctccaagtccacctccaagtgcgccaccgtcggcatccagggcatcgcctggtccttcggcggcatgatcttcgccctcgtctactgcaccgccggcatctccggcgggcacatcaacccggcggtgaccttcgggctgttcctggcgaggaattgtccctcaccagggcggtgtttacatcatcatgcagtgcctgtgcgccatctgcggcgcgggcgtcgtcgaagggttccagcaggggctgtacatgggcaacggctgctggcgctacgtcgtggcgcccggctacaccatggncgacggcctagtgcgccgagatcgtctgcaccttcatcc

SEQ ID NO: 70951 - DNA, 596 bp, Zea mays
  misc_feature: Ceres CLONE 1551612
  misc_feature: Translation starting site: 221
  misc_feature (26)..(26): n is a, c, t, g, unknown, or other
  misc_feature (31)..(31): n is a, c, t, g, unknown, or other
  misc_feature (34)..(34): n is a, c, t, g, unknown, or other
  misc_feature (331)..(331): n is a, c, t, g, unknown, or other
  misc_feature (340)..(340): n is a, c, t, g, unknown, or other
tcacgcggtgcggcgcttagactagntgggnatncccccgggctgaggattcgtctacccctagaaaaatgtgctgggagccccgtcagcaaggacttcccgctcgccatctaccccgtcgacaagggtgccgctcccctacgagctgttcgggcccaagccgcccaccccggcgcccgcgccggccccggcacccgtcaagtccaagaccaagaagaagatgaaggccgccggcatctgcgaagcgcccacggccgacgacgacacctccgcctccgacgaccataatggcgccgccgcgcctggcaccgcggcaggtggggacgcacgngctctcggngcttcgccgcgctgccctcggcgccggctcttctgatgggaagagaaggaaagaatccgcccccatcggtcaaaattgaagtccatggggcggccctcctgcgggggaaataaatccttctggccccgggccttgatttgccataaatgtcccaggggcaaaaaataaaaattgggtgccccccccccccgtgaccaaccgggatttgggggtttataaatttttcccccctgggttttccccccctttttctttg

SEQ ID NO: 70952 - DNA, 694 bp, Zea mays
  misc_feature: Ceres CLONE 1551614
  misc_feature: Encodes the peptide sequence at SEQ ID NO. 70953
  misc_feature (1)..(1): n is a, c, t, g, unknown, or other
  misc_feature (278)..(278): n is a, c, t, g, unknown, or other
  misc_feature (368)..(368): n is a, c, t, g, unknown, or other
naagctggagctcaccgcggtggcggccgctcctagaactagtggatcccccgggctgcaggaattcgtctcacccctagaaaaaaatcttgtccagacgtgcatcatatcctccgtgtgatccattcatccccgcgccgtgctagcttgctagttgcaagcaccagccgaccaccaaacgatagcgcacgcggaacatttaacagcatcaggtttaggccctgctgccgtcgtcgagcgcccgggccacgcacacctgaaagcaatggagatcgtcngcacgcgctccccggcctgctgcgccgccgtgtcctttctccagtcgtacaggcccaagggcggtcagccgccgacaacgtttctacggnaagtctgtgcggggggaaaacggggcgggccgctcccggcaagaaggaattcaaagggggccagcccgccgggcccctaggtgccggggcgaaaatcggaaaaagcccggaagaaattcctgaaccaaggggacccccggaaaaaaaccccttagggggtctcaattggtgggggggaggccttgggaaaaaatcgtttaaagggccgaaaagggtccctgggggggacacccctgggtataacccccttttcgaaaaaaaaaaggggggcccaaaaatttccccataaaaaacccccctttgggggttggggagaacccacagtg

SEQ ID NO: 70953 - protein, 60 aa, Zea mays
  misc_feature: Ceres CLONE 1551614
  misc_feature: SWISSPROT Homolog: EC 3.1.3.37 Sedoheptulose-bisphosphatase
  misc_feature (5)..(5): Xaa is any aa, unknown, or other
  misc_feature (35)..(35): Xaa is any aa, unknown, or other
MEIVXTRSPACCAAVSFLQSYRPKGGQPPTTFLRXVCAGGKRGGPLPARRNSKGASPPGP

SEQ ID NO: 70954 - DNA, 725 bp, Zea mays
  misc_feature: Ceres CLONE 1551615
  misc_feature: Translation starting site: 214
  misc_feature (640)..(640): n is a, c, t, g, unknown, or other
aagctggagctcaccgcggtggcggccgctctagaactagtggatcccccgggctgcaggaattcgtctcacccctagaaaaatagaaaaagttcaattcgatcacttcttccattccaatttccacacacacacgtctcagctcactccctcctccagtttcgtcagctcgtcatcataaaccgaacacagagctctcgattccattccaggatgctgctgaacccggcgtcagagacgtcggtgctagacaccatccggcagcacctcctcgaggagccagcggcggcggaggcgcggccggccgacgagagcttcgggagcctggtggcggaccagtggagcggctcgctcccgttccgcaccgacgacgccgacgacatggtggtgttcggggtgctgcaggacgccttcgcctacggctggctgcccgacggctcattcgtgcacgtgaagcccgagccagtgcggtcccccgactcgtcctcctaccacccctgctcctacgacggctcaccctgcttcggcctcctggacccggagcccgcgctgacgcccggcaccaccacgcccggggaggggcaggaggaagcccgcgcggccatggcccggggcagcactacaggggggtgaggcagcngccgtggggcagttcgcggcgagatcagggaccccgcaggacggcgcgcgcgtctggctcgcacgtacgacacgccgaggacgcc

SEQ ID NO: 70955 - DNA, 696 bp, Zea mays
  misc_feature: Ceres CLONE 1551617
  misc_feature: Encodes the peptide sequence at SEQ ID NO. 70956
  misc_feature (385)..(385): n is a, c, t, g, unknown, or other
  misc_feature (502)..(502): n is a, c, t, g, unknown, or other
  misc_feature (552)..(552): n is a, c, t, g, unknown, or other
caaagctggagctccccgcggtggcggccgctctagaactagtggatcccccgggctgcaggaattcgtctcacccctagaaaaaacctcgcctccccccactcctgccctccctcgctcacccagtggggcagccaaagccgagccgcaaccgcaaagatcttgcgcggcctcctttccacagctcgtcactgtgccgctcgtgccatccaccctcggttcacccaaccaacaatccatccggcaccacaccccgctgcggcgatgtgcggcggcgccatcctctcgggtctcatcccgccgtccggggtgccggcggcggcagcggcggccaagaagaaacagcagcggcgtgcgacggcggacctgctgtggccggggcccngcaagaagggagcgccccgggaagaagacttcgaggccgacttccgcgagttcgagcgcggcctcggagaagatgacgtaaacggggccgcgaacaagtcaagagcttcctctgccngaaccggaaggctcgccttccccgcgccgttggggccgcgcgcactgcantttaacgcgtgatgaccccaaaggaagttaaaggaaaaatgcctactacccttaacaactcaacgcaaaaaaaccgccgggggaaaaaccccttccgaagaaaccccggcgccgccccgggggaaaaatggggggcccaaaaaa

SEQ ID NO: 70956 - protein, 99 aa, Zea mays
  misc_feature: Ceres CLONE 1551617
  misc_feature (41)..(41): Xaa is any aa, unknown, or other
  misc_feature (80)..(80): Xaa is any aa, unknown, or other
  misc_feature (96)..(96): Xaa is any aa, unknown, or other
MCGGAILSGLIPPSGVPAAAAAAKKKQQRRATADLLWPGPXKKGAPREEDFEADFREFERGLGEDDVNGAANKSRASSAXTGRLAFPAPLGPRALXFNA

SEQ ID NO: 70957 - DNA, 686 bp, Zea mays
  misc_feature: Ceres CLONE 1551618
  misc_feature: Translation starting site: 187
aagctggagctccccgcggtggcggccgctctagaactagtggatcccccgggctgcaggaattcgtctcacccctagaaaaactcgcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaacgtgctcggcgagaagggccgcaggatcagggagctcacgtctgtcgtccagaagaggttcaacttccccgagaacggcgtcgagctctacgccgagaatgtcgtcaaccgcggcctctgcgccatcgcgcaggctgagtccctccgctacaagctcctcggaggccttgccgtccggaggggctgctatgggtgtcttcgctttgttaaggagagtggtggcaagggttgtgaggtcaattgtgagtggaaagctcagggctcaaaaagcaaagtccatgaaaatcaagggaggctacatgatctcatctggccagccagggaatgaaa

SEQ ID NO: 70958 - DNA, 678 bp, Zea mays
  misc_feature: Ceres CLONE 1551620
  misc_feature: Translation starting site: 302
  misc_feature (528)..(528): n is a, c, t, g, unknown, or other
  misc_feature (532)..(532): n is a, c, t, g, unknown, or other
ctggagctccccgcggtggcggccgctctagaactagtggatcccccgggctgcaggaattcgtctcacccctagaaaaatccggttccgcttcggcgcgtccctctgttgccttgcccttgccgccaaccaacacccccgaccccgagagccgagcccctcttgcttggccctcaagctttcggtgcgtcacccgccgccaaccctcgacgagactccgattctcttttcccctaggccaaggtctggccttccggtctttcttcacgccgtttgtgcggtgcggtggcgatcgtccgcgatgggcgccgcgcggggagaggaggacggggaggggcgctgcggcgagcggtgcccgtcgtggtacgtgagccgggaggagatcgagagcggctcgccgtcgcggcgggacggcgtcagcgcggccaaggaggccgagctccgggccacctactgctcccttcatcgcgacgtgtgcatcagactccgactgccgcagattacaatggccacggcgatcatgctctngcancgttttctacctccgccagtctcatgccaagaacgagtggcagactattgcaactgtctgcatatttcttgggtcaaagatagaagacccaccttgtcaattgaaacacggggtcattgtggtctttgaaacaatgttccataaaa

SEQ ID NO: 70959 - DNA, 677 bp, Zea mays
  misc_feature: Ceres CLONE 1551622
  misc_feature (80)..(80): n is a, c, t, g, unknown, or other
  misc_feature (313)..(313): n is a, c, t, g, unknown, or other
  misc_feature (398)..(398): n is a, c, t, g, unknown, or other
  misc_feature (404)..(404): n is a, c, t, g, unknown, or other
  misc_feature (450)..(450): n is a, c, t, g, unknown, or other
agagctggagctcaccgcggtggcggccgctctagaactagtggatcccccgggctgcaggaattcgtctcacccctagnaagattgcaaatgtttctcttcctctctcccacctctcctctcctctccattgcaaaccttcgggatgaaggttgagagcctgctctgaaacgacgtacgtaaagggagcaaggaaccggagagcgtgcggcgggcttctggattttagagtaggcacctgtcgcttggacgtgcttcggagaagtaggtgtccaaaagttgcttacagtggatccagatccttcgaacaacnttgctcaagctcatgatatagactgtcatggaggcagctgcacatgaggatatgccccccccccggggggggggggggggggatnattaancttcctccacatacactacccaccaaaccccccatatcccccagcngcgtgctctaaaaaaaaccccggggaatggaaaacattcttcatgaattcgggacccaggtccccgaaagcctgggattttaccccccccccgaagaccccgctcccccgccgcgcggctgagcttgggggaccccccattcccagggcccggccaagaggtcccccccggaaccgcggcggggcgaccgcggggccgcccgcgggggggggcgggggggggggggg

SEQ ID NO: 70960 - DNA, 689 bp, Zea mays
  misc_feature: Ceres CLONE 1551624
  misc_feature: Translation starting site: 139
  misc_feature: SWISSPROT Homolog: EC 1.1.1.95 Phosphoglycerate dehydrogenase
ctccccgcggtggcggccgctctagaactagtggatcccccgggctgcaggaattcgtctcacccctagaaaaaccaccagacgccacccaacaccctaaacccttcgacccaacccgcctccaactccaaagccgtcatggcggcgccgtccccgaccactaccgccgccgccgccgccgccgccacgacccaccaccgcgtgctcctcccatccgcgcgcccccgcgccgcgccctcttctctccgcctcccgctccgcgcgcagccccacgcccacgcccacgcccagcgcgcgcgcctcgccgcccccgtcgcggccgcggccccggccccggcggcgtcgacggcctcccccgagtcccccgcgtcgggcgccgtcgcggggaagcccacgggtgctctcggccgaaggcctcggcgccgcggggcctcccgctgctgcgggagttcccccacgccaactgctcgtacggcctctcccccgaggacctccccgccaagatctcgccctggaacccgctcatcgtcagggcccgggaccaagggccggcccgcaacgtctttccaaggcgcccgggggggaaggcttccccggtcctcgggcccgccccgggggttcgggaatcaaaaaactgtgaaaccttggcccggcgcccacaggagagagggggttgccctccgttctta

SEQ ID NO: 70961 - DNA, 652 bp, Zea mays
  misc_feature: Ceres CLONE 1551625
  misc_feature: Translation starting site: 140
  misc_feature: SWISSPROT Homolog: EC 1.14.13.21 Flavonoid 3'-monooxygenase
  misc_feature (409)..(409): n is a, c, t, g, unknown, or other
ctggagctccccgcggtggcggccgctctagaactagtggatcccccgggctgcaggaattcgtctcacccctagaaaaaaccagtcaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgcccggtccccggggctggccggtgctgggcaacctgccgcaggtcggcgccaagccgcaccacaccatgtgtgctctggcgcgggagtacggccccctgttccggctccggttcggcaccgccgaggtggtggtggccgcgtcggcgcgggtggcgccccanttcctgcgcgcccagaacgcaactttcagaaccgcccgcccaaatccggggccaagcacgtggcgtacaactaccaggaccctggtgttccccccgtacggcttcccgggtgcgcccccctaccggaagctgtgcgcgcctccaccttttttctccgcccaggggccctggaacaacctggcccgggcgttaagggaaagggcaaaggttgccccttcatgggggggggggaagccccccccg

SEQ ID NO: 70962 - DNA, 663 bp, Zea mays
  misc_feature: Ceres CLONE 1551626
  misc_feature: Encodes the peptide sequence at SEQ ID NO. 70963
  misc_feature (365)..(365): n is a, c, t, g, unknown, or other
  misc_feature (379)..(379): n is a, c, t, g, unknown, or other
  misc_feature (387)..(387): n is a, c, t, g, unknown, or other
  misc_feature (390)..(390): n is a, c, t, g, unknown, or other
  misc_feature (393)..(393): n is a, c, t, g, unknown, or other
  misc_feature (414)..(414): n is a, c, t, g, unknown, or other
  misc_feature (431)..(431): n is a, c, t, g, unknown, or other
  misc_feature (438)..(438): n is a, c, t, g, unknown, or other
  misc_feature (461)..(461): n is a, c, t, g, unknown, or other
  misc_feature (475)..(475): n is a, c, t, g, unknown, or other
  misc_feature (496)..(496): n is a, c, t, g, unknown, or other
  misc_feature (542)..(542): n is a, c, t, g, unknown, or other
  misc_feature (543)..(543): n is a, c, t, g, unknown, or other
  misc_feature (577)..(577): n is a, c, t, g, unknown, or other
tccccgcggtggcggccgctctagaactagtggatcccccgggctgcaggaattcgtctcacccctagaaaaagcctaccccgtccctccccagcgcgccgtctagggtttcacagcggtgccccgatccattcgagcgccccgcaccgccgccatggagtttgacgaatacgagtacttggagaaggcggtggagcccgctcctccacaggccaatggttccggctccggctccggcgagaaggaccggggctcgcgccgccgcgagggcggcgaggaccgcatatcgaagcgctctcgctcggggggggaccgcgaccgggacaggcaccgcagcggccgggagcaccgtgaccgggacaggnatgacgtgaagganggagaganccngcnaaagcccgcgggaggacaggnacagggacagggagggnaaaaaancgggaaaaggagaggggaaacangcatcggctgaganagagggagtgggacgggagcngaagacccggagccgctcgaaagcgcccccgtgcggggaaagagannatgtttagggactggaacgggagcccgaagccancaagcaacatcctatcccaacgttgatgtcaggcctagaaaaaatacggggccaacccaaaagtggatccagaaggggaccagagg

SEQ ID NO: 70963 - protein, 105 aa, Zea mays
  misc_feature: Ceres CLONE 1551626
  misc_feature (71)..(71): Xaa is any aa, unknown, or other
  misc_feature (75)..(75): Xaa is any aa, unknown, or other
  misc_feature (78)..(78): Xaa is any aa, unknown, or other
  misc_feature (79)..(79): Xaa is any aa, unknown, or other
  misc_feature (80)..(80): Xaa is any aa, unknown, or other
  misc_feature (87)..(87): Xaa is any aa, unknown, or other
  misc_feature (93)..(93): Xaa is any aa, unknown, or other
  misc_feature (95)..(95): Xaa is any aa, unknown, or other
  misc_feature (103)..(103): Xaa is any aa, unknown, or other
MEFDEYEYLEKAVEPAPPQANGSGSGSGEKDRGSRRREGGEDRISKRSRSGGDRDRDRHRSGREHRDRDRXDVKXGEXXXKPAGGQXQGQGGXKXGKRRGETXIG

SEQ ID NO: 70964 - DNA, 659 bp, Zea mays
  misc_feature: Ceres CLONE 1551631
  misc_feature: Encodes the peptide sequence at SEQ ID NO. 70965
  misc_feature (456)..(456): n is a, c, t, g, unknown, or other
gcggtggcggccgctctagaactagtggatcccccgggctgcaggaattcgtctcacccctagaaaaatcactagaggtggacatccctccattaatttaagggatttttatgtccaccgccgccgccagcgccaactaaacccgcgacgacggtcgaccatggcgtcctcgctgctctcctcccccgctaaacccaccaccaccaaaacgaccccggccccaagacccgcccgctccgcccatgtccatgtcctctccgccgcccgctgcctccgcctccgcctccgcgcggtccccgcccgagcgtcgtcgcagcatcctccgcctccgcccaccccgcggtcgcggcggccggagtacgtcccgaaccgcatcgacgaccccaactacgtgcgcatcttcgacaccacgctgcgcgacggggagcagtcgccgggcgccaccatgacgagcgnccagaagctcgtcgtcgcgcgccagctggcccgccctcgcgtcgacatcatcgaggccggggtcccgggctcctcccccgacgacctcgacgccgtgcgctccatcgccatcgaggtcggcaacccggcgccaggacccgccggggaggaggacgcccgtcacgtgccggtcatctgcggcctctcgcggtgcaaccgaggaa

SEQ ID NO: 70965 - protein, 71 aa, Zea mays
  misc_feature: Ceres CLONE 1551631
  misc_feature: SWISSPROT Homolog: EC 2.3.3.13 2-isopropylmalate synthase
  misc_feature (4)..(4): Xaa is any aa, unknown, or other
MTSXQKLVVARQLARPRVDIIEAGVPGSSPDDLDAVRSIAIEVGNPAPGPAGEEDARHVPVICGLSRCNRG

SEQ ID NO: 70966 - DNA, 637 bp, Zea mays
  misc_feature: Ceres CLONE 1551633
  misc_feature: Encodes the peptide sequence at SEQ ID NO. 70967
  misc_feature (362)..(362): n is a, c, t, g, unknown, or other
ggagctccccgcggtggcggccgctctagaactagtggatcccccgggctgcaggaattcgtctcacccctagaaaactctcgaaaccctagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccaacgaccagggtaaccgcaccacgccctcgtacgtcgccttcaccgactccgagcgcctcatcggagatgcggccaagaaccaggtcgccatgaaccccatncacaccgtctttgatgccaagcgtctcatcggcaggaggttcagtgatgcgtctgtccagagtgatatcaagttgtggcccttcaaggtcattttctgggcctggtgagaagccaatggatggttgtccagcaccagggtgaaggaaaaccattttgccacttaaaaaaaccccctcttggggttcttatccaagatgcgctgaaatttcctaaaacctttcccttggggaacccccaatcaaaaaatgggtggggggccacaggccccccccct

SEQ ID NO: 70967 - protein, 102 aa, Zea mays
  misc_feature: Ceres CLONE 1551633
  misc_feature (67)..(67): Xaa is any aa, unknown, or other
MAGKGDGPAIGIDLGTTYSCVGVWQHDRVEIIANDQGNRTTPSYVAFTDSERLIGDAAKNQVAMNPXHTVFDAKRLIGRRFSDASVQSDIKLWPFKVIFWAW

SEQ ID NO: 70968 - DNA, 628 bp, Zea mays
  misc_feature: Ceres CLONE 1551635
tggagctcacgcggtggcggccgctctagactagtggatccccgggctgcaggatcgtctcacccctagaaaagagagacagagagaaaaccctaaccctaacaatcatttccaggcccccgccccccggcgtctccagaacttccagaccttcaggaacctccacggcgagcctcgttcccgccctatctcccatttcccccggcggcgcgcgggatctgatctggcccttctgcggggtttcctgtagacagggcaagccggtttttgaacgtggaaggaaacctgccgcttcatccgcggcggggagggggaattccctagcggggaggatctcggcttggggcggctgggtaaaaaggggtaagacccaccccgggggtggggggtcggaaaaccaaccggggggggggggggggaggaactgaggggggggcggagtggagcctttcgccccaaaatcctcttccaggggtggtgtgtgaacactccccccccattggttgatggggaggcccccccccttggttttccttatactagagaggtggttatgaaaagacagccctctcaatattggcacaccatatcgctcgggtttcaagcgggcgctgccacccagtaccgg

SEQ ID NO: 70969 - DNA, 2745 bp, Zea mays
  misc_feature: Ceres CLONE 1551638
  misc_feature: Encodes the peptide sequence at SEQ ID NO. 70970
acctcctcgtcgtcgtcttggccgcagcagccagcaggtcgcggccatggcctccgtctccctcctactctgcctcctcctccttgtgccacctctcgccgccgcccagcagcagatgtcctctttctccgcaaacaactcgacctggagccccacgaacagcaaccgcatcctcgtgtcgatcaatcgggaattcgccgccgggttcgtggcgtcgacctctgctcgggatcgctaccacttcgccgtctgggtcgtcggctccaactccaccgacaaggctttcatatggtacgcccacgacacagccagctactccccctacgagggcaacgacacctccaagctcgccatcgacgcggcgggccggctcacctggactgccggcgggaacaacaacgccaccatctggtcgctcccgccccccgccaacaccaccaccaccccggcggtgctgcagctcaacgatacggggagcctggtctacggggcagcctggtcgagcttcgccgagcccaccaacacgctcatgccggggcaggccatgcccaagggaggcaacgacaccacgctccagtccgtcaacggccactacagggtcgtcaactccgccacgctgcagttcaacaattccatgatgtacgccaacatcagcggcggcagcgctctgctcaatctcaccgccgacggcaagctccagttcagcggctcgcagctcatcgcctccgaccaaggcaccaccaatcgggtgcggcggctcacgcttgacgacgacggcaacctgcgcctctacagcctggtgcccaagacccggaagtggctcgtggtgtggcaggtcgtgcaggagctctgcaccatccggggcacctgcgccaacggcagaatctgcgtccccgtcggcgttgacagcaccacttgcgtctgcccgccgggctaccgcaacgccaccccgacggacccctgcacacccaagaaaaggtacagcggcaggggcgacgacgacacgttcgtgcggatggacttcgtctccttctccggggccgccaactcctcggcgtcggaccccgggccgctgatgaccaagctgacgccgcagaacctggcggactgcgagagactctgccggagtaactccacctgcgtggcgttcgggtacaagttcggcggcgaccggacgtgcctccagttcaccgggctggtggacgggtactggtccccggcgacggagatgtcgacctacctgcgggtggtggcgtcggacaaggacagcaacccgttcacggggatgacgaccatgatcgagacggtgtgccccgtgcggctgtcgctgccggtgccgccgaaggagtcgcggacgacgatccagaacgtggccatcatcacggcgctgttcgtggtggagctgctggccggggtgctgtcgttctgggcgtttctgcgcaagtactcccagtaccgggagatggcgcgcacgctggggctggagtacctccccgccggcgggccccggcggttctcgcacgcggagctgaagcaggcgaccaaggacttctccaacgtggtggggcgcggtgcgtacgggacggtgtaccgcggcgagctgcccgaccggcgcgccgtggcggtgaagcagctgcaaggcgtgggcggcggcgaggcagagttctgggcggaggtgaccatcatcgcgcgaatgcaccacctcaacctggtgcgcatgtgggggttctgcgccgaaaaggagcagcggatgctggtgtacgagtacgtacccaacgggtcgctggacaagtacctgttcgccggcggaggcggaggcggtgggagcggcgaggaggattcgtcctctgagcagcagcagcagcagccgctgctggaccttcacacccgttaccgcatcgcgctgggtgttgcccgcgccatcgcctacctccacgaggagtgcctggagtgggttctccactgcgacatcaagcccgagaacatcctgctggaggacgacttctgccccaaggtgtccgacttcggtctgtccaagctgacgagcaagaaggagaaggtgaccatgtcgcgcatccgcggcacccgcgggtacatggcgcccgagtgggtgatccaccgcgagcccatcacggccaaggccgacgtgtacagcttcggcatggtcctgctggagatcgtgtccggtcgccgcaactacgggttccggcaggagtcggtgggcagtgaggactggtacttccccaagtgggcgtacgagaaggtgtacgtggagcgccgcatcgacgacatcctggacccccgcatcgccgccacctacgacgacgccgccagcgtcgccaccgtggagcgcatggtgaagacggccatgtggtgcctgcaggaccgcgccgagatgcggccgtctatggggaaagtgtccaagatgctggaggggtccgtcgagatcacggagcccgtcaagccaacaatcttctgcgttcaggacgactgatgactacacaagttttttttctttcatttccagatgtgaattcccagtgccgtctgccgtccaccgtcaatagaattttagtagctgttcacttccactctttgtttttttttttggtttgcatagcaaaagctatactaatccttaagtattgtgaatccaccgtccaggaatccgctaagttattgttcacatagtccaccttgcacccattaccaaatttgtttctaggccataaaaaaaaaaaaaaa

SEQ ID NO: 70970 - protein, 815 aa, Zea mays
  misc_feature: Ceres CLONE 1551638
  misc_feature (500)..(795): Pfam Name: Pkinase Pfam Description: Protein kinase domain
  misc_feature: SWISSPROT Homolog: EC 2.7.11.1 Non-specific serine/threonine protein kinase
MASVSLLLCLLLLVPPLAAAQQQMSSFSANNSTWSPTNSNRILVSINREFAAGFVASTSARDRYHFAVWVVGSNSTDKAFIWYAHDTASYSPYEGNDTSKLAIDAAGRLTWTAGGNNNATIWSLPPPANTTTTPAVLQLNDTGSLVYGAAWSSFAEPTNTLMPGQAMPKGGNDTTLQSVNGHYRVVNSATLQFNNSMMYANISGGSALLNLTADGKLQFSGSQLIASDQGTTNRVRRLTLDDDGNLRLYSLVPKTRKWLVVWQVVQELCTIRGTCANGRICVPVGVDSTTCVCPPGYRNATPTDPCTPKKRYSGRGDDDTFVRMDFVSFSGAANSSASDPGPLMTKLTPQNLADCERLCRSNSTCVAFGYKFGGDRTCLQFTGLVDGYWSPATEMSTYLRVVASDKDSNPFTGMTTMIETVCPVRLSLPVPPKESRTTIQNVAIITALFVVELLAGVLSFWAFLRKYSQYREMARTLGLEYLPAGGPRRFSHAELKQATKDFSNVVGRGAYGTVYRGELPDRRAVAVKQLQGVGGGEAEFWAEVTIIARMHHLNLVRMWGFCAEKEQRMLVYEYVPNGSLDKYLFAGGGGGGGSGEEDSSSEQQQQQPLLDLHTRYRIALGVARAIAYLHEECLEWVLHCDIKPENILLEDDFCPKVSDFGLSKLTSKKEKVTMSRIRGTRGYMAPEWVIHREPITAKADVYSFGMVLLEIVSGRRNYGFRQESVGSEDWYFPKWAYEKVYVERRIDDILDPRIAATYDDAASVATVERMVKTAMWCLQDRAEMRPSMGKVSKMLEGSVEITEPVKPTIFCVQDD

SEQ ID NO: 70971 - DNA, 653 bp, Zea mays
  misc_feature: Ceres CLONE 1551639
  misc_feature (316)..(316): n is a, c, t, g, unknown, or other
ctggagctccccgcggtggcggccgctctagaactagtggatcccccgggctgcaggaattcgtctcacccctagaaaaaacgggcgtagagagagagagagagagagagagagcgcgaagagggcgtgagagaggagggaggccaagccgtacgcgtcatctcctgctgtttcttcggttcttcccatccctttcctgcctcggcttgcaccttcaaccttgcttgtgaacatctctgattccattttcatctgttgggtggcaagaaactaatcaaggagtctctctcttctcattctctgcgtggaggactgnttagctgtagctgagcggcatgctttcccagacataaaattgtgggaagagagtttgatgctaccactttgccagagggaccgaccagacccattaacctcaacctgagcccctgcagtttcccaactttttcatttggcaaattgaaaccaccaagtcccccccttccctttgcattttgaaaaaacctttttttaagcctgggtcaagggtttgggcggggggggaaaccaggcttaaggggtgaaaacccaagggtcccttccaagcccggggggggacccctcccacccctttttgtcccccgggaaacccggcccccctgtttttttttttt

SEQ ID NO: 70972 - DNA, 584 bp, Zea mays
  misc_feature: Ceres CLONE 1551641
  misc_feature: Encodes the peptide sequence at SEQ ID NO. 70973
  misc_feature (7)..(7): n is a, c, t, g, unknown, or other
  misc_feature (11)..(11): n is a, c, t, g, unknown, or other
tctttancagnggatcccccgggctgcaggattgcgtctcacccctagaaaaaaagacagccagccacgcacctccgcgccgcgccgagctcctccctttgcctaccgcccttccctccgcgcgaggaaaaagccagcagcaagcaatcaactcagcggagcacggcaaagcaaacgaagagctcgcgttggcgttgccgatttgccgtgccttgcctagctagcttcgccacgacgaacctgacgtgagagcgcggcgaccacccccaccggccaccggcgcgcgagtagcttcctgtcgttcgttccctccgcgagagcgtctatttacccccgagagagccggacgcgcgagatggagatggcggggggcggcgaggccgacacgccgtcgcacgagccggtgcgcacggcccggagccacaccatcctgctccccatcgtcggcgtcctcttcggcctacctggtctaccgtttcctccggccgggccttcgcggggggctgggcccttgacggccacgtcccgtttcccggtggggggccttcctgccccgcctgggttcccccggccgggggcccagg

SEQ ID NO: 70973 - protein, 76 aa, Zea mays
  misc_feature: Ceres CLONE 1551641
MEMAGGGEADTPSHEPVRTARSHTILLPIVGVLFGLPGLPFPPAGPSRGAGPLTATSRFPVGGLPAPPGFPRPGAQ

SEQ ID NO: 70974 - DNA, 669 bp, Zea mays
  misc_feature: Ceres CLONE 1551644
  misc_feature (398)..(398): n is a, c, t, g, unknown, or other
  misc_feature (448)..(448): n is a, c, t, g, unknown, or other
ctccccgcggtggcggccgctctagaactagtggatcccccgggctgcaggaattcgtctcacccctagaaaaatttacggtctgtacaagcctcagaactttcgactgaaaaattacaattaatacttattactacttactatataaaaggaacaaactgaataggccctgctcattggtcagtcgtgcgtaccaatctcggactcaatttcagtttttgcagtcctctgacaatttgaaatttataatgttgcaggggctggacgagaatcaaactacgaagagaggctaggcaggcatgacagatgtttgaggaaggctgaagatgctattcacagggatgactctagtgatgatgatgaaataggagacggcaactatgtgttgtgtgcttaangaagagaagagagcagcttttattcatgtgggcatcttgtctgctgtccngaatgcgcatttacatagagcgtacacctcatccattgtgccaactgtgtgggtcagacatcgatacatgattgagggttatgactctttagtatgacaaaatggaatggtgagccgtgaacaatcattggccctgcacccattggggggccatttcagccctcggaatccggagggaaaaattaaaagttgaattcagcccttgccaaatgggcgctaga

SEQ ID NO: 70975 - DNA, 657 bp, Zea mays
  misc_feature: Ceres CLONE 1551645
  misc_feature: Encodes the peptide sequence at SEQ ID NO. 70976
  misc_feature (520)..(520): n is a, c, t, g, unknown, or other
  misc_feature (540)..(540): n is a, c, t, g, unknown, or other
  misc_feature (568)..(568): n is a, c, t, g, unknown, or other
  misc_feature (573)..(573): n is a, c, t, g, unknown, or other
  misc_feature (574)..(574): n is a, c, t, g, unknown, or other
  misc_feature (591)..(591): n is a, c, t, g, unknown, or other
  misc_feature (593)..(593): n is a, c, t, g, unknown, or other
  misc_feature (596)..(596): n is a, c, t, g, unknown, or other
acccgcggtggcggccgctctagaactagtggatcccccgggctgcaggaattcgtctcacccctagaaaaacgatccctttctcccctttccctgcgtagtgcggagctccagtgaaggaaccaaacagcgcaacacacgaacacaccaggcggcaggctccaccccgtccttttcctgccttttccccccgtcgagttaatccatccagtcgccaaaagctttgctaaatttcacgtgtctcgcctcgagtcgtccctaatccgacgatgccttgttctactcctaaaaaaaacccaaagatcctgactttctcttgctgctagcctcccttttcccttctcccttaatcgcactgttggaagctcttcgctgtcacccccacccacctccggcgctcttttttagcattttccttgggctctggactccaaaatcccagccctttgtttgcttctctgtctcctgctgaatggtgtccccgggtcccagactcttgatttgctcctcgcgggggtcngtcccatggcggcagctgcnctggcatggcagagcaggtgtggccaanctccnnagtgaggtgagacgccncntcnatgctgccgaagtggctttgaaaatgcccccaaatgggcccgggcttgaaaagaccgcgga

SEQ ID NO: 70976 - protein, 61 aa, Zea mays
  misc_feature: Ceres CLONE 1551645
  misc_feature (23)..(23): Xaa is any aa, unknown, or other
  misc_feature (32)..(32): Xaa is any aa, unknown, or other
  misc_feature (34)..(34): Xaa is any aa, unknown, or other
  misc_feature (40)..(40): Xaa is any aa, unknown, or other
  misc_feature (41)..(41): Xaa is any aa, unknown, or other
  misc_feature (42)..(42): Xaa is any aa, unknown, or other
MVSPGPRLLICSSRGSVPWRQLXWHGRAGVAXLXSEVRRXXXAAEVALKMPPNGPGLEKTA

SEQ ID NO: 70977 - DNA, 667 bp, Zea mays
  misc_feature: Ceres CLONE 1551646
  misc_feature: Encodes the peptide sequence at SEQ ID NO. 70978
aatagctggagctccccgcgggtggcggccgctctagaactagtggatcccccgggctgcaggaattcgtctcacccctagaaaaaaagagcagccacttggatccggtgctcagcggaacagctagctatagcctgtagctagcagctagcttcagtcacaggccggacggtcggctcacacacagctagccgccgccgctgctagcttagccaccagtagtccgatctgatctacaggcagggggccagcaggggcagctagctagctagccgcgcgccggcgccatgatgaacctgaacctgaagcagcctctggtgctgcccgcgcaccacagcaatgtcgtcggctcgcgcctgtcgtcgccgtcgccctcggcggccgccgccagcaggaagaccgggcggcggcttgtcttccgggtccggctcccgggggcccgtggcggctgccaaggattaaactgcagcgccaccaaggaggtcagcggccccttgtcctcccttaccccggaaaaaaatcctaaagggtaaccgccccccgggggaggccctcccccggccccgggaaaaaattaattttccaaggggccccttaaaaaaaatttgggaaaaatttttcggaaaaaacccctcttggggagaaatttaaatctccaaaatttaac

SEQ ID NO: 70978 - protein, 81 aa, Zea mays
  misc_feature: Ceres CLONE 1551646
MMNLNLKQPLVLPAHHSNVVGSRLSSPSPSAAAASRKTGRRLVFRVRLPGARGGCQGLNCSATKEVSGPLSSLTPEKNPKG

SEQ ID NO: 70979 - DNA, 661 bp, Zea mays
  misc_feature: Ceres CLONE 1551648
  misc_feature: SWISSPROT Homolog: EC 4.1.1.31 Phosphoenolpyruvate carboxylase
  misc_feature (661)..(661): n is a, c, t, g, unknown, or other
ggagctccccgcggtggcggccgctctagagctggggatcccccgggctgcaggaattcgtctcacccctagaaaaaacctatcgcatcgcatcagcacgagcagcaggtcgtgccgctccgaccatgtcgcttcagtgcttagcttcccgccgcgccatggcgtccacctatgctcccggtcccggcaagaagccctgaccatcgactcacaactccggcagctggtccaggtgaggtctcccatgaccacggctcccctagtcccatgcgcggcgcgtctaccgttcccgcaactgctctcacgacctccccggtcctagccttcgacgctgagtatcggattgctgcaagattgcgttacactacaatggatctcgacacacgacaaatctgggagagctctcgcccaaaataacggtgctggccgctgagaacttccatcgtcctggctagctgcctcgtgattatcgctcatcgacgcaacctaggagcagatgtgcagactcatacactattctcagactgactagctcagaatacgcgcgcttcaccgacgaagcgtcttaccgctggccatgaccgatatcaaaatatatcgctcgctgccatcaacgatggagggatagcactgcccccaaagtaagtttttgaagacgatn

SEQ ID NO: 70980 - DNA, 662 bp, Zea mays
  misc_feature: Ceres CLONE 1551656
  misc_feature: Encodes the peptide sequence at SEQ ID NO. 70981
  misc_feature (56)..(56): n is a, c, t, g, unknown, or other
  misc_feature (71)..(71): n is a, c, t, g, unknown, or other
  misc_feature (181)..(181): n is a, c, t, g, unknown, or other
  misc_feature (296)..(296): n is a, c, t, g, unknown, or other
gctccccgcggtggcggccgctctagaactagtggatcccccgggctgcaggaatncgtctcacccctagnaaaaagcagcgagtgaaggaggagcctgcccgcgcctgcgcctggttgtaattgtagctcacgctcacccttcagttgaccaccgctgcggcagcaatggcggcaagtcnccggcagcaccgccgcggcttcccgctggtcccgctgctgctgtcgctcctggcggccgccgcgtacgggcgccctcatctcgaagggggcccgcccgcgcccgctctgccggtnatccgcctcgcggcgcccgccggccgaggccgagtgcgagcagacctacgggttcctcccctgcaccccacgggggggggggagcgtcttcctggtgctggcctacggcttcctcaggttcaagggggccactttccggcgggggggaagcgagcctcctgctaaaaatcaggggggcccgggccccttcgggggcctcctcctccccatcctaggggcccctccccaacggctccccgtccaaatgggccggccccccccgggaagaaaaaggaggccgagaccccggtggctatccgggagggggctccccccccgttcccccggctccccccccacccggtctgggagaaccgggggggcccg

SEQ ID NO: 70981 - protein, 97 aa, Zea mays
  misc_feature: Ceres CLONE 1551656
  misc_feature (5)..(5): Xaa is any aa, unknown, or other
MAASXRQHRRGFPLVPLLLSLLAAAAYGRPHLEGGPPAPALPVIRLAAPAGRGRVRADLRVPPLHPTGGGERLPGAGLRLPQVQGGHFPAGGKRASC

SEQ ID NO: 70982 - DNA, 561 bp, Zea mays
  misc_feature: Ceres CLONE 1551659
  misc_feature (179)..(179): n is a, c, t, g, unknown, or other
  misc_feature (220)..(220): n is a, c, t, g, unknown, or other
  misc_feature (228)..(228): n is a, c, t, g, unknown, or other
  misc_feature (232)..(232): n is a, c, t, g, unknown, or other
ggactccccgcggtggcggccgctctagaactagtggatccccgggctgcaggattcgtctcacccctagaaaaatccatctggctctgctccggtccgttccgctccttctccccctatctagctagccttccgttcctgcatcgcggcggagatgggcgccctcacacgccgctcgngtcggcgggcgcgctgcttctgctgctgctcgcgccgctcngccgcggngggnggacagcatggtcaattcgtcctcctacgggcaaaccgaaacccaagaaggaagggccccgccggatttacccccaagtggatggcggggccaaggccggacctaaaaaaccctttgggaaagagaaaccccaggttcaaagggtttagggggaaaacctccccttaatttaaccccccaaaaacccccccccaaaaggggggggcccccctttttcccccccggggggaaaacctttttccccccctccccaaaagaaaggatgccccccccccccccctctcggtttgagggggaggccccccaaagaggaaaaaagaccccccctc

SEQ ID NO: 70983 - DNA, 590 bp, Zea mays
  misc_feature: Ceres CLONE 1551661
  misc_feature: Encodes the peptide sequence at SEQ ID NO. 70984
  misc_feature (320)..(320): n is a, c, t, g, unknown, or other
ctccccgcggtggcggccgctctagaactagtggatcccccgggctgcaggaattcgtctcacccctagaaaaaacggtccacacagcccaacaaaggagcgcggcggcccctccttccttcctcccacttctctcgcgcggcgctcgcttacctcgcctcgcattccgttcgagcaggggagcggcagtgagaagggagggaattaaggcaagatgttcatcgagagcttccgcgtcgagagcccccacgtgcggtacggcccgacggagatcgagtcggagtaccggtacgacacgacggagctggtgcacgaggccnaggacggcgcctcccggctgggtcgtccgcccccaagtccgtcaaagacaaatttccgggaaccaagacccgcggtccccaagctcggggtcatgcttgtgggggggggggaggcaacaaaggggtccccgcttgacgggtggggggccttgccaaaaagggaagggggtttcctgggggggaaccaagggaaaaggggggaaaaacccaaatttataggggtccccctaccccggggttccccccttttaaagagggggggcctccccc

SEQ ID NO: 70984 - protein, 125 aa, Zea mays
  misc_feature: Ceres CLONE 1551661
  misc_feature: SWISSPROT Homolog: EC 5.5.1.4 Inositol-3-phosphate synthase
  misc_feature (36)..(36): Xaa is any aa, unknown, or other
MFIESFRVESPHVRYGPTEIESEYRYDTTELVHEAXDGASRLGRPPPSPSKTNFREPRPAVPKLGVMLVGGGEATKGSPLDGWGALPKREGGFLGGNQGKRGEKPKFIGVPLPRGSPLLKRGGLP

SEQ ID NO: 70985 - DNA, 684 bp, Zea mays
  misc_feature: Ceres CLONE 1551663
  misc_feature: Encodes the peptide sequence at SEQ ID NO. 70986
ctggagctccccgcggtggcggccgctctagaactagtggatcccccgggctgcaggaattcgtctcacccctagaaaaatccctgtccctccactcctcccgtcgagcacttggcactgccaatggcggctcccgcccacaccccttcgatgcgcgcaagccaccttctttccccgtgagatcgacgcacctccccctctcgtgcttcattcccgctcgtcgttcgtttcttcggccccgagccgtcgcgcggtcgcctccacatctcgtcgtgctttaaggtctttggcctccgccgttcttggacaggggcacaccactgtccaccggtgcccactacgcgaaatacgagtccctcgtgcggctccgtagggtggaagagatccatcaggcggtgagtgggaggggcggcttccacacaaccggaggggaggggggcaatggcggccgtggcacgcccactctgcacgtggctcgtcgccgcgtgcttatctgcggcatgcgacgctgaagagcacaagcagaagcctttctgcgcaagcggaagccgcgctgggggcggtgtcatgcttcggccagcgccgccgcctcggcgcgcgggggtcccgctttggcgcgctctgggaagaactatgggttggtgcctttacaagctgaaagaaaggggcatttgaaaataaaaa

SEQ ID NO: 70986 - protein, 77 aa, Zea mays
  misc_feature: Ceres CLONE 1551663
MAAVARPLCTWLVAACLSAACDAEEHKQKPFCASGSRAGGGVMLRPAPPPRRAGVPLWRALGRTMGWCLYKLKERGI

SEQ ID NO: 70987 - DNA, 658 bp, Zea mays
  misc_feature: Ceres CLONE 1551666
  misc_feature: Encodes the peptide sequence at SEQ ID NO. 70988
  misc_feature (315)..(315): n is a, c, t, g, unknown, or other
  misc_feature (398)..(398): n is a, c, t, g, unknown, or other
ggagctccccgcggtggcggccgctctagaactagtggatcccccgggctgcaggaattcgtctcacccctagaaaaaaccccaatccccaatcccgtccgcttctttccccgtccccgaccttgccgaggaacctcccgctcccaaatcctagcctctcctccctcgccgctcccctccccatggaggacgaggacgccggcctcggcgacgggggcgaggcctcccctccgcaccatgccgcggcgtcgggcgaccgggcgcgggacttggcggcgtccccgaccagctcgcgctccgtgacgcagacggtgnaccgggtcccacccgcttccgtgatccaggggttactccgctcgccaaagggccattgggcgtggggggaagggcatccccancaaacccttccccgtcggcgggtaccagtgggggatctccttctaccccggaggggaagaaccccgagggaccacttcgggctacgtctcggtctttattcgcgcctcgctcccaagggacccaaagttgcccgcgcttcttcggagcttccgccttcttaaaccaagaggggaaagggggaaagccccaggggccccctccaccttttgacccccccccccggagggccgggaccctacccccccccaagggtccgggg

SEQ ID NO: 70988 - protein, 125 aa, Zea mays
  misc_feature: Ceres CLONE 1551666
  misc_feature (45)..(45): Xaa is any aa, unknown, or other
  misc_feature (72)..(72): Xaa is any aa, unknown, or other
MEDEDAGLGDGGEASPPHHAAASGDRARDLAASPTSSRSVTQTVXRVPPASVIQGLLRSPKGHWAWGEGHPXQTLPRRRVPVGDLLLPRRGRTPRDHFGLRLGLYSRLAPKGPKVARASSELPPS

SEQ ID NO: 70989 - DNA, 653 bp, Zea mays
  misc_feature: Ceres CLONE 1551667
  misc_feature: Encodes the peptide sequence at SEQ ID NO. 70990
  misc_feature (317)..(317): n is a, c, t, g, unknown, or other
  misc_feature (386)..(386): n is a, c, t, g, unknown, or other
ctccccgcggtggcggccgctctagaactagtggatcccccgggctgcaggaattcgtctcacccctagaagggccactcgtctgacgctacgctgcctactatctatctacctctaccctccctcatcacttgttccactacgaccggccacctagctcgccgcgcgcgcaagcctgcgccaccacccactctactagcttagtctcccctcgtgcagcgcgacgacagccagcaatggccgccgcccagtgaggcagggtcgcagtgacggcacgagacgcacacccacgggcgctggcggcatgccgggcgacncctacaacctcctgtgcgccgaggacgacgccgccggcacccccctgctgtggggcggcgacgacgacnacgggtgctgctcccctgtcgaggaagactcggcgggcgcggcggcctccatcgccaagctcatcggcggcgaggcccagtactcccccaggccggactaccccgacaggctcccctccaagtccatccaacccggccgcccgccccaagtcgggcgcagggattcccaggggcaagaatactatggggtttctcccttgaaggcctacctcgccggcaaatacagggaaccggttcctccctccccccgttttgccgggggggggg

SEQ ID NO: 70990 - protein, 116 aa, Zea mays
  misc_feature: Ceres CLONE 1551667
  misc_feature (5)..(5): Xaa is any aa, unknown, or other
  misc_feature (28)..(28): Xaa is any aa, unknown, or other
MPGDXYNLLCAEDDAAGTPLLWGGDDDXGCCSPVEEDSAGAAASIAKLIGGEAQYSPRPDYPDRLPSKSIQPGRPPQVGRRDSQGQEYYGVSPLKAYLAGKYREPVPPSPRFAGGG

SEQ ID NO: 70991 - DNA, 599 bp, Zea mays
  misc_feature: Ceres CLONE 1551782
  misc_feature: Encodes the peptide sequence at SEQ ID NO. 70992
cgattgggtaccgggccccccctcgagccactgcagtggtaaaggaggaaaggtggggccgatagatagaggagctgcggcgccgccggcgagcgaagagtggaggatccgatccgaagcgagaggactgaatcctgcggccgggagggacgcgggaccacgacgagcgtcgtcgtcggtgccaagcaacggcagttgtccctgtccagagcacaggcaagatggttaacgcgatcaaggggctgttcatctcctgcgacgtacctatggcgcagttcatcgtcaacctgaacgcgtcgatgccgccgtcggagaggttcatcgtgcacatgctcgaccctaccaacatgttcgtgcagcctcacgtggcgcacatgatcaggagcaagatcggggagttcagggaccagaacagctacgagaagccgcagtagtggaggatctaccgcgtcctacactcctacctcgggacttgctttcgttgcctgtattatttctgctgtgagctgacgctgagcacctcagcggaaacgagtacgccaaatagatcccacctgtggccttgaaatcatactgctatgtgctatatacatgcagag

SEQ ID NO: 70992 - protein, 70 aa, Zea mays; identical to SEQ ID NO: 7419
  misc_feature: Ceres CLONE 1551782
  misc_feature (1)..(70): Pfam Name: Tbf5 Pfam Description: Transcription factor TFIIH complex subunit Tfb5

SEQ ID NO: 70993 - DNA, 622 bp, Zea mays
  misc_feature: Ceres CLONE 1551794
  misc_feature: Encodes the peptide sequence at SEQ ID NO. 70994
ttgggtaccgggccccccctcgagccactgcagtggtaaaggttcgccagattcggagttttctgggattggctggttattaccgaagatttattccggacttctctcgaattgcgaagcctattactgagttgctgaagaaagaagtcaaatttgtgtggagtcagaagtgcgaagatgccttccatgcattaaggcagcatctgaccacagcaccagtattggcgcaacccgacagcagcaagccttttgatgtatattgtgatgcctctggcaccgggctaggttgtgtcttgatgcaagacaaccgagttattgcttatacctcaagagcactcaggcctcatgagcagaattatcccactcatgaccttgagttagcagcagtggttcatgcattgaagatgtggaggcactatctaatgggaacccactgcaacatcttcactgatcataagagccttaagtacatttttactcaggctgatctcaacatgaggcagagaagatggctagagctgatcaaggattatgacctggaggtacattatcacccagggaaagctaatgtggtagcagatgccttgagtcggaagttgcaatgcaactgtattctgatgga

SEQ ID NO: 70994 - protein, 206 aa, Zea mays
  misc_feature: Ceres CLONE 1551794
  misc_feature: SWISSPROT Homolog: EC 2.7.7.49 RNA-directed DNA polymerase
  misc_feature: The sequence is a functional homolog of SEQ ID NO 1458 in the 10/374,780 US patent application
  misc_feature: The sequence is a functional homolog of SEQ ID NO 1459 in the 10/374,780 US patent application
  misc_feature: The sequence is a functional homolog of SEQ ID NO 1457 in the 10/374,780 US patent application
GYRAPPRATAVVKVRQIRSFLGLAGYYRRFIPDFSRIAKPITELLKKEVKFVWSQKCEDAFHALRQHLTTAPVLAQPDSSKPFDVYCDASGTGLGCVLMQDNRVIAYTSRALRPHEQNYPTHDLELAAVVHALKMWRHYLMGTHCNIFTDHKSLKYIFTQADLNMRQRRWLELIKDYDLEVHYHPGKANVVADALSRKLQCNCILM

SEQ ID NO: 70995 - DNA, 626 bp, Zea mays
  misc_feature: Ceres CLONE 1551810
  misc_feature: Encodes the peptide sequence at SEQ ID NO. 70996
tgggtccgggccccccctcgagccctgcagtggtaaaggtttaactttacacgcagtggcaaaaggacaaaggagcggcggcgaggtctatggcgtcgacggcggggtacctggcgcggcgggcggcgcagaaggagcgggtgcgcctgctctaccgcagggcgctcaaggacacgctcaactgggccgtccaccgccacctcttctaccaggacgcgtcggatctccgggacaagttcgaggccaaccgacacgtggataacctggacgtggtcgataggctcattgacgatgcggaggctcagtacaggaacttccagcaccccgatccctacattgttccatgggcaccaggcggcactaaattcacaagaaacccccctccacctcaagggatcgagatcatctacaattatggcaaggaggaccagtaaacaagagtcctgcaagcggggggcagaacttccacagttccaaatcacttcctgtttaatcgagttgttgtacgagaaataagaatggaaattactggactccatccatgcttctcatttgcttgttctgataatcatgtgctcttcatctagtgcatattgaagtcatgtttcctgtcaaaaaaaaaaaaa

SEQ ID NO: 70996 - protein, 114 aa, Zea mays; identical to SEQ ID NO: 70439
  misc_feature: Ceres CLONE 1551810
  misc_feature (13)..(78): Pfam Name: Complex1_LYR Pfam Description: Complex 1 protein (LYR family)

SEQ ID NO: 70997 - DNA, 634 bp, Zea mays
  misc_feature: Ceres CLONE 1551827
  misc_feature: Encodes the peptide sequence at SEQ ID NO. 70998
cgattgggtaccgggccccccctcgagccctgcagtggtaaaggcgtgttttctttgctggagtcaagcttcgcgacatttctcggggcttcttcgcggttgttgccgtgttttctgtctttctgactccgctattcttggtccggatctttgcagtggaggccccgctgaagagatcgtttcagaatatgcaccagggctatcccaaagaaacactggtgcgtttccttaaggctagagagtggaatgtagcaaaggctcataaaatgattgtagaatgtttgaattggaggattcaaaatgaaattgatagtgtgctggaggtgagtcatcctgtcttgaatttaatccttccagatattactgtatatgttatcagaaagctaacgaaggttcccttaaagttctacgattctggtcttctcctaaccatttctcattttgattgtttattttattattgcagcaataccactctcaataatctgcctatttgtgtgtgtttgtatagcaaaatttgattttctttttctgatcaatgtttgcactgtccatctgcagaggcctatagtcccagtagatttatacaggtcaatacgtgattcacaacttattggcctgtcaggatacacaa

SEQ ID NO: 70998 - protein, 110 aa, Zea mays
  misc_feature: Ceres CLONE 1551827
MHQGYPKETLVRFLKAREWNVAKAHKMIVECLNWRIQNEIDSVLEVSHPVLNLILPDITVYVIRKLTKVPLKFYDSGLLLTISHFDCLFYYCSNTTLNNLPICVCLYSKI

SEQ ID NO: 70999 - DNA, 643 bp, Zea mays
  misc_feature: Ceres CLONE 1551851
  misc_feature: Encodes the peptide sequence at SEQ ID NO. 71000
cgattgggtaccgggccccccctcgagccactgcagtggtaaaggtgggcgcgacgcctcggctgattcgtccgccccgatcccatcaccaccgtaccccgcgggcgacgtcggccgctagcgatggcgacgtcgtcgtcggcgggggcgcgcaagaaagctcccagccccccgaagcaccgccacgacggcacctcgccgttgccgctcggcatggactggagccctcccccgaagagatgggagggaaggaacaccatatggccacataatcctcaaacaggttggagttactgtgtgatgataccttcttggatcactcaaacacctgaaactggtgtgaccgctgatagctttttgaaatctgtcgttttttacaggatacatgtcggtatacaatctccagaaggctttagctctagccatggaattctcagaaggtttagtgactttctgaatctatcttctgatcttaagagcgcatttcccagaaaagatgtcccgtcggctcctccgaagcatgctttcttaagaataaactcaagcaggttgcttctagaagagagaaggcatgcattggaggagtggatgcaaaagttactttctgacattgacttgtcaagaagtgctcctgttgctgctt

SEQ ID NO: 71000 - protein, 173 aa, Zea mays
  misc_feature: Ceres CLONE 1551851
  misc_feature (66)..(170): Pfam Name: PX Pfam Description: PX domain
MATSSSAGARKKAPSPPKHRHDGTSPLPLGMDWSPPPKRWEGRNTIWPHNPQTGWSYCVMIPSWITQTPETGVTADSFLKSVVFYRIHVGIQSPEGFSSSHGILRRFSDFLNLSSDLKSAFPRKDVPSAPPKHAFLRINSSRLLLEERRHALEEWMQKLLSDIDLSRSAPVAA

SEQ ID NO: 71001 - DNA, 649 bp, Zea mays
  misc_feature: Ceres CLONE 1551853
  misc_feature: Encodes the peptide sequence at SEQ ID NO. 71002
  misc_feature (649)..(649): n is a, c, t, g, unknown, or other
cgattgggtaccgggccccccctcgagccctgcagtggtaaaggggctgaggaggccatcggacgcacaaggacagcaagcagagtgcagggccggagcgagcgaccgagagtgtgtgtgagagagagatggcgtccagcgcctcgtgtaccctgctgctgccaacgctctcgctcgcggtgatcctgctcgcgctgtgcgcccgcggcggcgaggccaggccgccgccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggcttcttcagcgccgccatcaagctgcccgccgactacgcggcgggcgtcgtcgtcgcgttctacctgtcgaacggcgacgtgtacgagaagacgcacgacgagctggacttcgagttcctgggcaacgtgcgcggccgcgagtggcgggtgcagaccaacgtgtacgggcacggcagcaccgacgccggccgggaggagcgctacgacctccctttcgaccccaccgacgacttccaccactacttcatccttctgaaccn

SEQ ID NO: 71002 - protein, 173 aa, Zea mays
  misc_feature: Ceres CLONE 1551853
  misc_feature (44)..(173): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
MASSASCTLLLPTLSLAVILLALCARGGEARPPPPLHGVRPLAFDEGYTQIFGSANLALLRDGRRVRLTLDESTGAGFASQDVFLHGFFSAAIKLPADYAAGVVVAFYLSNGDVYEKTHDELDFEFLGNVRGREWRVQTNVYGHGSTDAGREERYDLPFDPTDDFHHYFILLN

SEQ ID NO: 71003 - DNA, 647 bp, Zea mays
  misc_feature: Ceres CLONE 1551880
  misc_feature: Encodes the peptide sequence at SEQ ID NO. 71004
cgattgggtaccgggccccccctcgagccctgcagtggtaaaggtctgctcgcttgcactagctagccagcagcggcacagcagcgcgcgcaccacctctcgccgcggcagcgacgacgacgggaggcttgttgagagctagctagctagctagctagctaggacacagcgagctcgagagcctgtgtgctagagagacagagagagaaaaaacatactcctctgcagtctgcacacaggggagaagctagcgctatagcacagtatatagacgacagcaccgatcagtagtgaggccggcatgacgatgaggcagtcgaggttcaagaggatctgcgtgttctgcggcagcagccaggggaagaagcggagctaccatgacgccgccattgagctcggcaacgagctggtggcccggagcgtcgacctggtgtacggcggcggcagcatcgggctcatgggcctcgtctcccaggccgtctacgacggcggccggcacgtcatcggggtcattcccaagacgctcatgacaccagagataagcggcgagacggtcggggaggtgcgggcggtggccgacatgcaccagaggaaggcggagatggcgcggcagtcagacgcattcatcgccctgcctggagggtatg

SEQ ID NO: 71004 - protein, 115 aa, Zea mays
  misc_feature: Ceres CLONE 1551880
  misc_feature (53)..(115): Pfam Name: Lysine_decarbox Pfam Description: Possible lysine decarboxylase
MTMRQSRFKRICVFCGSSQGKKRSYHDAAIELGNELVARSVDLVYGGGSIGLMGLVSQAVYDGGRHVIGVIPKTLMTPEISGETVGEVRAVADMHQRKAEMARQSDAFIALPGGY

SEQ ID NO: 71005 - DNA, 653 bp, Zea mays
  misc_feature: Ceres CLONE 1551902
  misc_feature: Encodes the peptide sequence at SEQ ID NO. 71006
cgattgggtaccgggccccccctcgagccactgcagtggtaaaggggtttgtttggctctattcgcacacacccacgccgtcggatcctcctgccctccccacgtccacctctctccgccgaagaatcggcggcggcggcggcggcgagcgccttcccttgtcaaaatccacccggcggcagagcagagcctcgttgctgaggaggggagatggcaggcatgaccgatatgccgatgaggccggcgcggccgggcccgccgatgcagcaccggggccctccgccgatggcgcgcctccgccccgaaccaatcgaccgcgagaagacctgccctctgctgctcagggttttcacaagggttgctggtcaccaccaaaatgaagagttttctgtgagagggaaagaaccaaaggatgaagttcagatttacacatggaaggatgccactctccgtgagcttactgatcttgtgaaagaggttgctcttccagcaaggaaaaggaacgcgaggctttcttttgcatttgtatacccagacaagaatggtcgttttgttgtcagacaggtaacgctataagaatttgggcatgtttggacccttagctccatctcgccttgcttcgctgggcaaactagccttgccaggaaaggtgg

SEQ ID NO: 71006 - protein, 121 aa, Zea mays
  misc_feature: Ceres CLONE 1551902
  misc_feature (30)..(122): Pfam Name: SAP18 Pfam Description: Sin3 associated polypeptide p18 (SAP18)
MAGMTDMPMRPARPGPPMQHRGPPPMARLRPEPIDREKTCPLLLRVFTRVAGHHQNEEFSVRGKEPKDEVQIYTWKDATLRELTDLVKEVALPARKRNARLSFAFVYPDKNGRFVVRQVTL

SEQ ID NO: 71007 - DNA, 635 bp, Zea mays
  misc_feature: Ceres CLONE 1551906
tgtgtccgggccccccctcgaactctgcaatggtgaaggtctgacgcttttcccacgagcgccccctgcccttctcgcttctccttccataggcagacgccgcgactcccccaacgcctgtccacctacccctgtcatatctcccgcccccagctgaggcaatggggtcctgcgtccgtctccttcgcctccgccgccgaccttgatcgggcgggccgggaacctcaccgttcttcatcacgccgccttctcctgctatcacgccgcggggcgctttgcgcacgccgccgccctagtctccgcgctcgtatttctctaccccacccgacagaggatagccccgtcgccctccccttctccctctgcgaaaaacacaagagcccgttcgcggcgcctgcagtggtgttcaccccgaccccgccgtcggctcctgtgaatgtcgcgccgccgccggtgcggtgcctccgccccagtacgataagtttccgctggatgcaagcaccacggatcggcgtgtggcttcttctgggacgccttctctcgcttcctgtatgcgcacaccagcctcgactagtacatggctacctggttccggttggatcactccaagtaccagtggtgcgctcaacgactac

SEQ ID NO: 71008 - DNA, 709 bp, Zea mays
  misc_feature: Ceres CLONE 1551948
  misc_feature: Translation starting site: 246
ctggagctcaccgcggtggcggccgctctagactagtggatcccccgggctgcaggaattcgtctcacccctagaaaaatcacacatcaccgccgctcatcaacaatcgagcaggagcagtctaccccatccagccaccctatcctatgcactgcactgctgctgctggtgctggtccggccagtcctgtccggtctcctctgtgtcatcgagctctctccgatccatctggtacgacactacccatggcgacgcacaacggcaccaagcactctgacgccaatggaggtgtcgatgaaagccggcaacggcggcagcgcctagtggctgaactacgacgggcggccgcggcgcacgggcacatactggacggccagagcgcacatcatcactgccgtcatcggctcgggagacctgtcactggactgcgccatcgcacaactgggatggcgtgccggccacgccgccagtgctgctactcgacttcgtcatctacgacactgccacgctgctcgccgagtgcgtaccgtacggtggacccagacacgggcaagcgcaactacacgttcatggacgcagtgcgctccagcatcggctgcgtcaatgtcgccttgtgcgacgccatacagtacgtcgacgtcgtctgcgtacgcatcgagctacacatcggctcctccataacatgcaggtcgtcatcaaggacgggtgc

SEQ ID NO: 71009 - DNA, 632 bp, Zea mays
  misc_feature: Ceres CLONE 1551949
  misc_feature: Encodes the peptide sequence at SEQ ID NO. 71010
  misc_feature (353)..(353): n is a, c, t, g, unknown, or other
  misc_feature (429)..(429): n is a, c, t, g, unknown, or other
agctccccgcggtggcggccgctctagaactagtggatcccccgggctgcaggaattcgtctcacccctagaaaaaatgagcgccgagaatcgagtttgcgctctcctttccggctttccgcccaaacagccgtcgggcgtcccacggtcgccgcccctgccggagatacgcgtagccgggagttaagggatgagtcctcaaatgctgttattggaaacatcttaagttagtgtaagttgctgaaacaatggaagaggttcaaaactgtgtgatgaagctgcggagcaattcaaggcggcacagggataaagtgtatgttggctgtggggctggatttggtggagacaggctnaatggctgcttataaagttggctgcagagagtcaggagcttattacctagtctcgagtgttgcagacgactctgcngatcgatacgattatgtgtcggaggcaagctacgatctcggtcaagagtgatgtcttgcttcaccctggcttttgaccgaaaggtgcctcttactaacatgggggaagtaaaatttgctggctatggttccactttatgggggaataccctttcccttctttgcccgtttctccggtttccgccgggggatcccttgggaccc

SEQ ID NO: 71010 - protein, 39 aa, Zea mays
  misc_feature: Ceres CLONE 1551949
MEEVQNCVMKLRSNSRRHRDKVYVGCGAGFGGDRLNGCL

SEQ ID NO: 71011 - DNA, 706 bp, Zea mays
  misc_feature: Ceres CLONE 1551954
  misc_feature: Encodes the peptide sequence at SEQ ID NO. 71012
  misc_feature (418)..(418): n is a, c, t, g, unknown, or other
  misc_feature (425)..(425): n is a, c, t, g, unknown, or other
  misc_feature (599)..(599): n is a, c, t, g, unknown, or other
acccgcggtggcggccgctctagaactagtggatcccccgggctgcaggaattcgtctcacccctagaaaaacttgcctgggaagccagatattattgcagcctcatacaccgcccttccctactgcttcctgagattcgagagctcgggcgccagatctgaaacctcttgtgttgtgcctttggtagtttggtgtagcattgagctagtagaggtgctgttctagttccaggatgagcaaggaggatgtcctcaaggtgcagacattgatgctgagagtgaacatacactgtgacgggtgcgagaagaaggtcaagaagaccctccacaagatcgacggtgtctaccagagcagcatcgacgcggaacagggcaaggtgacggtgtccggtttgctggatccggataccatcatcangaagctncacaaggccggcaagccggctcagctgtggggttccaagccccggcatcactcagaacgcctaccatggcggctgcaaggcccatttccaggacgctgggctgcgcaagagccattcaaggactccggaggtggcaggggcatttccaggatgcccgccgcgccaggcccaaanggccgttccggttggcgcggtcacaaggccctggcgttgcctgtgccgaagccgttgcctggcaatcccttaaatggggatgcgaacccgacccccattagttccgg

SEQ ID NO: 71012 - protein, 157 aa, Zea mays
  misc_feature: Ceres CLONE 1551954
  misc_feature (13)..(73): Pfam Name: HMA Pfam Description: Heavy-metal-associated domain
  misc_feature (62)..(62): Xaa is any aa, unknown, or other
  misc_feature (122)..(122): Xaa is any aa, unknown, or other
MSKEDVLKVQTLMLRVNIHCDGCEKKVKKTLHKIDGVYQSSIDAEQGKVTVSGLLDPDTIIXKLHKAGKPAQLWGSKPRHHSERLPWRLQGPFPGRWAAQEPFKDSGGGRGISRMPAAPGPXGRSGWRGHKALALPVPKPLPGNPLNGDANPTPISS

SEQ ID NO: 71013 - DNA, 711 bp, Zea mays
  misc_feature: Ceres CLONE 1551956
  misc_feature: Encodes the peptide sequence at SEQ ID NO. 71014
acccgcggtggcggccgctctagaactagtggatcccccgggctgcaggaattcgtctcacccctagaaaaagagggatagataggtccagtgcaagcgagcaggagcaggcatcttcatccagggagagggtgggtggcccgtggcccacatcgatgcgatgccggttcacgttgcgctcctcgccgtgccggcggtggccgctgggttcctgcaggcgttccagttcgcgttcctgctgtggcccttcaacctggcgctgccgctggcgcgccacctgccgcaggcgtgcatcgcgttccgcggggtcgcgtccttgtacggagcagagctgcggcggtacgcgggcgccgccgcccgggccgccgtgcccgtgctgcagccgccgagccaccaccggtacgcctcgctccgcggcgtgcagcagcgggcgcacggggatgccgtcgtcgcgcacgccatggtcgcgctcgtcgacatctcctactgatgccggccgcttgcatcgcgactccgggcgcacttccgggcgattcctcagccttttagcatgccgtcccgagtgtaaataaaacaatatatacctgttcttccctcctaccttcgtcagctgaggtgtgtagtttgtttcttcaccatggacctgtggcgagctttcatgtgtacaagaccggaattcgagttgcttgatgtgcctcctgttgaagtcac

SEQ ID NO: 71014 - protein, 109 aa, Zea mays; identical to SEQ ID NO: 69180
  misc_feature: Ceres CLONE 1551956

SEQ ID NO: 71015 - DNA, 706 bp, Zea mays
  misc_feature: Ceres CLONE 1551957
  misc_feature (495)..(495): n is a, c, t, g, unknown, or other
  misc_feature (521)..(521): n is a, c, t, g, unknown, or other
  misc_feature (522)..(522): n is a, c, t, g, unknown, or other
ggcggccgctctagaactagtggatcccccgggctgcaggaattcgtctcacccctagaaaaaatcaggcgaatcatatccatccacctactacgctgctaggctgctacgaacaaaatcctcctaattaagacgggcgtcgttggcttcaaatactggtctctcccctgtccaaaagtctctcgaatctccaccctggttctgcaccggttccagaattttctcccatttccagggtctccccgtttctgtccggcggttctgccgttccactgcttttgatttcggagtgtgaacttacatcttgctggataataaagattggattttaagcgatttgggggtgcttgcctgatccgcgtcgccctgcgaggtactgccgggggattgccaccccggggaagttttgggtggttttgagattcggcttggccggagcaggaatgaccatcgacatggccattcccgggagctcccgggttgctgaacgcctgncgggaagagggacatgaagttcttcnnggacccccgacttgcttgcgctccgggggcttccagaatccgtccgttccctctttgggacggaaacaggggtctatctgtgagccctcgggttgatcccggaaaattttcccgggtgcaaggaaccatacttcgctcaggcaaccctagcagcccggcccttatacgaaccctacacaggagt

SEQ ID NO: 71016 - DNA, 700 bp, Zea mays
  misc_feature: Ceres CLONE 1551959
  misc_feature: Encodes the peptide sequence at SEQ ID NO. 71017
  misc_feature (385)..(385): n is a, c, t, g, unknown, or other
  misc_feature (396)..(396): n is a, c, t, g, unknown, or other
  misc_feature (616)..(616): n is a, c, t, g, unknown, or other
  misc_feature (617)..(617): n is a, c, t, g, unknown, or other
  misc_feature (675)..(675): n is a, c, t, g, unknown, or other
tggagctccgccgcggtggcggccgctctagaactagtggatcccccgtgggctgcaggaattcgtctcacccctagaaaaaagcagatcactacacacaccttcgtctctaatcagatatcaaagaagtagccattaagttaacgatggcttccgccgacctcgcagaggccatcgagcccagcaggaagaagaagagcaacgtcaagtatgcctccatctgcgccatcctcagcctccatgagcctccgtcatccttggctacgatattggggtgatgagcggagcggccatgtacatcaagaaggacctgaagatcacggacgtgcagctggagatcctgatagggatcctcagcctctactcgctcatcggggtcctttcngggggggggcncgggggaaaaccccccaaaaagagagatccccgccccccccccccccgaaaaaacggcgtttttctcccgcgccccgaggaaattatatttttttttcgcgggggggggcggccccccccccccgcgggggggggggggtcccccaccccccaatactaccccacccccccccctcctttttttgggggggggggggggtctctctcctctttcaggganngaaacatctccgcgctctccgcggtggtggcggggaacgtaaaacccccccccaaatnccctccccccaatcgaggggagagg

SEQ ID NO: 71017 - protein, 141 aa, Zea mays
  misc_feature: Ceres CLONE 1551959
  misc_feature (40)..(40): Xaa is any aa, unknown, or other
  misc_feature (113)..(113): Xaa is any aa, unknown, or other
  misc_feature (114)..(114): Xaa is any aa, unknown, or other
  misc_feature (133)..(133): Xaa is any aa, unknown, or other
MSGAAMYIKKDLKITDVQLEILIGILSLYSLIGVLSGGGXGGKPPKKRDPRPPPPRKNGVFLPRPEEIIFFFRGGGRPPPPAGGGGSPTPQYYPTPPPPFFGGGGGSLSSFRXXNISALSAVVAGNVKPPPKXPPPNRGER

SEQ ID NO: 71018 - DNA, 744 bp, Zea mays
  misc_feature: Ceres CLONE 1551960
  misc_feature: Translation starting site: 358
  misc_feature (451)..(451): n is a, c, t, g, unknown, or other
ctcaccgcggtggcggccgctctagaactagtggatcccccgggctgcaggaattcgtctcacccctagaaaaatctgttctcctttgcctcctgcgcaccccgtcttctcctcgccgcgtcaaaccccagcagataaagcaaccgcccgccgcctcctctcctcctctcccgaatcagccgtcgcggtgcctaatccggccgaccccccctccgatccgcgggtgcccgccgcagaggctgcgcctccgggcctcccgcgatgtatagcaacttcaaggagcaggcgatctagtacgtcaagcaggcagtcacagaggacaatgccggcaactacatcaaggcgttccctctctacatgaacgcgctcgagtacttcaaaacccacctcaagtacgacaacaaccccgggatcaagggagccatcatcgcccagttcaccgagtacctangcctcgccgcaggagataccgggcggtccctccgatgagggcagcccacgccctgtggccaatggtgggcgacagcaattgccaccttgccccccagaaccaagggaaaggatggggacggaggcaacgggaggggatgaatcccagcaatccaatactgaagggggggggttaaattcccccgttgttcccgcgggaaccccaaatttttactggaaaagacttttccggggctccaaaaacccgcaataggggcctccacaaaagggccctttttatggcccccgcaaatt

SEQ ID NO: 71019 - DNA, 779 bp, Zea mays
  misc_feature: Ceres CLONE 1551961
  misc_feature (385)..(385): n is a, c, t, g, unknown, or other
  misc_feature (386)..(386): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (396)..(396): n is a, c, t, g, unknown, or other
  misc_feature (399)..(399): n is a, c, t, g, unknown, or other
  misc_feature (400)..(400): n is a, c, t, g, unknown, or other
ccggtggcggccgctctagaactagtggatcccccgggctgcaggaattcgtctcacccctagaaaaaaagcagaggccctccctccctcccttccctgcatacgccactcccactctctccctccccaaatcctgctcgtcctgttgaatcatgcggctattgagactatttttttgtgctctcaagggaaaagagcacacttaactctaccacgcctgtctctctctctctccctctccagtcacacacacactatctctgtccatcttttccaccggcggagtggacactccattagcaccagctttttccttcattaacaagggcaatggacgaaggctttttttttccccccccccccggggaaaagaatgggggggttnnttcnnanccnccnnccccccctttattaaaaaaaaaacacaactccccccgacaccgcggaggggggctctccgcccatttctttcaccctaattcgaccgagaatcggtaaccggatgcactgcatctccggcccatttccccactacgtatgcggaggtccgaagctgctctaagataagcccttcagagcgcattcccactttcggtggatacccggtggtgcccatgggcgtttacgaattgaaggctgatagtgtacccataagacaaggatcgtgggtccactaggaggaacaatcgagcaggtcttcttgtcgcggatagatgaagctcgcgttattggccgtattaaatgggtcgagctgcttatcacgctttgcgaaactctcg

SEQ ID NO: 71020 - DNA, 701 bp, Zea mays
  misc_feature: Ceres CLONE 1551966
  misc_feature: Encodes the peptide sequence at SEQ ID NO. 71021
ctcaccgcggtggcggccgctctagaactagtggatcccccgggctgcaggaattcgtctcacccctagaaaaagatgagatcggcgcgtatatcttttccggtgtccgatgattcatgcattagcaatttgactcgtacgtgcgtgactacagttgcatgctatggccatggccaccacttcgccggcaactgtgcagccatcatcatacaagcacacgagccgcggcgcggcgcggtgctgccctcctcctctgctgtcctggaagacacgaagctttgggcagcaggtgacgacaagggccacggcggcgagctcccgtgggcagcccgccggctgtgccactgggcaggggggagaagagggcgacagtatcaggcggctgcagaacgggtcggacgtgcggggcgtcgcgctggagggcgagaaaggccgggccgtggacctcacgccgctggcggtcgaggccatcgccgagagcttcggggagtggctgcgagaggaggagctccggctccggggccaggagcccgagcagctgcgtgtgtccgtcggccgcgaccccaggctgtcggggccgcggctcagcgcggcgctctttgcggggctcgccagggcgggctgctccgtcttcgacatggggctcgccaccacgccggcctgcttcatgagcaccatactgccacgctttcactatgacg

SEQ ID NO: 71021 - protein, 177 aa, Zea mays
  misc_feature: Ceres CLONE 1551966
  misc_feature (70)..(177): Pfam Name: PGM_PMM_I Pfam Description: Phosphoglucomutase/phosphomannomutase, alpha/beta/alpha domain I
  misc_feature: SWISSPROT Homolog: EC 5.4.2.10 Phosphoglucosamine mutase
MATTSPATVQPSSYKHTSRGAARCCPPPLLSWKTRSFGQQVTTRATAASSRGQPAGCATGQGGEEGDSIRRLQNGSDVRGVALEGEKGRAVDLTPLAVEAIAESFGEWLREEELRLRGQEPEQLRVSVGRDPRLSGPRLSAALFAGLARAGCSVFDMGLATTPACFMSTILPRFHYD

SEQ ID NO: 71022 - DNA, 712 bp, Zea mays
  misc_feature: Ceres CLONE 1551982
  misc_feature: Encodes the peptide sequence at SEQ ID NO. 71023
  misc_feature (429)..(429): n is a, c, t, g, unknown, or other
agctcaccgcggtggcggccgctctagactagtggatcccccgggctgcaggaattcgtctcacccctagaaaaacggcgggcagatctaccctggaggcggtgttccagcagcctgagacgaccccccttgcaggcgccgacgggggagatggagctgccgagcaacgctggcgacggcgaactcctgcccatggaggagcacaaggagcgcgcgctgcggcacctactccgccgaatcaagcgcccgctggaggagttcgtggccgccgtggcagacgtcgcggagcagctggtgagcgcgtatctggaccctggcgtcgagtggcgcggcgcaaactggcgggagcggttcctggccagtcgtacgatagcgcgagctcgatggccaggcgtagggcacacgtcacaccggggtggcaactggcanggcaatgcccgatcaggtctccgtcgtcgattcgtctgaacagctatcctcatcatattttaatgtctccagcctaatacggaagacctatcctgtatttacgtccacgtttatggcaacgctctccctcccggggcctcctcctccatctttaatggggggcacctttggccttaaccatgggggttgggccttggccttgcttggttttccaaatcaaccttgaccaatgggaagcccacatttccgggaaattccttgtttaaaacgcggaagaaatttt

SEQ ID NO: 71023 - protein, 105 aa, Zea mays
  misc_feature: Ceres CLONE 1551982
  misc_feature (93)..(93): Xaa is any aa, unknown, or other
MELPSNAGDGELLPMEEHKERALRHLLRRIKRPLEEFVAAVADVAEQLVSAYLDPGVEWRGANWRERFLASRTIARARWPGVGHTSHRGGNWXGNARSGLRRRFV

SEQ ID NO: 71024 - DNA, 717 bp, Zea mays
  misc_feature: Ceres CLONE 1551983
  misc_feature: Encodes the peptide sequence at SEQ ID NO. 71025
  misc_feature (555)..(555): n is a, c, t, g, unknown, or other
agtggatgtccccgcggtggcggccgctctagaatagtggatcccccgggctgcaggaattcgtctcacccctagaaaaagcccgacaaacagggtagcctccgatggcctcccggacggtgttgcgccgccgcggaagaagagcaacgtccggttcgccttcgcctgcgctatcttggcctccatgacctccatcctcctcggctatgacatcggggtgatgagcggcgcggcgctgttcatcaaggaggacctcaagatctcagacgtggaggtggaggtcctgcttggcatcctcaacctctactcgctgatcggctccttcgcggcagggcgcacctccgactggatcggacgccggctcaccatcatccttgcggccgtcatcttcttcgtcggggccttcatgatgggcttctcggtcaactacaccatgctcatggccggcaggttcgtcgcgggcatcggcgtgagctacgcgctcatgatcgcgctcgtctacacagccgaggtctcgccggcgtcgtcacggggcttcctcacctccttccccgnagtgttcatcaacttcggcatactgctcggctacgtatacaactacgccttctccccactcagcttgaaggtcggctggcgccttatgctcggcgtcggcgccgcgccttccgtcgtcatcgcgctcatggtgctcggcatgcccgaggtccccacggtggt

SEQ ID NO: 71025 - protein, 177 aa, Zea mays
  misc_feature: Ceres CLONE 1551983
  misc_feature (124)..(124): Xaa is any aa, unknown, or other
MTSILLGYDIGVMSGAALFIKEDLKISDVEVEVLLGILNLYSLIGSFAAGRTSDWIGRRLTIILAAVIFFVGAFMMGFSVNYTMLMAGRFVAGIGVSYALMIALVYTAEVSPASSRGFLTSFPXVFINFGILLGYVYNYAFSPLSLKVGWRLMLGVGAAPSVVIALMVLGMPEVPTV

SEQ ID NO: 71026 - DNA, 852 bp, Zea mays
  misc_feature: Ceres CLONE 1551984
  misc_feature (852)..(852): n is a, c, t, g, unknown, or other
agatccattgacgatggataagaaatagatgtgatttgctctgggaggggtggggctctccgcgggggcggccgctctagaactagtggatcccccgggctgcaggaattcgtctcacccctagaaaattaaaccgtgaaaacggggttgtgggagagcatacaagcgttttgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtaggtaccctgaggcaaaggtgagaagagcccccagtgggcaggcaaatagagacgtgaagaccgtgctgagctcccaagcagtgggaaggagaaaagtgatctctgactcgcgtgccttgtagagagaatgagcgccgcgacctccaaggcatgtgactttggtttaagggaaatggaaccccgccgggagcccgtaggcttaaaggagagtccttccatagaggtcgacttgtccccttggctttatggaactcgtaatccttggggagaatcttatcccgttgtaccacgcattgaaggctctggtgaggaaacttaagccatgaggctccgagcccggactgaatgtttggaagagttcagccggaatagattacgtgagattagggggggcgataattgccacctcctatcaccaggagcttagtcaaggttgcttctccacaacataggcatcaatagtcctcaaccaggcttttacttggatctatttgcgtgggttaacgcn

SEQ ID NO: 71027 - DNA, 682 bp, Zea mays
  misc_feature: Ceres CLONE 1551985
  misc_feature: Encodes the peptide sequence at SEQ ID NO. 71028
ggctagagtcgtccaccaatcttcatatctagactagtggatcccccgggctgcaggaattcgtctcacccctagaaaaaatctatgagcttcagctctctttcgggtacggtgggaggcactgcccgcaataaaaaaaaatgacaattcgatgccacaaacaagctcaaatgcttggtcggtcacttttgaaggttccagaccagtcatgtcctccgcgccctgctgggctcctctccgttactggcgcacgcctgagaccaatacacattcgcatccgccgcaatgccgtgtgtcattcaccgctaagactgtcgcgaggtgtacctgctggttctctagggtgcacgctgcacttacggagctgagcctttctactggatgcggtggatcctacatcttcacgccggtcactctcatggagtacgctattacgtcagatgttcacgtctgctggtcgcactgcaagccctatccggcatctaccatggagccagttgacaagcatgcgctagagcatcatggtctcctgaaactctgctgcagtcctgatgttctcatgcttctgaatcagataggtgcacgtatgtcctgtcacggatcactcccttggtagcgccgttgcgagccgcaatgcgctacactacatctgcatctcatcgtcaagctcgccacctgctcc

SEQ ID NO: 71028 - protein, 135 aa, Zea mays
  misc_feature: Ceres CLONE 1551985
MSSAPCWAPLRYWRTPETNTHSHPPQCRVSFTAKTVARCTCWFSRVHAALTELSLSTGCGGSYIFTPVTLMEYAITSDVHVCWSHCKPYPASTMEPVDKHALEHHGLLKLCCSPDVLMLLNQIGARMSCHGSLPW

SEQ ID NO: 71029 - DNA, 2001 bp, Zea mays
  misc_feature: Ceres CLONE 1551986
  misc_feature: Encodes the peptide sequence at SEQ ID NO. 71030
aaccactctgctccactccgccatggccacctccctcctacgcctctctcgccaccgccgcgcgctgctcgccatctcctccgtccgccttgcgctctccacccagccccacgtcccatctccgtccccatcccctaccccctcctccgcccgccgcctcccgcatttcctctccttcctcgccgccgccgccgccgccgccgctgggggagcaaccgtcgcgctctgcgactccggcctagatcaccgggtcgggggcaaggacagcgccgatctggtggttcgtggggagcggaagttcgtgccgcaggagttcatcgacgagctcgcgtccttcctcggggacaacatcactctggactacgaggagaggagcttccatggcacgccacagaacagcttccacaaggcggtcaacctgcctgatgtcgtcgtgttcccgagctcgcaagatgaggtacaaaggattgtgatggcctgtaacaagcacaaggttccaattgtaccatatggtggggctacctcaatagagggtcacacactggcacctcatggtggtgtttgcatcgacatgaccttgatgaagaaaataaaatccctgaatgttgaggatatggacgtagttgttgaacctggagttggatggatagagctgaacgaatacctgaagccctatggcctattttttcctcttgatccagggcctggggccaccattggaggaatgtgtgctactcgttgttctggttcattagctgtgaggtatggaacaatgcgggataatgtgattaatcttcgggctgttttgccaaatggtgatgttgtcaagacaggctcccgggctcgaaagagtgcagctgggtatgaccttgctcgtttgatcattgggagtgaaggaactttgggtgtaattacagaagtgactttacgactccaaaagcttccatctcattctgtagttgcaatgtgcaatttcaaaacaattaaggatgctgctgatgttgccattgcaacaatgctttctgggatacaggtttcaagagtggaattgttggacgaggttcagataaaggcaataaatatggcaaatggcaaaaatttgcctgaagtgccgaccttgatgtttgaattcatagggacagaagcatatgctctggaacaaactctcttggttcaaaaaattgccactgaacaccatggatcagattttgtttttgtcgaggagccagatgctaaagcggaactatggaagatcaggaaggaggcactttgggctggttttgctatgaaacctgatcatgaagctatgataacggatgtttgtgtccctctatccagacttgctgaatgcatatctacatcaaagcgattgcttgatgcgtcgccattgacttgtttggttattgctcatgctggtgatggaaattttcacacaattatcctgtttgatccaagccaagaggaccaacgaaaggaagcggagagactaaaccatttcatggttcatacagctctgtctatggaaggtacatgcacaggagagcatggtgttggcacagggaaaatgaagtacctggagaaggagttgggcatcgagtcactcaggacgatgaaaagaataaaggcggcgctggatcccaacaacatcatgaatccgggaaagctgatcccgcctcacgtctgcatatgaccgtcacctgactggaggatcgatccccccatggccatcagtgggcttgttggctcactcatcaaaagctttggttccgcgaggcgtgacgcggtgctctgctgacagttgcaataatgcgctgaactgctctgtgcctgtatggcatgcgttggaggcaaatgcacgtaggcgtcacatcaaaactataccggtaccaaaaaaaaaaaaaactgaactgcctcagggaagggatgggaaataatggagcaaacattcgtctcctgacgccgttttaacaggagaaccctttttaaaaaaaaaaaaaaaaa

SEQ ID NO: 71030 - protein, 555 aa, Zea mays
  misc_feature: Ceres CLONE 1551986
  misc_feature (307)..(548): Pfam Name: FAD-oxidase_C Pfam Description: FAD linked oxidases, C-terminal domain
  misc_feature (134)..(271): Pfam Name: FAD_binding_4 Pfam Description: FAD binding domain
  misc_feature: SWISSPROT Homolog: EC 1.1.2.4 D-lactate dehydrogenase (cytochrome)
MATSLLRLSRHRRALLAISSVRLALSTQPHVPSPSPSPTPSSARRLPHFLSFLAAAAAAAAGGATVALCDSGLDHRVGGKDSADLVVRGERKFVPQEFIDELASFLGDNITLDYEERSFHGTPQNSFHKAVNLPDVVVFPSSQDEVQRIVMACNKHKVPIVPYGGATSIEGHTLAPHGGVCIDMTLMKKIKSLNVEDMDVVVEPGVGWIELNEYLKPYGLFFPLDPGPGATIGGMCATRCSGSLAVRYGTMRDNVINLRAVLPNGDVVKTGSRARKSAAGYDLARLIIGSEGTLGVITEVTLRLQKLPSHSVVAMCNFKTIKDAADVAIATMLSGIQVSRVELLDEVQIKAINMANGKNLPEVPTLMFEFIGTEAYALEQTLLVQKIATEHHGSDFVFVEEPDAKAELWKIRKEALWAGFAMKPDHEAMITDVCVPLSRLAECISTSKRLLDASPLTCLVIAHAGDGNFHTIILFDPSQEDQRKEAERLNHFMVHTALSMEGTCTGEHGVGTGKMKYLEKELGIESLRTMKRIKAALDPNNIMNPGKLIPPHVCI

SEQ ID NO: 71031 - DNA, 707 bp, Zea mays
  misc_feature: Ceres CLONE 1551989
ctcaccgcggtggcggccgctctagaactagtggatcccccgggctgcaggaattcgtctcacccctagaataagtcgcagtcctccccatcgcgttgccggatcgagcttggctctctcgaatcttggatcgtcgcacggtttcgacagacggtcgcgctctcgtccccctccacacgtttccgcctcccgatccatagccgccgtgagacgacgcctacatatctcctccctctcgcagctctccagctctcggaggcccggggttcaacgacacgcgcttcttcagtcacgacatctcacccggcggtgcggacgctcggtgctcatcgcgagccggacggcacagccgctcttgttgtccctcatgggttgcgggtcggcgcgtccacgggatggcgaccacccccctcgactctcctgatgctgcggagcgagacgtggatgacccactacggctggacgtcagacggcaaaatgcgcatgaacatggatgtggatagtgagttcacttaccgctatgccgacaagaaggatggccgcatggatggtgatggtgagtactggcgaccccgtggataatggacacatcatctgcttacgcatggcatcgacagatgatccaggtattcgctgggacgagaccacttagcctgtcatgactacccgatagactttgtgggactattttagagcgatgaaaattt

SEQ ID NO: 71032 - DNA, 726 bp, Zea mays
  misc_feature: Ceres CLONE 1551990
  misc_feature: Encodes the peptide sequence at SEQ ID NO. 71033
  misc_feature (509)..(509): n is a, c, t, g, unknown, or other
  misc_feature (610)..(610): n is a, c, t, g, unknown, or other
  misc_feature (654)..(654): n is a, c, t, g, unknown, or other
ctcaccgcggtggcggccgctctagaactagtggatccccccgggctgcaggaattcgtctcaccccctagaaaaagtcactcgtcagtactcagtggaggaggcggcggcggggagggagacagatgcgggaggcccaccgcggggtcgcccggaccagatggacacgccggataggccccgcgccggcgccggcgccgggttcgaggattctcctgtgttcaatttcatcaacaatctctcgcctataccaccacctaaacctttagactcagcacataatgtgcagctattcaagtcatcagatttggcacctgtttcttcgatctttgcctcaccacatgttaatccaacaaagggaactaaagttctgatcagggacgaatctgttcagcttcctcatgaattgcactcacctagcagtgtcagaactcggataggcacctcaggctcttttagaatgatcagatgcaaagacattgtgccagagaatttgtatatcacttgtncactaaacgaggcatctattgattcttcagatcatacatcaagctctacaggccaattgactcaatccataaaagatgctgctggcagtatggaaagcgantagggatcatgcgctggtggtaaaatagacctaccatgtcccangagtgcacaggctagaggtatgaaccttgatgagagtagcccagacagaatggatcatcacattctggaata

SEQ ID NO: 71033 - protein, 149 aa, Zea mays
  misc_feature: Ceres CLONE 1551990
  misc_feature (117)..(117): Xaa is any aa, unknown, or other
MDTPDRPRAGAGAGFEDSPVFNFINNLSPIPPPKPLDSAHNVQLFKSSDLAPVSSIFASPHVNPTKGTKVLIRDESVQLPHELHSPSSVRTRIGTSGSFRMIRCKDIVPENLYITCXLNEASIDSSDHTSSSTGQLTQSIKDAAGSMES

SEQ ID NO: 71034 - DNA, 738 bp, Zea mays
  misc_feature: Ceres CLONE 1551991
  misc_feature: Encodes the peptide sequence at SEQ ID NO. 71035
  misc_feature (409)..(409): n is a, c, t, g, unknown, or other
  misc_feature (413)..(413): n is a, c, t, g, unknown, or other
tggagctcaccgcggtggcggccgctctagactagtggatcccccgggctgcaggaattcgtctcacccctagaaaaaaaaaacacgcgcacttcgagttgtacaggagctgcactgcacgctcctcaaattcccacgccgcatcgccacccagtgccctgctcaccgccgaacggtttcaatggccgcaagcacagcggcgccatgctacgacgcgcccgagggcgtggacgtccgcgggcggtacgaccgggagttcgcgggcatcctcacccgcgacgcgctggacttcgtggccggcctgcagcgcgagttccgcgccgccgtccgctacgccatggagcagcggcgggaggcccagcgccggtacgacgccggcgagctgccgcggttcgacccggccacaacnctcntgcgcgagggggactggacgtgcgcgcccgtgcggccggccgtcgcggaccgcaccgtggagatcacgggccccgccgagccgcggaagaatgtcatcaacgcgctcaactcccgcggcaaaggtcttcatggctggactcgaggacgcgcctttcccccacttgggaagaccttgatgccccgggcagggggaacttgccgggacgccttgggctgggcaacatcaacttcccgcaacccggggccccggggggaacttacaaactccaaagaaccgaaccgcccaagtttttttttccgggccccggggttgggcaccctccc

SEQ ID NO: 71035 - protein, 185 aa, Zea mays
  misc_feature: Ceres CLONE 1551991
  misc_feature: SWISSPROT Homolog: EC 2.3.3.9 Malate synthase
  misc_feature (78)..(78): Xaa is any aa, unknown, or other
MAASTAAPCYDAPEGVDVRGRYDREFAGILTRDALDFVAGLQREFRAAVRYAMEQRREAQRRYDAGELPRFDPATTLXREGDWTCAPVRPAVADRTVEITGPAEPRKNVINALNSRGKGLHGWTRGRAFPPLGKTLMPRAGGTCRDALGWATSTSRNPGPRGELTNSKEPNRPSFFFRAPGLGTL

SEQ ID NO: 71036 - DNA, 718 bp, Zea mays
  misc_feature: Ceres CLONE 1551993
  misc_feature: Encodes the peptide sequence at SEQ ID NO. 71037
ggagctccccggggtggcggccgctctagaagtggtggatccgccgggctgcaggaattcgtctcaccccaggaaaaaccgccaccggaaccgtcgtgccgacgtctcgccagcgataagcaaagccccgcctcactctctcgtccacagacaaagccgcgacccacaagtgcccccctcctcccgcgctcccaaatcactccctctctgtctctccactccactcgccgccgccgcccgaatctcaatggcggccgcggccgccccgacaacatccctctcactcgcggcccgtgcggcaagaagggcggccgccgccccgctccgcacgggaggcctcgccgcggcgcgccatccggcggcgtctctggcgttcgcggcgggtgactcgcggctcgcggaccacttcgagtcgcggtgacggcaggcgtcctccgcgcgcggaacgcgggccatggccaccatggcgaataagatggtcggcggactcgcggaggccgacctcgaggcgaagcgcgtcttcgtgagtgccgacctcaggctgccgctcaacgagcaacagaatatcgccggactagacccgcatccgggtccgccgtcaccaccattgcggtgcctcctcggcaaggtcggccaaatccttcctctcccgcgcctgggggtcgcccgaagggttttacgccccagtctttccgtaacccccccttgtgggcagggt

SEQ ID NO: 71037 - protein, 57 aa, Zea mays
  misc_feature: Ceres CLONE 1551993
MAAAAAPTTSLSLAARAARRAAAAPLRTGGLAAARHPAASLAFAAGDSRLADHFESR

SEQ ID NO: 71038 - DNA, 715 bp, Zea mays
  misc_feature: Ceres CLONE 1551995
ctccccgcggtggcggccgctctagaactagtggatcccccgggctgcaggaattcgtctcacccctagaaaaaacccaaaactccgctctcatcccaccccccctccactccactaccacggcggcacggcctgcctctgcagctctgccctgctccgcacccctcgctctccaaccccaacgcgcggcgttgctaaaattcaccgcagcgcttactccagtttggccacctcaccacccgccgccgctgtttaagaaggccccgcgcccgatcggggatcacgaaccttggccgccgctgccggagtgggggtaagcgagagccctcctgcttggggtgcgttcttcgtaggctgcttggttctcttcgagcccgatttgctctttgtagcctggccccccccaagcgcagtctggtcttcgactcctctcctctgctggaggtttgcaggatctggtatgatatggtgatgtatgatgaactgacgacgcacgctgctgtcgcgtgcggtgtggtgagtctgtgccggcgtagaattcccggcggccatggggggcgcccggaatggtcgccatcgcggtctcttatcgaaaacttgctgcaagggctgggaaaatgtcgacaatttgctggaagccgccctgttactaaaagaaagaaattccacccttgcaaagggaagccccttgaaccaaagggcccccatctcgtcc

SEQ ID NO: 71039 - DNA, 717 bp, Zea mays
  misc_feature: Ceres CLONE 1551996
  misc_feature: Encodes the peptide sequence at SEQ ID NO. 71040
  misc_feature (667)..(667): n is a, c, t, g, unknown, or other
agacctggagctccccgcggtggcggccgctctatactagtggatcccccgggctgcaggaattcgtctcacccctagaaaaaataaaagctggcgggagaccgtcctcgaccgcattgaccccgccgtggcacggcctcgatgccggcgacgacgcacgcgcgaggcgccggagggtccggccatgacgtcgtccgtgcgggagtggtggcgccgcgccgccgctgcgctcaatgacaggatgagcctgctcctggcgcgcctgcgcccgcgcctggccgggtcgtcgtcgtggcaccaccgggagctggatgctgccgtgatccgcgcgacgagccacgaggaccggtggatggactaccggagcgccgcgcgggtgttcgcgtgggcgcgctcttcgctcacgttcatccggcccgtcatgtgggcgctggcgcgccgcgcgcggcggacgctgtgctgggtcgtggcgctcaagtcgctcatgatcacgcacagcatcctcctccgctcgggtcgcgcgccgcgctccggccgcgtccccttcgagctcgctgacttccgagaccggtcctcgtctgcggcggccaggtccctgggcttctccgcctttgtgcgcgcttacttccggtttctggactaccgctcactcttcgccgcgcaggangacaccgaccgccatgactacgccgaaaggtgctcggatccccagacggg

SEQ ID NO: 71040 - protein, 177 aa, Zea mays
  misc_feature: Ceres CLONE 1551996
  misc_feature (161)..(161): Xaa is any aa, unknown, or other
MTSSVREWWRRAAAALNDRMSLLLARLRPRLAGSSSWHHRELDAAVIRATSHEDRWMDYRSAARVFAWARSSLTFIRPVMWALARRARRTLCWVVALKSLMITHSILLRSGRAPRSGRVPFELADFRDRSSSAAARSLGFSAFVRAYFRFLDYRSLFAAQXDTDRHDYAERCSDPQT

SEQ ID NO: 71041 - DNA, 715 bp, Zea mays
  misc_feature: Ceres CLONE 1551997
  misc_feature: Encodes the peptide sequence at SEQ ID NO. 71042
ctccccgcggtggcggccgctctagaactagtggatcccccgggctgcaggaattcgtctcacccctagaaaaacggccaccagacatcccttcctctctttctcctcgaggctcgagcattcgtgctgctccgaccccaccgacacaggctcggcggtccggcgatctcgctcaccggcgggaacatgactacttcaaggcgccttgctgacaagaagaccgcaaagttccagaagaacatcaccaggaggggttctgtgcctgaaaccactgtcaagaagggaaatgactaccctgttggccctctaatgcttgggttcttcatcgttgtcgtcattggatcatcgctcttccagatcatcaggacgggaaccgtcggcggggtggcttgagagccggcccacatctaatccccagtatagagagttgcttgttctacatgcatccagctaggattgggtagcagctaacatgttacacatgactagactgccctgcattccgttcatttggagagccttgaatctggaactgaaccacaaggcacaatcttgtagcttatattaagtgttaaatggggtactgggatctcagtgtctcttctaagtacaaaaaataaacgagacgctaccagtacccattcgacctatagtgagtcgtattacgcgcggtcactgggcgttgttttacaccgaacggagtgtgcaaaccccg

SEQ ID NO: 71042 - protein, 68 aa, Zea mays
  misc_feature: Ceres CLONE 1551997
  misc_feature (1)..(64): Pfam Name: RAMP4 Pfam Description: Ribosome associated membrane protein RAMP4
MTTSRRLADKKTAKFQKNITRRGSVPETTVKKGNDYPVGPLMLGFFIVVVIGSSLFQIIRTGTVGGVA

SEQ ID NO: 71043 - DNA, 658 bp, Zea mays
  misc_feature: Ceres CLONE 1551999
  misc_feature: Encodes the peptide sequence at SEQ ID NO. 71044
  misc_feature (658)..(658): n is a, c, t, g, unknown, or other
ggagctccccgcggtggcggccgctctagaactagtggatcccccgggctgcaggaattcgtctcacccctagaaaaagccctcctacttgcagaatctccatttccccccgcaccaaaccagccaaaccactggcgcacgccgaggagagagaaagggggtgtgcggggcggcgaccggcctccgacgacgcggggcgtcgcggcgtcgtggcggtgaagcggatgaggctgtgggaggaggaggacgatgacgaggacgaggaggggatggaagtggacggggaggcggaagatgagccggggtggccgtgtggggcgccggaggcggggcccggcgaaacgaggccggcagcgatcctcgtggcggacgcggcggaggtcgacttccccgtcatctacgtcaacgccgccttcgaggccgccacggggtaccgcgcgcacgaggtgctcgggcggaactgccgattcctacaattccgggatccacatgcccaaaggcgacaccccctcgttgatcccatggtcgtttcagagattcggcgatgtctcagcgaggggatcgaattccaaggcgagctgctgaatttccggaaggacggtgctccacttcacaacagattaaggctcgttcctatgcacggcgatgatggctatgn

SEQ ID NO: 71044 - protein, 144 aa, Zea mays
  misc_feature: Ceres CLONE 1551999
  misc_feature: SWISSPROT Homolog: EC 2.7.11.1 Non-specific serine/threonine protein kinase
MRLWEEEDDDEDEEGMEVDGEAEDEPGWPCGAPEAGPGETRPAAILVADAAEVDFPVIYVNAAFEAATGYRAHEVLGRNCRFLQFRDPHAQRRHPLVDPMVVSEIRRCLSEGIEFQGELLNFRKDGAPLHNRLRLVPMHGDDGY

SEQ ID NO: 71045 - DNA, 527 bp, Zea mays
  misc_feature: Ceres CLONE 1552003
cccgcggtggggggcgctctagactagtggatcccccgggctgcaggaattcgtctcacccctagaaaaagacgaaacggacggacgccacgccctgcccgccggggctgcttgccactgagccactcctctctcttcctcatccatccccgccccgcccgcagaaccaaaccagcctccctagtccctccctccccagcagctcacgactcacgagagagcgcaagtattactgcgcaccgcctcgcccgcgggcgtcagcgtgaagctgccgcacagctaccccgcgaggcatgggggatggacgccgggcggcggggaaagctgcccgtacaagcttaccccggcccaccaggacggaagctgggaaagacttcacccggggggccccccaagttgggcctccccctgttcgggggtttcgggttggtaccgggggcccaattttccccccgggaaaaattttagaagccctccccccggtggcccagtagaaaaaacccccccctttttccccggggggaagt

SEQ ID NO: 71046 - DNA, 586 bp, Zea mays
  misc_feature: Ceres CLONE 1552009
  misc_feature (193)..(193): n is a, c, t, g, unknown, or other
  misc_feature (202)..(202): n is a, c, t, g, unknown, or other
  misc_feature (206)..(206): n is a, c, t, g, unknown, or other
  misc_feature (207)..(207): n is a, c, t, g, unknown, or other
  misc_feature (246)..(246): n is a, c, t, g, unknown, or other
  misc_feature (260)..(260): n is a, c, t, g, unknown, or other
  misc_feature (275)..(275): n is a, c, t, g, unknown, or other
  misc_feature (280)..(280): n is a, c, t, g, unknown, or other
ccgcggtggcggccgctctagaactagtggatcccccgggctgcaggaattcgtctcacccctagaaaaatcccccctctccacactgccaactcgctccgaagagggaggaggacgacgccggttgccactgccactgccgcgccgctcccgtctcccctccctccgcgggaactcggcgccaccatgctgntcacgcgcnacgnncgcgtcgccgcctccgcgtcccccgcctccccgtggaanctgggaggaccgancgagggcggccccanctgcnacggatgccgggactaccggaacccctggcggagaagggccgccccgccaaggtggccccctggccccccaggcggttggacccggcccccaatggtctcccccccgaaaccggaacccgaaaggacccggggggggggggccccccccaagggaattccccttttccctggggccccctccccccagaggggaacccctttttggggggcccccccccacaaggggggtttgtttcccagggggggaggggggggggccccctttggggggggggcccccccccgggaaatatattggaaagaaa

SEQ ID NO: 71047 - DNA, 726 bp, Zea mays
  misc_feature: Ceres CLONE 1552010
  misc_feature: Encodes the peptide sequence at SEQ ID NO. 71048
  misc_feature (10)..(10): n is a, c, t, g, unknown, or other
  misc_feature (12)..(12): n is a, c, t, g, unknown, or other
  misc_feature (37)..(37): n is a, c, t, g, unknown, or other
  misc_feature (38)..(38): n is a, c, t, g, unknown, or other
  misc_feature (41)..(41): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (448)..(448): n is a, c, t, g, unknown, or other
tttttgtggntnccttcctcccctccctctttttttnnttnttttttctaaannnccnnnnnnnnnnccaaagctggagctcaccgcggtggcggccgctctagactagtggatcccccgggctgcaggaattcgtctcacccctagaaaaagccactgctaactagctaatctagcagtcagcataggagactggttggagagaagagaacctcagtgcgcgaaaaaagaactcaagcctcaaggagggtatacgccgccgcgccgagtcgtccacgtccgaggaggaacgcacgcgctcacgcggcgccgatggatggaagcggtgccggcaccggcagcgccacgctgctgcggaagcggccgctgtccgtgaacacagcgtcgtcgacggcggcggcgattgagctcgggagcaagcaggccgccggggttgtggcggccatcnaggaggagccggtgagcccgacggggcggctgttccgggagccgaacttccgctgccacatcgtgtccgtgttcggcctcggcgcgccggtggacctgccggcgctgcgggccggggtcgccgccacgctcgcgcgccaccctcgcttctgcagcgtccaggtggtaaatgagaaggacgcgagaccgaagtggatacggacagcggtaaacgtggacgaccacatcatcgtccccgagctaaaccccgccaccacgtcggccgacccggacaaggct

SEQ ID NO: 71048 - protein, 138 aa, Zea mays
  misc_feature: Ceres CLONE 1552010
  misc_feature (46)..(46): Xaa is any aa, unknown, or other
MDGSGAGTGSATLLRKRPLSVNTASSTAAAIELGSKQAAGVVAAIXEEPVSPTGRLFREPNFRCHIVSVFGLGAPVDLPALRAGVAATLARHPRFCSVQVVNEKDARPKWIRTAVNVDDHIIVPELNPATTSADPDKA

SEQ ID NO: 71049 - DNA, 652 bp, Zea mays
  misc_feature: Ceres CLONE 1552011
aaagctggagctccccgcggtggcggccgctctagaactagtggatcccccgggctgcaggaattcgtctcacccctagaaaaaaaatcacttcttcccggactcccagactcctcccaaaaccctcgcatcctctcccacgcatgtcacaatcgccatgaccgacagaaaccccgccgccgcctcaagcaagcgtcactgtgacctctccctcgacgataccacgccgtcggccaagctccagcggtgctccgagccgtcgaaccaacgccggcggggaaaccgaacggcggcgcggcgaccggagaggagagcgagatgatggccggcgcacggaaacctagggcgcagaggtacctggtcgccgtggagacattgggaccccgcttctccggctcacagaaaaagccaaccagggcaccgtccttggggccctcgaggagcatttccccattttatggggaggcagtttacaatactttttttaccaaaaggaatgaagggggttcggctttaaaaaagttttcccatttggattgttacgggaaaaaaaaaaaaaaaaccggggaaaatattttttttcccaaaaaccctttttttttttttaaaaaaagaaaaaaaaacaagggggtgggttaaaaactttggtaag

SEQ ID NO: 71050 - DNA, 676 bp, Zea mays
  misc_feature: Ceres CLONE 1552012
  misc_feature: Encodes the peptide sequence at SEQ ID NO. 71051
tggagctccccgcggtggcggccgctctagaactagtggatcccccgggctgcaggaattcgtctcacccctagaaaaatccttccttgcttctcgtctcgtcgcctctcggagatcagaaagagaacaccggacacctagcctgcgcccttgccttccctccgcgcgcgcgcgctatctatggcgatggaagacgtcgcgggtgcctcctcctcctcggcggccgccgcctccgaccccacgcacggctggcagacggtgtcgtaccccaagcgccaccgcaagcaggcgcatcagccaccccgcgccatggctcccgatctggcgctgcaggccaacggcaaaggctccggtgtcttcgacgccgtcgagaagcgctcccaggagcgccaccgctcgctgctgcagcagctcgcatccagggcggccgacctcgacgacgcgcggatcgccgcggtcacaggcggcgcttactccgacgactccgactccgacgaggccaccgcccagcgccagggggggggaggtgaagaaacctaagaagcctaaaaaacctaagggggaccatccgccaaggctgcccgccctgattcaagccaaagaacctcccatcgcaccttggtcaagaattccgccttcctttggaaaatccaccgggactttcccccccctgggg

SEQ ID NO: 71051 - protein, 119 aa, Zea mays
  misc_feature: Ceres CLONE 1552012
MAMEDVAGASSSSAAAASDPTHGWQTVSYPKRHRKQAHQPPRAMAPDLALQANGKGSGVFDAVEKRSQERHRSLLQQLASRAADLDDARIAAVTGGAYSDDSDSDEATAQRQGGGGEET

SEQ ID NO: 71052 - DNA, 678 bp, Zea mays
  misc_feature: Ceres CLONE 1552016
  misc_feature: Encodes the peptide sequence at SEQ ID NO. 71053
  misc_feature (370)..(370): n is a, c, t, g, unknown, or other
  misc_feature (371)..(371): n is a, c, t, g, unknown, or other
aaagctggagctccccgcggtggcggccgctctagaactagtggatcccccgggctgcaggaattcgtctcacccctagaaaaaaccgcttcactcgtttccttccgatccatacacaccgcgcacgtacgcgtactccatcgtcccggtgcaggcgggttcacgtcacgacctcgggcgagacgagatggcgacgccgaacgggcttgctcggatcgagacgaacggggcgaccaagcccgacaacggcgtgtgccacgacgacagctcggcgccggtgcgcgcgcagaccatcgacgagctgcactcgctgcagcggaagcggtcggcgccaaccacgcccatcaaggacgggcgccgccctcgaccnnttcgccgccgcgctctccgagggagagcgccacaggcagcagctgcagtccatcagcgcgtcgttggcgtctctgacacgtgaaacggggccgaaagtgtcaaggcgacccgggcccggagggggcaaggcccccgcgacgggtgcaccgccaacccccgaggggccacaaaaggaaaaccaacccggcggccccaaatttggcggtaaggaaaagttcccttaagtttcccccggggtcctttaaaaaccctcgcccgtgttaggctttaaaaaacgggccctccaattccaaaaaggggggcctt

SEQ ID NO: 71053 - protein, 88 aa, Zea mays
  misc_feature: Ceres CLONE 1552016
  misc_feature: SWISSPROT Homolog: EC 4.1.1.49 Phosphoenolpyruvate carboxykinase (ATP)
  misc_feature (62)..(62): Xaa is any aa, unknown, or other
MATPNGLARIETNGATKPDNGVCHDDSSAPVRAQTIDELHSLQRKRSAPTTPIKDGRRPRPXRRRALRGRAPQAAAAVHQRVVGVSDT

SEQ ID NO: 71054 - DNA, 674 bp, Zea mays
  misc_feature: Ceres CLONE 1552019
  misc_feature: Encodes the peptide sequence at SEQ ID NO. 71055
  misc_feature (111)..(111): n is a, c, t, g, unknown, or other
aaagctggagctccccgcggtggcggccgctctagaactagtggatcccccgggctgcaggaattcgtctcacccctagaaaaaagcggcattgcaggttgcagcaaagangagagagagagagagagagagagagagagctcacgagcctcccgtcctcccctacccccctcatgcgccgcaagaagcacttggaccggggtgggggcggcggcggaggtggcacggagctcttcatctgcttcacctcgcgttcctccgctgcctcagccatttccgtcgccggcggcagcgcgcactcttccctccgcccctccagctcctccaagctcctcagccccggccgcggcagtgccagcgcaagcggagctgaggcagtgccggccccgcctctgcacccctcactcagccgccgcctccgcaacagcggcagcctcaagggcggccagtccccaatgttcccctccgggtccaccggcggtggccgccgcggccggggcggattcgaacctgccgaaccctcgtctcccaaggtcacctgcatcggccaggtccgcgtcaagggcggtaagcgcaagcccaagcacgcctccgccgccgcgctgcgctcccgctccaggcgcggcggaggcgggagcgcaaaggccagcttccgccgcgctggcgacgaccgg

SEQ ID NO: 71055 - protein, 167 aa, Zea mays
  misc_feature: Ceres CLONE 1552019
MRRKKHLDRGGGGGGGGTELFICFTSRSSAASAISVAGGSAHSSLRPSSSSKLLSPGRGSASASGAEAVPAPPLHPSLSRRLRNSGSLKGGQSPMFPSGSTGGGRRGRGGFEPAEPSSPKVTCIGQVRVKGGKRKPKHASAAALRSRSRRGGGGSAKASFRRAGDDR

SEQ ID NO: 71056 - DNA, 864 bp, Zea mays
  misc_feature: Ceres CLONE 1552019-R
  misc_feature (1)..(1): n is a, c, t, g, unknown, or other
nccgattgggtacctcgagcgtctcgtttttttttttttttttcgcagggtggttgaaatatatcaattactaagcttaagcatggcacaactccattaaatattacacatctttacctacacatcaaaaggtgcagaatttaagctggtgttatccagagccacatattggacaagattctgaggctctctctgtctagtggctgcatgtgtctagatgttacaaagcatcacataacagcacaaatcaatatcaaagaacctatctcatatagtaacttaacaacatgctattatttggtgctgtccagacatcacataacagcacaaagcacaatcgaagaaccactcgctactattgcacaacaggctcacaaactcaatcactcactacctaactacgcatcacattccagcagctgtctggcagggatcagaacccgactccagttgcgttcagtggcagatggcggtccttccagaagcaagcatcgggtgccaaccgcgctgatgatcgcatcggctctgacttgcaccttttcagaacgaacggggcgtaggcgcccgcattggtgaccggcggcaactctagctttggcttctgttctgttgttgctggtttgagtgccagtgtcttctggacaactggacatggcatgggcacagctgagttcaccgtcaatggatctttgctctcttgtacatctttcacaacggtgttgccttcagcattctccttttttacagtctccactgttccagtagcagaaagcttctgttgcctgtggttgtagttattcttttcctggtaagacttccaatgcacgaagtcagtactgcagacccatgtcttctttggagact

SEQ ID NO: 71057 - DNA, 818 bp, Zea mays
  misc_feature: Ceres CLONE 1552020
  misc_feature: Encodes the peptide sequence at SEQ ID NO. 71058
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
ttttttttttnnnnnnnnnnttggggntnnnnngtcctcttcnnnnnnccaaagctgggactccccgcggtggcggccgctctataactagtggatcccccgggctgcaggaattcgtctcaccccctagaaaaagctactcgatttgatcaaccgccatccattctactcctccgttgcagctgcggcatccatccagtaggccgaccaataccatggcttcagcgtgcgggaccgcctccacttgcggcattcccatgcacctgccggcgttgcacttgctgctcccatgaagcagctttccctcgtctcgccctcactggtttcgcttccgcgcaagatgaggccgggaaggaagtacaacttcagggtaaacgctgcaaaggagctgcatttcaaaaaggatggctcgggtatcaggagaatccaaaaagcgccccccaatcttccatatgtgtgtgtgggttactctttgggccccgggggccaacatgtagttcctcgaataatcccgtaagggctccccttcaaactggacaaaagatcggtgatagctgctgtgatgaacggaagtttgaatcctcccaggaacccctgtcttaaatatttttgtggaggttaaagttgggccccccccctaaactctcttgcgtttgatcaacaccccctctggggctagtggataggtgggatacaatcaaagtatgtagccttgtgtctcacacaccatcaggcacccattgacccgggaggcctatacaaaagaatctggaaggtccaccctgtatcccagagttgcaggtagacagattaccaag

SEQ ID NO: 71058 - protein, 58 aa, Zea mays
  misc_feature: Ceres CLONE 1552020
MRPGRKYNFRVNAAKELHFKKDGSGIRRIQKAPPNLPYVCVGYSLGPGGQHVVPRIIP

SEQ ID NO: 71059 - DNA, 693 bp, Zea mays
  misc_feature: Ceres CLONE 1552022
  misc_feature: Encodes the peptide sequence at SEQ ID NO. 71060
tccccgcggtggcggccgctctagaactagtggatcccccgggctgcaggaattcgtctcacccctagaaaaagtcctaccacaccgcccccctcccccacgggccgccttctcccgggaacacgagaccctcgttccctgcgccaccgagtgagccaaggccgcgccttgtcgtttccgacctaggtcgcgagatctccgaggagcggagccccgccgtgccgccgcctgctacaggggggcacgcagggaccgcacggtgcgatggtggacacgggcggggggaggctctaccagcgtcgtggcgcggtcgctttcgtcgcggccaacaaggcgctgctcgccgctgcgtgagtcgtcgggttcgcgctcgtgttcctatgggagagcgcctccctgcccctcggtagcgccggcggcggagggtacctcatgctcctgtcggcgccggctccgtcgccgcgccccgagccgcggcttcgccccacgccgtacaacatcacggaactccggggccgtgggggaacggccggttggtcaacaccgggggcgtctcgtagcctgctctcttaggccatctcgagggctctccggatcgagagcggccgggcaacctcaatgggcccacccagggcgtctggcttcacgggagcccctttcaacccttgatcaggtaacactgaacgtctgggt

SEQ ID NO: 71060 - protein, 29 aa, Zea mays
  misc_feature: Ceres CLONE 1552022
MVDTGGGRLYQRRGAVAFVAANKALLAAA

SEQ ID NO: 71061 - DNA, 668 bp, Zea mays
  misc_feature: Ceres CLONE 1552023
  misc_feature: Encodes the peptide sequence at SEQ ID NO. 71062
  misc_feature (544)..(544): n is a, c, t, g, unknown, or other
  misc_feature (577)..(577): n is a, c, t, g, unknown, or other
  misc_feature (580)..(580): n is a, c, t, g, unknown, or other
ctccccgcggtggcggccgctctagaactagtggatcccccgggctgcaggaattcgtctcacccctagaaaaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgccgcccgcacagcaaactccagaaaggtggcttcnccgacgaaggctccgcccacaccgagtccgacntcnaggagacgctcaagcgcctcgtggtcggaagtcgggcagtccccccaaagaagggttccaagcgctaaagaacaagaccggtcaaccc

SEQ ID NO: 71062 - protein, 165 aa, Zea mays
  misc_feature: Ceres CLONE 1552023
  misc_feature: SWISSPROT Homolog: EC 4.1.1.31 Phosphoenolpyruvate carboxylase
  misc_feature (132)..(132): Xaa is any aa, unknown, or other
  misc_feature (143)..(143): Xaa is any aa, unknown, or other
  misc_feature (144)..(144): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRPHSKLQKGGFXDEGSAHTESDXXETLKRLVVGSRAVPPKKGSKR

SEQ ID NO: 71063 - DNA, 1018 bp, Zea mays
  misc_feature: Ceres CLONE 1552024-R
ggggcggtggtagcaaaggtcaagtaacaagctcagttcgatcacgtagtaaactttgttcaccgctgcacctgagaccaaaacaagatatagaaaaaatggcagcttttactttttttattcaatgtcctcttacctacatggcagggggaactaggaagatcctcccctgcagaaagtaggccactcttatgtactaggtgatggagcaggatccatcggatggtcactgtcatgcatcccaactatgcctgcgccactgaggttcccaggtgtccttgttgatctgccacacatgaacatggtagaccttgtgtccaacagcccctcgccctttgctcctgggttcaataacgttgtgtccatacttcaatctcccgaagtgtagatcaaaataccccgccccattgggttttgcaatcaaaatgtggttatgtcagcgtgactatctagaattatacttctacctgcttaataggcccgtaatcgatatacgcctcatcctcgagcaaactaacatgcctcctaccggaaatcattgttgtgtgtccaccgtcgatcgcttttgtggatgccacatactttttttttccgtgattattgtattctcttttttccttttgggtgagcatcgcgttgttgttatttgtctcctgcaacacatatcaccttttgcttgtatatatcatttctccccgactttcctctaatgttgttttatattctacctccgttcaggtaggtcacttacatccagaagtcccctgttcactttgaacttctgtaaacgcttcacactctctctttttcaatctatctcgtcttataatgatccactaaataatatcatgatgtcgtaactaagtctgccggagagaatggtggcacttagtattgattatgccactcatcaagccactacgcataacggctgtattgaagaggaggtgaccctgtgtgttatttttctctaaagggacccgcccaccatatgtaactctccagcccacttatactc

SEQ ID NO: 71064 - DNA, 497 bp, Zea mays
  misc_feature: Ceres CLONE 1552026
  misc_feature: Encodes the peptide sequence at SEQ ID NO. 71065
  misc_feature (155)..(155): n is a, c, t, g, unknown, or other
ggagctccccgcggtggcggccgctctagaactagtggatcccccgggctgcaggaattcgtctcacccctagaaaaaagagcagagcaagaagctttgcagtgaacgagtgagtatgtgcggcatactgctgtgctcggtgcgccgacgagccnagggcagcagcaagaggtccccgggtgctggagctgttcccggcgctgaaccccccggggccccccaaatgggaaccgggccctccggaagggggggaaattgttccttttcccccaagggcctgccctatttttaacccgggctttggggaaaaacccccttttaaaaaagaaaaacatcttggggcccccccccctcacccggaaaattttttaaccccccgggtccttctgagggccctccccccgggggggggggccattttttttaaacccgggggaaaaagcgggggggtttccccccccccttctcaaaaaaggagggggaaaaaaaaaatttct

SEQ ID NO: 71065 - protein, 58 aa, Zea mays
  misc_feature: Ceres CLONE 1552026
  misc_feature (14)..(14): Xaa is any aa, unknown, or other
MCGILLCSVRRRAXGSSKRSPGAGAVPGAEPPGAPQMGTGPSGRGGNCSFSPKGLPYF

SEQ ID NO: 71066 - DNA, 652 bp, Zea mays
  misc_feature: Ceres CLONE 1552030
  misc_feature: Encodes the peptide sequence at SEQ ID NO. 71067
ctcaccgcggtggcggccgctctagaactagtggatcccccgggctgcaggaattcgtctcacccctagaaaaagccttgagctgggggttcgttcaggaagctgatctgagagctcgcgaccgcaaccacaaccaacccaaaaagctgcagcagatccatccatctcacccgaaacaatcgatcccctcttatagacttcgcctgcctccaacccttaatcttcagctatggattcagccgccgcgcgacccgacgaggaggaggcgcgccgccgccggagcaccgactgcatctacttcctcgcctccccgttgacctgcaaaaagggaagtgaatgcgagtaccgtcatagcgatgctgcgaggatgaatcccagggactgctggtattggttccatggcaactgcgcaaatcctaaatgctcctttaggcacccgccattagacaacatggccggagcaccaacgactccacgtccagctcaacagtctgtaccccatcaagcttcagcttctgttccagctcagccccagggatctgttcctgcccctgcaagcagggggttccttgctattacctttcggaagggatgtgcaccaaagggggacggtggtgcctttctgctgggccccggtcttgtggaaaccctg

SEQ ID NO: 71067 - protein, 141 aa, Zea mays
  misc_feature: Ceres CLONE 1552030
MDSAAARPDEEEARRRRSTDCIYFLASPLTCKKGSECEYRHSDAARMNPRDCWYWFHGNCANPKCSFRHPPLDNMAGAPTTPRPAQQSVPHQASASVPAQPQGSVPAPASRGFLAITFRKGCAPKGDGGAFLLGPGLVETL

SEQ ID NO: 71068 - DNA, 696 bp, Zea mays
  misc_feature: Ceres CLONE 1552031
  misc_feature: Encodes the peptide sequence at SEQ ID NO. 71069
catagctggagctccccgcggtggcggccgctctagaactagtggatcccccgggctgcaggaattcgtctcacccctagaaaaattctcgccaaaggggaagccctgcccgtacttccgttgcggcgctacgagcttcgacgggcctcgatctccacctctgaagtgactacttgtgatctagatctgaagctgtagtggtcagcagcttagtgtgaatcgaagatgagcgtggtggggttcgacctcggcaatgagagctgtatcgtggcggttgcgcggcagcgtggcatcgacgtggttctcaacgaggagtccaagcgcgagacacccgccatcgtttgcttcggggacaggcagcggttcatcggcaccgccgggcgccgcgtcctccaccatgaaccccaaaaactccatctctcagaattaagcgccttgctcggcccgcaagttcttagaatcccgaactggagggggaatctcgcctccttccatttccaagtcagggagggcccccaatggttttccccctggccctgttcgggacccgggggaaaggaacggaagtttcccctcccccaaatggtttggcagggggttgtcacaatttgaaggggcttttgtgaggggaacccctaaacgccccaatttggttatttgttccaatgggatcccccgggtcatttttaaaaagag

SEQ ID NO: 71069 - protein, 128 aa, Zea mays
  misc_feature: Ceres CLONE 1552031
MSVVGFDLGNESCIVAVARQRGIDVVLNEESKRETPAIVCFGDRQRFIGTAGRRVLHHEPQKLHLSELSALLGPQVLRIPNWRGNLASFHFQVREGPQWFSPWPCSGPGGKERKFPLPQMVWQGVVTI

SEQ ID NO: 71070 - DNA, 535 bp, Zea mays
  misc_feature: Ceres CLONE 1552032
  misc_feature: Encodes the peptide sequence at SEQ ID NO. 71071
ggagctccccgcggtggcggccgctctagaactagtggatcccccgggctgcaggaattcgtctcacccctagaaaaaagcccaccccaggtcgccacgcccgccacaagaagcagcagccttacccgaaccgaagacgaaccctaccgcgccttgatatcatatcgtctccgtgtcgttctcgcagcgcagcgagcgagccacgcgctcctgcgcagtagcgtaatggcggtgcaaggcggcgaggagagggagagcgggaagggcgccgccccggcggtggtgtcaggcggcgaggcgggcccgccgggccggaggacggcgaggggccacccgctcctgcgcggcgggtggaggcgcgaccggtacacgcacgggatgcggccggcgcagatggaggcgctccgcgccatgtgcggcgcgctcatcccctcgctgcccgccgaacgccgacgccgggccgcgggcgacccgccccgggcgggcaaggaccctccgagccgctttctaccctcgcccctccggccggcccgaa

SEQ ID NO: 71071 - protein, 103 aa, Zea mays
  misc_feature: Ceres CLONE 1552032
MAVQGGEERESGKGAAPAVVSGGEAGPPGRRTARGHPLLRGGWRRDRYTHGMRPAQMEALRAMCGALIPSLPAERRRRAAGDPPRAGKDPPSRFLPSPLRPAR

SEQ ID NO: 71072 - DNA, 658 bp, Zea mays
  misc_feature: Ceres CLONE 1552035
ggagctccccgcggtggcggccgctctagaactagtggatcccccgggctgcaggaattcgtctcacccctagaaaaaaccgccggtggaaaaactttggaggcgcccaacttccaagatacccactagctcccagcctcctaccttgccctttccacccttcgctgatgctagctaggatgatgggatttttcgagctctaagacaagtactactgatccttgcgcttcacacgccctcttgctccctgcgtgttcttgattcggcctcaaaatttgttgcctgttttctcgtgtttgaggtgatatctcggttctaaaaatctgccagatttcttctccccgtttgtatggacaaatttgggaacgaaccctagtctgtgtgtgaagcagccaaagtggtgttcttgcggagcaaagcaaagctaaagctgcagcagttggtgaggatacatgagatacagaagggcttgttagattctgtaaagacactcttattagctgatacttttttccatcaactggggccggtttttcggaagtacgcccatcttggattaaagcctctcaatttcaggattcggcacaggcacaataccatcaagtgaacaagagccatttggtcttgggcatggagaagcaatccagcacccggcatg

SEQ ID NO: 71073 - DNA, 617 bp, Zea mays
  misc_feature: Ceres CLONE 1552050
  misc_feature (345)..(345): n is a, c, t, g, unknown, or other
  misc_feature (348)..(348): n is a, c, t, g, unknown, or other
  misc_feature (351)..(351): n is a, c, t, g, unknown, or other
  misc_feature (379)..(379): n is a, c, t, g, unknown, or other
  misc_feature (389)..(389): n is a, c, t, g, unknown, or other
ctccccgcggtggcggccgctctagaactagtggatcccccgggctgcaggaattcgtctcacccctagaaaaaacctcccttggtttggctggcggctagcccctaaccaaaaaaaaataaaataaaaccaactctcccattcggccatttgcccatttcccatctcgccttcgcttcccacgcccctccgtcccgcctcgccgcggcaaggcaccgccgccaaccgccctcgtccctcttcgactcgaccgcgtgagtgagacgaccgcgcgcgcccctcgcccgcccgccaggaagagatcgacccccgaacgcgtcatgaagtacgtgctggtgaccggcngcntgntgagcgggctcgggaagggcgtgacggncagcagcgtncggggcgtcctcaagtcctgcggcctccgcggtcacttcatcaagatcgatccataacccaaccttcgatgcccggaacattggcctccttcagcaatggcaaggggttggtttggaccaccggggggaagggggaacttgaaccttggaaacaacaaaagattttcgggaattcaaggtgaaccgcgaaaaaaaacttaccccggggggaaaattcccccgtgcggg

SEQ ID NO: 71074 - DNA, 707 bp, Zea mays
  misc_feature: Ceres CLONE 1552052
  misc_feature: Encodes the peptide sequence at SEQ ID NO. 71075
  misc_feature (344)..(344): n is a, c, t, g, unknown, or other
  misc_feature (630)..(630): n is a, c, t, g, unknown, or other
  misc_feature (707)..(707): n is a, c, t, g, unknown, or other
ctggagctccccgcggtggcggccgctctagaactagtggatcccccgggctgcaggaattcgtctcacccctagaaaaaaaacatcctcctctcctcgcagacatcttatccctcccgatcgaggccccgtttcctcctcctccggccaccgcacttagctgtcttaacttgccgttcggttcgcagcctcacgcccatggctaggaagtgctctagctgtgggaacaacggccacaactcgaggacctgcagcgggcacggcgccgggggcgggggcgtgaggctgttcggggtgcagctgcacgtggggtcctcgcccgtggccatgaagaagtgcttcancatggagtgcctgtcgtcgtcggagtacgccgcgccgggcgactacgcggccgctctcggcgcgacaaaaggggctcgccgtcggcctcctcctcgtcgtcgctcgtctcgggggaagagggccccgagaagatggcccaagggtacctcttccacgggctcatgggcagggttggcccaggaaaagaacaaagggggtttcttgggacggaggaaccaacaacaggcgaattccgggccgggcttgggagaacacccgggaagggggaaagcggggagagcaacntcccgggaagttcctggacgggcgccgaccgtcgggaggggggggagggttaacaaacaaccaaaaacattcataan

SEQ ID NO: 71075 - protein, 169 aa, Zea mays
  misc_feature: Ceres CLONE 1552052
  misc_feature (49)..(49): Xaa is any aa, unknown, or other
MARKCSSCGNNGHNSRTCSGHGAGGGGVRLFGVQLHVGSSPVAMKKCFXMECLSSSEYAAPGDYAAALGATKGARRRPPPRRRSSRGKRAPRRWPKGTSSTGSWAGLAQEKNKGGFLGRRNQQQANSGPGLGEHPGRGKAGRATSREVPGRAPTVGRGGRVNKQPKTFI

SEQ ID NO: 71076 - DNA, 607 bp, Zea mays
  misc_feature: Ceres CLONE 1552053
  misc_feature: Encodes the peptide sequence at SEQ ID NO. 71077
  misc_feature (246)..(246): n is a, c, t, g, unknown, or other
  misc_feature (261)..(261): n is a, c, t, g, unknown, or other
ctccccgcggtggcggccgctctagaactagtggatcccccgggctgcaggaattcgtctcacccctagaaaactagtcccctgctccattctcagccgccgccaatcccttcccgtgctccgcaaccgctgagtgagaagaagagatggccggcaagggcgatggcccggctatcggcatcgatctcggcacgacgtactcttgcgtcggcgtgtggcagcacgaccgcgtcgagatcattgccnacgaccagggtaccngcaccacgccctcgtacgtcgccttcaccgactccgagcgcctcatcggagatgcggcccaggaaccaggtcgccattgaaccccatcaaccccgtcttttattgccaagcgtttcatcggcagggaggttcatggatgcctctgtcccaaaggaattcaagtttggggccttaaaagggctttttcggggcctggtggaaaacccattaatttttttccccccccaagggtagaggaaaaaacctttttccccccaaaaaaaatcccccccttgggggccttaccaagaacccgggaaattttccaaaaattccccccttggggcacaaataaaaaaaaggtgtg

SEQ ID NO: 71077 - protein, 64 aa, Zea mays
  misc_feature: Ceres CLONE 1552053
  misc_feature (34)..(34): Xaa is any aa, unknown, or other
  misc_feature (39)..(39): Xaa is any aa, unknown, or other
MAGKGDGPAIGIDLGTTYSCVGVWQHDRVEIIAXDQGTXTTPSYVAFTDSERLIGDAAQEPGRH

SEQ ID NO: 71078 - DNA, 575 bp, Zea mays
  misc_feature: Ceres CLONE 1552056
  misc_feature (162)..(162): n is a, c, t, g, unknown, or other
  misc_feature (204)..(204): n is a, c, t, g, unknown, or other
  misc_feature (271)..(271): n is a, c, t, g, unknown, or other
  misc_feature (309)..(309): n is a, c, t, g, unknown, or other
  misc_feature (342)..(342): n is a, c, t, g, unknown, or other
ctccccgcggtggcggccgctctagaactagtggatcccccgggctgcaggaattcgtctcacccctagaaaacccgtcagccactcctctatcggtgacgcacgcaccccccacctctgatctgatctctccccctggatctcgacctccgcctggctgcntccgctctgcgtcgctcgccatggcgtctcgacgggagcttnagcacgcgggtcacgtcacgccgcgcccttcatcactcgtcacggagctgctctctgggcagcagcngacatggtaggagccgcgggcgccgatcatcaggagcngtcgccgaagggggctgttccaccgcggcgccnacagggggcggcggccgtaggcgtgccccaaagtccaagttcccgcagcccgccccagcgtgccattttcgcccgccgccgattgtcgcccctccctcttaattttcccttccggcccggggtttaccccccgccaaatttggtggaattccccccgtctgggttccaattttttcctgaaaatttttttggggggccccaccacccgggggccttcccgggggccaaaaggt

SEQ ID NO: 71079 - DNA, 681 bp, Zea mays
  misc_feature: Ceres CLONE 1552057
  misc_feature: Encodes the peptide sequence at SEQ ID NO. 71080
ctggagctccccgcggtggcggccgctctagaactagtggatcccccgggctgcaggaattcgtctcacccctagaaaaaatgatcggccacctcttctacatttggccttccaagctctggacaagtttaggtctgagttggcacaatttcctattgctgggtcagatgatgatgcacagaagctgatagatcttgctattagtattaacgaaactcttggtgatagtaagcttgaagaaattgacaagaagctcctgcagcatttcgccagtggttccagggctgttttgaatcctatggctgcaatgtttggcggtattgtaggtcaggaggttgttaaagcatgctcagggaaattccatccactttacccagtctttctacttgattctgtcgaatctctgccagtttgaaccgttgggaccctagtgatttgaagccagagaacagtagacatgatggcacaattagtggtcttgggggctcagcttcaaaagaaacctgggacagccaaaaatcctcctggggtgggtctgggggccctgggaatgtgaaatttttgaaaaaccctggccttaaagggggttttccttgccccccaaaaggggaaacctgaactggacaaaaatattaatttttaaaaaaaaaaaacattctccagcgccccaggtttcccttt

SEQ ID NO: 71080 - protein, 38 aa, Zea mays
  misc_feature: Ceres CLONE 1552057
MAAMFGGIVGQEVVKACSGKFHPLYPVFLLDSVESLPV

SEQ ID NO: 71081 - DNA, 645 bp, Zea mays
  misc_feature: Ceres CLONE 1552058
  misc_feature: Encodes the peptide sequence at SEQ ID NO. 71082
ctggagctccccgcggtggcggccgctctagaactagtggatcccccgggctgcaggaattcgtctcacccctagaaaatttcctcttcgtgaagaggctgagagctcgccttgcatgcacgcgcacacctctgcttgggagtacgtgcacagcggcagcagcggactaggagctccatgcatctgtctctagggtgtagagatcctgctcattgtacggtagctgccaccgtctcatcgtcaaccatgtctgctgcttccaccgtggatcctcatcctcctcctcatcatcagcagtgcaataaggtgtcgtccatggagatggagatccccgccgaccttatcatccggatcggcgagtccgttttccctctccacaaggcggtgatggtgcccaagtgcggctacatccgccgggccgtcgaggcggccaggcccagcagcaagggcgccgccgacgccgacgccgacccgccggccaccgtcgagctggacctctcggcgctgccgggcggcgccgacgcgttcgacaaggcggcgcgctactgctacggcgccaatttcgagatcacgccgcacaacgcggcggcgctgcgctgcgccgcggcgtttctggacatgcgccacgccttcgcggacctgggc

SEQ ID NO: 71082 - protein, 133 aa, Zea mays
  misc_feature: Ceres CLONE 1552058
MSAASTVDPHPPPHHQQCNKVSSMEMEIPADLIIRIGESVFPLHKAVMVPKCGYIRRAVEAARPSSKGAADADADPPATVELDLSALPGGADAFDKAARYCYGANFEITPHNAAALRCAAAFLDMRHAFADLG

SEQ ID NO: 71083 - DNA, 645 bp, Zea mays
  misc_feature: Ceres CLONE 1552063
  misc_feature: Translation starting site: 161
acccgcggtggcggccgctctagaactagtggatcccccgggctgcaggaattcgtctcacccctagaaaaaagcggcattgcaggttgcagcaaagagagagagagagagagagagagagagagagctcacgagcctcccgtcctcccctacccccctcatgcgccgcaagaagcacttggaccggggtgggggcggcggcggaggtggcacggagctcttcatctgcttcacctcgcgttcctccgctgcctcagccatttccgtcgccggcggcagcgcgcactcttccctccgcccctccagctcctccaagctcctcagccccggccgcggcagtgccagcgcaagcggagctgaggcagtgccggccccgcctctgcacccctcactcagccgccgcctccgcaacagcggcagcctcaagggcggccagtccccaatgttcccctccgggtccacgggcggtggccgccgcggccgggggcggattcgaaccctgcgaaccctcgtctcccaggtcacctgcatcgggcaggtccgccgtcaaggccgttaggcgcagcccaaggaagcctccgccgcccgcgttgggttccgcttccagggggggggaagcgggacccaaaggccacctcccccgcc

SEQ ID NO: 71084 - DNA, 665 bp, Zea mays
  misc_feature: Ceres CLONE 1552069
  misc_feature: Encodes the peptide sequence at SEQ ID NO. 71085
  misc_feature (655)..(655): n is a, c, t, g, unknown, or other
aagctggagctccccgcggtggcggccgctctagaactagtggatcccccgggctgcaggaattcgtctcacccctagaaaaaaaaacccgccagcatctccctccgagtccagggggcaggggcaccattaccgagtagtttaattagtgctagttgtattaccgttgttagtgacataattaccctcacgcgaagaacccctaccttggctagtcctcctacgtatacgtctcttctcttcgcttaatcttggtcggtgatttgattctgcacttcttgggcgcattgcagagggtgctcggtctgcagctatcttaggttaaccagtcgtgtgtggtctatcggtttcgatatagtactactgctctgttataatcagcggggaggaggaagatgacggtgacgccacggatcacggtgagcgacgggcggctgacggtgcgcggccgtacggtgctcaccggcgtgccggacaacgtgtcggcggcgcacgcggccggggcggggctcgtcgacggggccttcgtcggcgcccacgccggcgaggccaagagccaccacgtcttcactttcggcacgctccgggactgccggttcctgtgcctgttccggttcaagctgtggtggatgacgcagccggatgggcgtctccngccgcgacgt

SEQ ID NO: 71085 - protein, 90 aa, Zea mays
  misc_feature: Ceres CLONE 1552069
  misc_feature (87)..(87): Xaa is any aa, unknown, or other
MTVTPRITVSDGRLTVRGRTVLTGVPDNVSAAHAAGAGLVDGAFVGAHAGEAKSHHVFTFGTLRDCRFLCLFRFKLWWMTQPDGRLXPRR

SEQ ID NO: 71086 - DNA, 661 bp, Zea mays
  misc_feature: Ceres CLONE 1552071
  misc_feature (272)..(272): n is a, c, t, g, unknown, or other
  misc_feature (409)..(409): n is a, c, t, g, unknown, or other
  misc_feature (446)..(446): n is a, c, t, g, unknown, or other
  misc_feature (455)..(455): n is a, c, t, g, unknown, or other
  misc_feature (457)..(457): n is a, c, t, g, unknown, or other
  misc_feature (458)..(458): n is a, c, t, g, unknown, or other
  misc_feature (465)..(465): n is a, c, t, g, unknown, or other
  misc_feature (466)..(466): n is a, c, t, g, unknown, or other
  misc_feature (472)..(472): n is a, c, t, g, unknown, or other
ctccccgcggtggcggccgctctagaactagtggatcccccgggctgcaggaattcgtctcacccctagaaaaagccctcccacaccgcccccctcccccacggcccgccttcccccgggaacacgagaccctcgttccctgcgccaccgactgagccaaggccgcgccttgccgtttccgacctaggtcgcgagatctcggaggagcggagccccgccgtgccgccgcctgctacaggggggcacgcagggaccgcacggtgcgatggtgngacacggggcggggggaggctctaccagcgccgtggcgcggtcgctttcgtcgcggccaacaaggcgctgctcgccgctgcgtgggtcgtcgggttcgcgctcgtgttcctatggcagagcgcctccatgtccttcngcagcgccggcggcggagggtacctcagggctctgtngggggcgcntnncgcgcgnngcccgngccgggggtttcgcccacggcgtaacacatcacggacttcggggccgtcggggacggcccgggcgtcaacacccgggcgttcaaacgtgtttcaaggccatcccgggcttcccggaacgaggccgggggcaactaaatggcccccccggggttggggttaggggccctttaacccttcccggcccttgg

SEQ ID NO: 71087 - DNA, 876 bp, Zea mays
  misc_feature: Ceres CLONE 1552073-R
  misc_feature (1)..(1): n is a, c, t, g, unknown, or other
naacaattgggtcctcgagcgtctcgattgtttttttttttttgctctcacaggtcgtcttcctgagaaaacttatacatgaccaatctttttggttcaatattacccatgcagtaacgcacaagaacagtggtcaattcgtacaccatatttcaagaatgtcgccagtgctgcctggcaggcaaacaaaaacaatgcctcacgccgtgtacaacctctaccctcacaagcacaaatcgacaaaactaagacaagcacgccacccaatcagccaatccacgccctaattatgtactgttgtcgccggtcaaacatagcgtgatcacttcatcaggtgccttggtcgcctgggccagcgagagcgatattggaattccaaaacgaaattgcgagcaatcattatcggcagcatttcctgtcccctggtcttgtttcccaaaggcctagaatggtaagaacaaaccctttccctaggggtggcccaaaaaaaactggccctaagctggcaagaattttaccccccaccccccggggttccccccataaaccttttctttccgaaaggggaaaaaaccaaacctcctccctgggctttttggggagaaacccactccccttttccaaaaaattttttttttcccccacccttttcccaattgggggggaaatacccattaaaaaccaaattttcccacaaaataaaacccctttcccccatttcattttggggggttaacacccccccccttttgaaaactccaaaaaatccccgccccctttttcattttggggagccccccacaataaaccttttcaaaatcccccggaaaacttttttctcttaggggggcccccttttgggtctgaaaaactttt

SEQ ID NO: 71088 - DNA, 667 bp, Zea mays
  misc_feature: Ceres CLONE 1552079
  misc_feature: Encodes the peptide sequence at SEQ ID NO. 71089
  misc_feature (219)..(219): n is a, c, t, g, unknown, or other
  misc_feature (235)..(235): n is a, c, t, g, unknown, or other
  misc_feature (239)..(239): n is a, c, t, g, unknown, or other
  misc_feature (240)..(240): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
ggagctccccgcggtggcggccgctctagaactagtggatcccccgggctgcaggaattcgtctcacccctagaaaaagcgttactgtaccaatggctccccacctcctggccgtggccgtggccgtggcggccatcatcgccaccgtctcgttgctggcgcccggcgccgctgcctacccgtggccagtttgtgggacgagcaacgacttcgagcccnacagcacataccaggncaannctcaactnnnctcgccgcatgctgccaaaacacgtggtcgcattcccggtcctctacgccacgccggtctttgggccctccccgaacaagtctggggcatgggaattttgccccggggaaacccaacccaggaaggtgccttcccttggcctaccccagggtttcaggaaactggccaaaaaattgggtcctaaaaaaagggaagccccctttttattaaaaaccccggggcccccccccttattccgaaagtgtcacaccccctcccaaaaaaaaaaaccgggcccacaaacaattttttttaaaaaattaaaaaaaaacgcccccatttcccctctaaaccccccgcgggtttgaaacgcctccctccccccccccctttaaaaccccccccgaaaaaaagcgcggggtaaattccccccggggg

SEQ ID NO: 71089 - protein, 113 aa, Zea mays
  misc_feature: Ceres CLONE 1552079
  misc_feature (43)..(43): Xaa is any aa, unknown, or other
  misc_feature (48)..(48): Xaa is any aa, unknown, or other
  misc_feature (49)..(49): Xaa is any aa, unknown, or other
  misc_feature (50)..(50): Xaa is any aa, unknown, or other
  misc_feature (53)..(53): Xaa is any aa, unknown, or other
MAPHLLAVAVAVAAIIATVSLLAPGAAAYPWPVCGTSNDFEPXSTYQXXXQLXSPHAAKTRGRIPGPLRHAGLWALPEQVWGMGILPRGNPTQEGAFPWPTPGFQETGQKIGS

SEQ ID NO: 71090 - DNA, 674 bp, Zea mays
  misc_feature: Ceres CLONE 1552083
  misc_feature: Encodes the peptide sequence at SEQ ID NO. 71091
tccccgcggtggcggccgctctagaactagtggatcccccgggctgcaggaattcgtctcacccctagaaaaaaacaactcccccaatccgtcccgtcggccggacgagcagggcccaagggcccaccttaccatggcgaccgccactgccgcccccgtccccgccggcggccacccgtaccgccgcgcccgcactcgctgcggcccaccgcgcctgcaccgcctgcgcttcccggccgcagcagcagccgcttcgtcttccctgcccgccccgtcgtccatgctgccaccgctgccagatggaggcgggcggctggtggcggagctggtgtgcgcgttcaacgagctcacggagcggatgggggaggacctggcgacgtcctcctcgtcgagcctgctcttccgtgtgctgaagctggcgctccccgccctccgcgacgtggagggcggccgggcactcgcacgcgcgctcgccgtcgccgcgaccctcgctgacctccagatggatgctgaagtcatatcagccgggatactaagagaaacattagatgcaggagctgtaagaatgagggatgtaaaaacacagatggggatccgcacaactcatttgctgcatgacagctaaaggattaagcatgctccctccaaaacttgacgatttgaatgatggaagt

SEQ ID NO: 71091 - protein, 163 aa, Zea mays
  misc_feature: Ceres CLONE 1552083
MATATAAPVPAGGHPYRRARTRCGPPRLHRLRFPAAAAAASSSLPAPSSMLPPLPDGGGRLVAELVCAFNELTERMGEDLATSSSSSLLFRVLKLALPALRDVEGGRALARALAVAATLADLQMDAEVISAGILRETLDAGAVRMRDVKTQMGIRTTHLLHDS

SEQ ID NO: 71092 - DNA, 653 bp, Zea mays
  misc_feature: Ceres CLONE 1552086
  misc_feature: Encodes the peptide sequence at SEQ ID NO. 71093
ctccccgcggtggcggccgctctagaactagtggatcccccgggctgcaggaattcgtctcacccctagaaaaactcccttccctcccgtaccgtatcagtctcccggattctctccggttcgtgggagggccaaagcttcgagttaggaaaaccctaccgctgtgggagtagcctccggcgatggctgcggcggcgatcctgccggagctggcgacgcaggtgctcatcccggtcgcggcggccgtgggcatcgcgttcgcggtggtgcagtgggtgctggtctccaaggtgcgggtcacccccgagcgccgcgcggacggcggggccgtgaagagcgggcccagcgactacctcatcgaggaggaggagggactcaacgaccacaacgtcgtcgtcaagtgcgcccgagatccagaccgccattctctgaaggagctacatctttccttttcactgagtacaagtatgttggattattcatgggcatcctttgcaatccttatatccctcttccctggggtctgtccaggggatcccccccaaagagtccacccttgcccctttttccaggggccaaactttgaaagcctggcctttgcaaagcccttctttcaaacttaacctttttgggcctggggcaaccccccccct

SEQ ID NO: 71093 - protein, 146 aa, Zea mays
  misc_feature: Ceres CLONE 1552086
  misc_feature: SWISSPROT Homolog: EC 3.6.1.1 Inorganic diphosphatase
MAAAAILPELATQVLIPVAAAVGIAFAVVQWVLVSKVRVTPERRADGGAVKSGPSDYLIEEEEGLNDHNVVVKCARDPDRHSLKELHLSFSLSTSMLDYSWASFAILISLFPGVCPGDPPQRVHPCPFFQGPNFESLAFAKPFFQT

SEQ ID NO: 71094 - DNA, 652 bp, Zea mays
  misc_feature: Ceres CLONE 1552088
ggtggcggccgctctagaactagtggatcccccgggctgcaggaattcgtctcacccctagaaaacccccgccacaacgcgagccgcatcgcctcgtctcctccacgccatacacgcccgccttcccttccccggcgaccaggacccctcgcccgcggcgccagcgagctcccccggccagtcgtaggcctcccggagctcagcacgcacgcaggtgggtccagtgaggcctggttgtgcgcgttcctgcgggcgtcgtcggggcagatccatggaactcagccgcccgcagcgcggatagtactgcacttgtgcaccagccaccagcggatcgccaggactgcccacctgctgctgcttgtgtcgctagccatttttcgggcgtctggcttggaggatatggccgcggcgatggacgcgcccaaccctggagcggctgctggcccaggttcggattcctgtctctagcaactagcagtctagctgctgaattttctcgctcctatactgctgccctgtacttgcaagctatgccttctttgaatccgctgcggcttcgctaaaattggcttgcgcgaaactgaggcactcaagtcactggggcctggatggggtcgagttgggtggggtggactttagtagttgactaatt

SEQ ID NO: 71095 - DNA, 670 bp, Zea mays
  misc_feature: Ceres CLONE 1552098
  misc_feature: Encodes the peptide sequence at SEQ ID NO. 71096
ctggagctccccgcggtggcggccgctctagaactagtggatcccccgggctgcaggaattcgtctcacccctagaaaaagttgagcacttccccttctcctacccttcacctcccgtttgcccgcagccgccaccgcgtccccaagcactccagcgcccccgtccccgatcgacgccatggtgtcggaggccagcaagaagaaggccgcccagaagaaggccgctgccgccgcaaagaggggaggcaaggcctcggtggcgtcctcgtcgtcttcatctgcggccgcggccgccgataaggtggcgaacggcgtcgtggcgcttaagctatcagaccgcacctgcaccggggtcctcgcatctcaccccctttcccgggatatccacatagagtctctttctttaacattccatggacacgaccttattgtggattctgatttggagctgaactacggaaggcgatacggtttgcttgggttgaatggctgtggaaaatctactcttctcacagcaataggctgcagagaacttcctatccctgaacacatggacatataccatctaagccatgagattgaagcttctgacatgtctgcactgcaagccattgttagttgtgacgaagaaagagtgaagttggaaaaggaagctgaaatttggctgcac

SEQ ID NO: 71096 - protein, 164 aa, Zea mays
  misc_feature: Ceres CLONE 1552098
MVSEASKKKAAQKKAAAAAKRGGKASVASSSSSSAAAAADKVANGVVALKLSDRTCTGVLASHPLSRDIHIESLSLTFHGHDLIVDSDLELNYGRRYGLLGLNGCGKSTLLTAIGCRELPIPEHMDIYHLSHEIEASDMSALQAIVSCDEERVKLEKEAEIWLH

SEQ ID NO: 71097 - DNA, 894 bp, Zea mays
  misc_feature: Ceres CLONE 1552102-R
  misc_feature: Pfam Name: Peptidase_S49 Pfam Description: Peptidase family S49
ctacgtgtttctgtgcaagatagatgtgtagtgacattatgaatttcccctcatctctaaatacaaatatttggaacatagagacctgagtgctagaattaatcaaaatagctcatgatatcttttacaagcaacaataactggttttctcctgacatgtctcctaaactttcaaacagaattccatccatcctagcgtggactccacttagggaggtcatgtcgtggagcactcccttcagtgccgtgtcaactccaagcaacgaacctcctatgccagataatatctccggtaatgatggagagggctttgaaacttcaactagctggatcctcttatccgtgggtatatgagctctctgttttgcaatagcaagatcttgagagaccccacctactgaatcaaccaaccctctagaaaatgcatggtggccgctccacactcgatcttagagcacactctccatcagatcaacactcagtgatcgacacgtgtctgctttatcacgaaactatgcataagctttgtgcgctgacttttaaaaaaagctctgcctcgtcgggtcttaaagggctttgatctttaacttaagctcagcatagcgacccgtgggatataatctctttagagaaacaaccctcccataaacttgtgaaagggagaacttcccctgataacactcaattgaccctgtgagagtattttcctcacaactattacgggtgcacctttgccttggtataccccttttggcggcacctcaaactcggaaccactcgggtttagagtggcctaaaacgcagattcccccccctcaaataagagagaaagcctcccccggggggttctatccggagaaaacccctgggaattttgaaattcctaaagctctt

SEQ ID NO: 71098 - DNA, 697 bp, Zea mays
  misc_feature: Ceres CLONE 1552103
  misc_feature: Translation starting site: 181
  misc_feature (312)..(312): n is a, c, t, g, unknown, or other
  misc_feature (661)..(661): n is a, c, t, g, unknown, or other
cagagctggagctccccgcggtggcggccgctctagaactagtggatcccccgggctgcaggaattcgtctcacccctagaaaattccccttccgctcgagtctgctctagggtttttgccaagccgccgtcgccgtcgctctgccctcgtatcccctcccacgacaccgagacaccaagatgacggcgcagaccgcggaggagctcgccacccagatcgagcagcagaagctcgaggagcagaagaccgaggcagaggaagttgtggtggaggatgaggaggaggaagatgaggacgatgacgatgatgancaggatgatgatgaactcgatggggatgccagtgggcagtcaaagcaaagcaggagtgagaagaagagccgcagggccatgctgaagcttggcatgaagcccatcactggtgtcagccgcgtcactgtaaagaaagcaagaatatactctttgtcatctccaaaccagatgtgttcaagagcccgaattccgacacgtatgtcatattcggcgaggctaagatcgaggacctcagctcccagctgcagacccaggcagcagagcaggtccagggctcctgacttgagccagatgatcttgaatcagagacgtctggccggggaagggagacaatgatgaggagtcgacnaaactggtgttgaggcaaggacattgacgctgtgat

SEQ ID NO: 71099 - DNA, 689 bp, Zea mays
  misc_feature: Ceres CLONE 1552104
  misc_feature: Encodes the peptide sequence at SEQ ID NO. 71100
  misc_feature (421)..(421): n is a, c, t, g, unknown, or other
  misc_feature (433)..(433): n is a, c, t, g, unknown, or other
catagctggagctccccgcggtggcggccgctctagaactagtggatcccccgggctgcaggaattcgtctcacccctagaaaaagaacggagaagagaacaagagatagtacttgacactcctgtcctgctcctccactcccacgctcccagccgagctcgagcgcacgcacacgcgcacaagcaggagctcctgtcccgctagatcccaaacagtctcctgcccgcgcgcgtttgggggggggcgcgaaggaatcaccggatggcgatgttcgcgcggccgctgctggccaccctgctgctgctgccggcgttcctgctctctgccgcctcggccgccgacagcaagagcaaccctgctgatgagctcgtggcactgatcaacagcaaccgcactgctggcaagggcatctctgtttcngacaaccaaggntttgggatgcatcgctctgcagtacatcaaagcatacgaaggccattgtgaccaagtggacgaacagagccgatggagtcaagcttcaccgacacgttcgccccgacctgtggcgtccaggcaaaaccctctccaagatcaccggaaagctggttggcttgccagtccccagtacttgggctccagctgaagcccttggccgtcttgttggtgaaacaaccccgaaggccccccagaaactgcccagcaaagaacc

SEQ ID NO: 71100 - protein, 73 aa, Zea mays
  misc_feature: Ceres CLONE 1552104
MAMFARPLLATLLLLPAFLLSAASAADSKSNPADELVALINSNRTAGKGISVSDNQGFGMHRSAVHQSIRRPL

SEQ ID NO: 71101 - DNA, 676 bp, Zea mays
  misc_feature: Ceres CLONE 1552106
  misc_feature: Encodes the peptide sequence at SEQ ID NO. 71102
tggagctccccgcggtggcggccgctctagaactagtggatcccccgggctgcaggaattcgtctcacccctagaaaaagagaatccgaaccgctgcatgtcctcctcctctccgcctcactgcggcgcagtgcacatctgccaagatctacacctcctcctgctcggccctgtgcctcgacatctcgcatccgctccatctatgaaaggccgccacacgccatggatagacgctctctacgggcacctcgattgaaggtccacctctctctacggggatcgaccgcctcctcatcggccgccgtcaattgaaggtcccagatatcgtctccgattacttctctccccattaccgcgctctagatctgccttttgtggagggccgccaattgcttctcttgctcccccccaatgaaatgtacgaaaaatcgtctccctataagggcgctcaagtaaatgggaggtccgccattttgggaaggttcgagaactcctcctcgaccccgggctaaaacggcctgggaaataagaaacctcggcttcggcccacggaaaaaaaaggcgggggaaatccggcaacatcacctcctccggttctcacccccgccgcctattatggaagggccagcaaaagggactcaggactttccaagaacttgtttgaaaacggaacccg

SEQ ID NO: 71102 - protein, 29 aa, Zea mays
  misc_feature: Ceres CLONE 1552106
MDRRSLRAPRLKVHLSLRGSTASSSAAVN

SEQ ID NO: 71103 - DNA, 699 bp, Zea mays
  misc_feature: Ceres CLONE 1552107
  misc_feature: Encodes the peptide sequence at SEQ ID NO. 71104
  misc_feature (462)..(462): n is a, c, t, g, unknown, or other
  misc_feature (463)..(463): n is a, c, t, g, unknown, or other
  misc_feature (560)..(560): n is a, c, t, g, unknown, or other
  misc_feature (663)..(663): n is a, c, t, g, unknown, or other
  misc_feature (664)..(664): n is a, c, t, g, unknown, or other
aaagctggagctccccgcggtggcggccgctctagaactagtggatcccccgggctgcaggaattcgtctcacccctagaaaaacttccatctccgatctgctgccataccactaccacaccatggatagccaaactccactgcataacccgctgcgaagaaaccttctaaagtgactaaatgatcgatctccttgtcctgaaaggctgaaacctaatgcgagagaggccacgggagagcgccatgattctcctgctcctgggctgctctcctgcatcgtcgcgcccagactgctctccagcttccaggagaagatgcatcaccgccggacagaaaatggtcaggtgctctctgaatgaagaaacgcagctgaacaaacatggactactatccaagcagttaatttcatgccttgctgcttcgcttgtgttcgtctctccacctagacaggctattcctgcnnaaacctttgcccgtccaggcttgtgccagattgaaacactggcagccattgacagtgcttcagttcctctgaagtttgaaacccttcagatgatgtncccacaggcataatgatgaggggtatgaccgtcaaaaactacgatccagttcccttactctggtagaaggttgaagggagcctcattttaaacgaggatttgnngggctcgggaacacgaacaatgtccactgtactca

SEQ ID NO: 71104 - protein, 78 aa, Zea mays
  misc_feature: Ceres CLONE 1552107
  misc_feature (43)..(43): Xaa is any aa, unknown, or other
  misc_feature (75)..(75): Xaa is any aa, unknown, or other
MVRCSLNEETQLNKHGLLSKQLISCLAASLVFVSPPRQAIPAXTFARPGLCQIETLAAIDSASVPLKFETLQMMXPQA

SEQ ID NO: 71105 - DNA, 660 bp, Zea mays
  misc_feature: Ceres CLONE 1552111
  misc_feature: Encodes the peptide sequence at SEQ ID NO. 71106
  misc_feature (546)..(546): n is a, c, t, g, unknown, or other
gctccccgcggtggcggccgctctagaactagtggatcccccgggctgcaggaattcgtctcacccctagaaaaatccactcgacaggctttacttgcttcctggcttgacgaacttagcaagctaccagcggtcggtgaggtcgagcgctggtgcatcgccatggccgaggacgggaagtccaatgatcaaatcctcagtgagctcgacgcactcagccacacgctctaccagacgcacaccaagcgccgcaccacctcgctcgcgctccgtcgctctgccgtcgacgaaaatgcaggcggcgctgacgctgtcgctgtccgcaccgcggcgcgcccgctctcccgccgcatgtccatgtcgccgttccggtcgaggcctaagctggacaataacttgaacgacgacgacgacgaagacgacgacgcgggcgtggcgctgccgtccaagagccagagcttcgctgcggtgacaacgtcgccgaccgtggtcggggagaaaaagggcattcggggatggaagccgatccgcgcgttgtcgcgcatncgcatgcagcggatgggctgcctcttctcgtggaaagtggtggccgcgcaagcctttccacgtcaatgaatggctgcccctcgcggtggcgtccaaaaaaggaaaaccgccaac

SEQ ID NO: 71106 - protein, 150 aa, Zea mays
  misc_feature: Ceres CLONE 1552111
  misc_feature (128)..(128): Xaa is any aa, unknown, or other
MAEDGKSNDQILSELDALSHTLYQTHTKRRTTSLALRRSAVDENAGGADAVAVRTAARPLSRRMSMSPFRSRPKLDNNLNDDDDEDDDAGVALPSKSQSFAAVTTSPTVVGEKKGIRGWKPIRALSRXRMQRMGCLFSWKVVAAQAFPRQ

SEQ ID NO: 71107 - DNA, 696 bp, Zea mays
  misc_feature: Ceres CLONE 1552115
  misc_feature: Encodes the peptide sequence at SEQ ID NO. 71108
  misc_feature (470)..(470): n is a, c, t, g, unknown, or other
ctccccgcggtggcggccgctctagaactagtggatcccccgggctgcaggaattcgtctcacccctagaaaaagcttgctgggcgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgcggcgcccctccgcctcagtctcccgcgccacctcccccggtccaccccgctccgcctgcccgccgcgctcccgctccgccaatggctcccgccccttcgcggcgccttccgccgccgccgccgcagtccccgcccccgggggacgaagcgtccccccaagtccctgggcgtggagaacaaaaacaatcaaaaaaaatctcgcccctgggggtcaatgttncttggggatcccctcttaaattacacccttccgggcaaaaaccaagggaagtggctccgtcttacccccccaaggggcaacacaccccaaaaaacaacccccttgcccccaaaaaacctggggaaaaaacctgtgccatgggcaaggcccggcttacaggcgccccctcaaaaacaaaaagttcgcccaaaatattctctctacaaaggggggcgcgctccttttg

SEQ ID NO: 71108 - protein, 185 aa, Zea mays
  misc_feature: Ceres CLONE 1552115
  misc_feature (110)..(110): Xaa is any aa, unknown, or other
MESGLVASHRLRVPPPSASAGHHHLIRHRHAHAPVAAAPLRLSLPRHLPRSTPLRLPAALPLRQWLPPLRGAFRRRRRSPRPRGTKRPPKSLGVENKNNQKKSRPWGSMXLGDPLLNYTLPGKNQGKWLRLTPPRGNTPQKTTPLPPKNLGKKPVPWARPGLQAPPQKQKVRPKYSLYKGGRAPF

SEQ ID NO: 71109 - DNA, 684 bp, Zea mays
  misc_feature: Ceres CLONE 1552119
  misc_feature: Encodes the peptide sequence at SEQ ID NO. 71110
  misc_feature (684)..(684): n is a, c, t, g, unknown, or other
ctccccgcggtggcggccgctctagaactagtggatcccccgggctgcaggaattcgtctcacccctagaaaaacctttttctccaattcaattcctcttcgtcgcctcgcgcatgggcattcctcgtgcgccgcggcagcgcagttaacgccagcgcgcgtggcttcacccggtcttgccacgacccgttgcaatcctgattcccttcctctccagaattcctcctcccatgtgcgtggatctcggagcccgtgcgggctagggtttatggctttggtcaatccatggcgtgcggtggcgaggtcgcgctgtcgcttcttctttaatgcgcgctgatccccatggacgccgagtccccacgggacgcttatggtttcgcggtgcggccacagcatctgcagcgtttccgcgagtacgccaagatttacaaggaagaggaggaggagagggcgcacagatggagagacttcttggacaggttggctgatgcagcgaatgtgcccaccacacccagcgtttcaccatatgcagctactggggatcctgcgtcaggtgcaggacaggcacaagagaatagcggcatcggaatacactgtgatgatgaaagaggagggatccgagaatgcagaacataacaacttggaaagcccaaaggaagccgatgccagtgctgaatcacgagn

SEQ ID NO: 71110 - protein, 97 aa, Zea mays
  misc_feature: Ceres CLONE 1552119
MDAESPRDAYGFAVRPQHLQRFREYAKIYKEEEEERAHRWRDFLDRLADAANVPTTPSVSPYAATGDPASGAGQAQENSGIGIHCDDERGGIRECRT

SEQ ID NO: 71111 - DNA, 675 bp, Zea mays
  misc_feature: Ceres CLONE 1552121
  misc_feature: Encodes the peptide sequence at SEQ ID NO. 71112
  misc_feature (675)..(675): n is a, c, t, g, unknown, or other
agctccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccacctgggccaagaggtgcagatcgcgcaaccgccgcccaacagcaaactcaagaaaagggggctcccccaacaaaaggtcccgcccccccccgaatcccaaatccaagaaaaaccctcagggccccggtgccaaaggcgggaaagcccccaaagaaaggggtcaagggcccaaaaaaacaaacctgccacn

SEQ ID NO: 71112 - protein, 172 aa, Zea mays
  misc_feature: Ceres CLONE 1552121
  misc_feature: SWISSPROT Homolog: EC 4.1.1.31 Phosphoenolpyruvate carboxylase
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLATWAKRCRSRNRRPTANSRKGGSPNKRSRPPPNPKSKKNPQGPGAKGGKAPKERGQGPKKTNLP

SEQ ID NO: 71113 - DNA, 712 bp, Zea mays
  misc_feature: Ceres CLONE 1552122
  misc_feature: Encodes the peptide sequence at SEQ ID NO. 71114
  misc_feature (277)..(277): n is a, c, t, g, unknown, or other
  misc_feature (356)..(356): n is a, c, t, g, unknown, or other
  misc_feature (357)..(357): n is a, c, t, g, unknown, or other
caaagctggagctccccgcggtggcggccgctctagaactagtggatcccccgggctgcaggaattcgtctcacccctagaaaaatagagctagcaactagctcacttgatatacatatacacaggccggcatattgcatcggcataaaaactgaatttaccatggcccacctgatctcttctgcaatcgcaggcgcgggcaacttggtcgctgatggaatcagtggtgtcactggcgtagcgtcgcaggttgtagaaagcgtagaagacactttangcagtatcgtagaagcaatcgaccaaggagtcaaggatgaagaccaactggacttgcccaagtacgtgtgtttcaaggnnagatacgtctgtacctttagtgctcgaaagtgaaaagcatccctacctgcaatttgcatcgggagatatgccaaccccaagtgtgaggttcatcacctaccaccacaggtgaaacgcaaacgggtggtgcgcttcaagtccaacatctcggcaagttctggcaacaacccctaactggatttgggccaacccgacaaacccggactaaacactccaaacccttgtcgagctcatcagatacgggaagaaggggtggacccccttcggaacctcggaaaaaaatattttggcaccgggttgactaaaaaggaaaggagaactccctaaaccccttatccccacccttcggaaaggg

SEQ ID NO: 71114 - protein, 75 aa, Zea mays
  misc_feature: Ceres CLONE 1552122
  misc_feature (39)..(39): Xaa is any aa, unknown, or other
  misc_feature (65)..(65): Xaa is any aa, unknown, or other
MAHLISSAIAGAGNLVADGISGVTGVASQVVESVEDTLXSIVEAIDQGVKDEDQLDLPKYVCFKXRYVCTFSARK

SEQ ID NO: 71115 - DNA, 677 bp, Zea mays
  misc_feature: Ceres CLONE 1552125
  misc_feature: Encodes the peptide sequence at SEQ ID NO. 71116
aaagctggagctccccgcggtggcggccgctctagaactagtggatcccccgggctgcaggaattcgtctcacccctagaaaaacttctgcttctgcgcatcctccaaggatcgtgatggccatggccacgcaagcctccgctgccacgcgccacctggtggccgcctccgcctgggcgccgtcggcgaagccgcggcagccgagctcacagctcgcgctgctgccgtcgtcctcccgcgcgccggccccgctccgcgcgaccgccggggaggcggtgaccgaggaggcgcccaaggggttcgtggccccgcagctggaccccagcacgccgtccccgatcttcgggggcagcacgggcgggctgctccgcaaggcgcatgtggaggagttctacgtcatcacgtgggtgtcccccaaggagcaggtgtacgagatgcccaccggaggcgccgccatcatgcgggaggggcccaacctcctgaagctggcacgcaaggagcattgcctcgcgctcggcaccaggctgcgctccaagtaccggatcaccctacagttctaccgcgtcttgccccaaagggggaaggggggccggccccccccccccccccaggggaggggggggggttttcccccaaaaaaaaaagagaaaaaaccccccccccccgccggggggggg

SEQ ID NO: 71116 - protein, 187 aa, Zea mays
  misc_feature: Ceres CLONE 1552125
  misc_feature (65)..(187): Pfam Name: PsaD Pfam Description: PsaD
MAMATQASAATRHLVAASAWAPSAKPRQPSSQLALLPSSSRAPAPLRATAGEAVTEEAPKGFVAPQLDPSTPSPIFGGSTGGLLRKAHVEEFYVITWVSPKEQVYEMPTGGAAIMREGPNLLKLARKEHCLALGTRLRSKYRITLQFYRVLPQRGKGGRPPPPPQGRGGGFPPKKKEKKPPPPAGGG

SEQ ID NO: 71117 - DNA, 651 bp, Zea mays
  misc_feature: Ceres CLONE 1552129
  misc_feature: Encodes the peptide sequence at SEQ ID NO. 71118
  misc_feature (140)..(140): n is a, c, t, g, unknown, or other
  misc_feature (153)..(153): n is a, c, t, g, unknown, or other
  misc_feature (154)..(154): n is a, c, t, g, unknown, or other
  misc_feature (454)..(454): n is a, c, t, g, unknown, or other
aaagctggagctcaccgcggtggcggccgctctagaactagtggatcccccgggctgcaggaattcgtctcacccctagaaaaaaaagattccgttctcccagtcgcctctcccagtcccagatctcgttcactcgcacntcgcgcaaccccnngcggccccgcgcctaatgggcatcctgtggcgccggcgacgccgcgtcagcgcagccgagggccagtatctcgcacgtcatcttcgatatggacggccttctcctcgacacggagggcttctacacggaggtgcaggagaagatcctagcgaggtacgacaaggtgttcgactggtcgctcaaggccaagatgatgggcaagaaggcggccgagtctgcccgcatcttcgtcgacgagtgcggccctcacggcctcctcacccccgagcagttcctcgaggagcgcgagagcatgctccnagcgctcttccccatcctgtacaagctgccaggagtactaacgttggtgcatcatcttcatgcccacggagtacccatggctgtggcgaacggatcccataaacgccatttttgcctgaagaccccgaatcccccgggaaagggtttccctggatgcatcccggttgtccggggggaatgacccaaaagggaaaggg

SEQ ID NO: 71118 - protein, 130 aa, Zea mays
  misc_feature: Ceres CLONE 1552129
  misc_feature (71)..(71): Xaa is any aa, unknown, or other
MDGLLLDTEGFYTEVQEKILARYDKVFDWSLKAKMMGKKAAESARIFVDECGPHGLLTPEQFLEERESMLXALFPILYKLPGVLTLVHHLHAHGVPMAVANGSHKRHFCLKTPNPPGKGFPGCIPVVRGE

SEQ ID NO: 71119 - DNA, 657 bp, Zea mays
  misc_feature: Ceres CLONE 1552131
  misc_feature: Translation starting site: 197
  misc_feature: SWISSPROT Homolog: EC 4.3.1.5 Phenylalanine ammonia-lyase
  misc_feature (421)..(421): n is a, c, t, g, unknown, or other
ctccccgcggtggcggccgctctagaactagtggatcccccgggctgcaggaattcgtctcacccctagaaaaaaagaagagcacgcccactcctctccggctcctcttcttctccaccacaccacaggcaccggcaccggcaccgcctcctccctccctcctgccaccgcgcggcaccccagccacagcacagcaatggcgggcaacggcgccatcgtggagagcgacccgctgaactggggcgcggcggcggcggagctggcggggagccacctggacgaggtgaagcgcatgggtggcgcaggcccggcagccggtggtgaagatcgagggctccacgctccgcgtcggccaggtggccgccgtcgcgtccgccagggacgcgtcccgcgtcgccgtcgagctcgacgaggaggcccngccccgcgtcaaggcagcagcgagtggatcctcgactgcatcgcccacggcggcgacatctacggcgtcacaccgggcttccgcgggacctcccaacggcgcaacaaggacgggcccgcccttgcagtcaagctgctcaggcttctcaccgccgaaatcttcggcaccgggaagcaatagcccaacccttgccttccgaagtcaccccggcgggcaattctgggggcccacaaaac

SEQ ID NO: 71120 - DNA, 664 bp, Zea mays
  misc_feature: Ceres CLONE 1552135
  misc_feature: Translation starting site: 241
  misc_feature: SWISSPROT Homolog: EC 1.3.3.9 Secologanin synthase
  misc_feature (389)..(389): n is a, c, t, g, unknown, or other
  misc_feature (393)..(393): n is a, c, t, g, unknown, or other
  misc_feature (491)..(491): n is a, c, t, g, unknown, or other
tccccgcggtggcggccgctctagaactagtggatcccccgggctgcaggaattcgtctcacccctagaaaaagtactccccccacctcgatcggccgtggcgtaggcgcaggcgcgtctagtagtaggtgaaacaacattgcgctccccgtcagcctgcagaaagcaatccagttcgtctcgctgcctagcctgcacgcacaccggccaccgcgcgccacggtctgccagccgaccaccatggcgtccagcggcgaggcagcactgctgggcggctccgtcggcgacgcgcgggcgccgccgctcccgtggaagctgctggcgctgctctgcgcggcgctcgcggtcgcgtggtgcgccgtgctcgcgctggagtgagcgtggtggcngccncagcgcctggcgcgggcgctgcggtcgcagggcctctgcggcacgtcgtaccgctccctcgcgggcgacgcggcgctgacggaggagctgaaccgggnagccaggtcccggcccctgccgctggcctgccacgacgtcgcgcccagggcgatgcccttgttcaccagaccatgaaggagcccggcaagacctcaatcacctggttcgggccggtgccaagggtgaccatccccaaccctgaactgtggcccgaggtgcttcccacaagttc

SEQ ID NO: 71121 - DNA, 677 bp, Zea mays
  misc_feature: Ceres CLONE 1552136
  misc_feature: Encodes the peptide sequence at SEQ ID NO. 71122
  misc_feature (385)..(385): n is a, c, t, g, unknown, or other
  misc_feature (386)..(386): n is a, c, t, g, unknown, or other
  misc_feature (503)..(503): n is a, c, t, g, unknown, or other
  misc_feature (518)..(518): n is a, c, t, g, unknown, or other
  misc_feature (523)..(523): n is a, c, t, g, unknown, or other
  misc_feature (548)..(548): n is a, c, t, g, unknown, or other
  misc_feature (587)..(587): n is a, c, t, g, unknown, or other
aatgctggagctccccgcggtggcggccgctctagaactagtggatcccccgggctgcaggaattcgtctcacccctagaaaaaggtaagccaaccgaaaccgatggcgtcgggctccggcagcgggagcgacttctccgtggtcgtggtgggatccgacttcgcggtcgacgccggcgccgcgctcctcgcccccgccgaccacgaggtgtggcacgactgcctccccgtcctcgctgaggcggacgcctgcttctccgacctcgaggagcgccaggtcgtgcgcatccagggcacggatagggcaggccgaaccatcgtccgcgtcgtcggcaagtttttccccgctcccagtattgatgggtgacgtctgaagaagtatgtnngtctacaactgcgcaccggattgccctgtgggtccattctgcattttgtacatccacagcaccgtacagtctgatgataacacccctggaaggtcgatcttgagggacatttatgangagcttccacctgantacanggaaaggcttcaagttttctacttnctgcatcctgggcttcgctccagactggcatggccaccnttggcagctattttaagtggaggtttgtattggaaatcaggtatatagtcgactggagtatctctgggggatataaaaaagagaggtgaa

SEQ ID NO: 71122 - protein, 87 aa, Zea mays
  misc_feature: Ceres CLONE 1552136
MASGSGSGSDFSVVVVGSDFAVDAGAALLAPADHEVWHDCLPVLAEADACFSDLEERQVVRIQGTDRAGRTIVRVVGKFFPAPSIDG

SEQ ID NO: 71123 - DNA, 719 bp, Zea mays
  misc_feature: Ceres CLONE 1552137
  misc_feature: Encodes the peptide sequence at SEQ ID NO. 71124
  misc_feature (488)..(488): n is a, c, t, g, unknown, or other
  misc_feature (491)..(491): n is a, c, t, g, unknown, or other
  misc_feature (492)..(492): n is a, c, t, g, unknown, or other
  misc_feature (617)..(617): n is a, c, t, g, unknown, or other
aaagctggagctccccgcggtggcggccgctctagaactagtggatcccccgggctgcaggaattcgtctcacccctagaaaaagtctctctaggttttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagccctcagattccctgggtaggctgttggtgtaaatctgcctgcgggatcagctcctgcggcagctgctcctgcggatgaggctgaggatgatgatgaccttgatctttttggtgatgaaactganganngacagaaggcagctgatgagcgtgccgccgctgccaggcctcttctaaaaagaaagaaagtgtaaatcctccgtcctatggatgtcaaaccttgggacgatgagactgatatgaaaaggctggangaagctgtcccccgtgtccagatggagggtctgaccttgggaacatcaaactttgtgcctgttgaaacggcatcaaaagatgacatcatggtgacattggcc

SEQ ID NO: 71124 - protein, 70 aa, Zea mays
  misc_feature: Ceres CLONE 1552137
MAVFSDLHTADGLKSLEAHLAGKTYVSGDSITKDDIKVFAAVPSKPGAEFPNAARWYETVSAAVALRFPG

SEQ ID NO: 71125 - DNA, 733 bp, Zea mays
  misc_feature: Ceres CLONE 1552139
  misc_feature: SWISSPROT Homolog: EC 2.7.11.1 Non-specific serine/threonine protein kinase
ctggagctcaccgcggtggcggccgctctagaactagtggatcccccgggctgcaggaattcgtctcacccctagaaaaaccgaaaggggtaggagagtgagcagccagagaacagggaggtagagaggaggaggaggtagaaggcgaaagaaggggaaccaaatcttggacgggaacacatagatttctttggtggaggaaggaggagggcaacaagaggaggttacaggtagcccaatagatctactgctgttgagggagttgatgcaaagctgagttgctgcgcgttggctttctttagagatggcttcagctggtgttgccccttctgggtacaagaacagcagcagcaccagcattggtgccgaaaagttgcaagatcacatgaacgagctaaagattagagatgataaggaagttgaagcaccccatattaatggggaaagggacccgaaactggcacataattgtcaccactactggtgggcaagaatggtcaccaaaaacagacagtgagctacatggctgaccgcattgtagggtcaaggtccttttgggatttggctccggccaagtgtttggaaaccggtgagaatgttgccataagaaagtcttcaaaaaaaggtttaaagacccggaactggaaacctggccccccctgacacccttaagtttttgctttgaacattgctttttttcaaactgaaagggggacttttcaaatttggccgt

SEQ ID NO: 71126 - DNA, 711 bp, Zea mays
  misc_feature: Ceres CLONE 1552140
  misc_feature: Encodes the peptide sequence at SEQ ID NO. 71127
  misc_feature (462)..(462): n is a, c, t, g, unknown, or other
  misc_feature (466)..(466): n is a, c, t, g, unknown, or other
  misc_feature (472)..(472): n is a, c, t, g, unknown, or other
  misc_feature (478)..(478): n is a, c, t, g, unknown, or other
  misc_feature (480)..(480): n is a, c, t, g, unknown, or other
  misc_feature (481)..(481): n is a, c, t, g, unknown, or other
  misc_feature (507)..(507): n is a, c, t, g, unknown, or other
aagctggagctcaccgcggtggcggccgctctagaactagtggatcccccgggctgcaggaattcgtctcacccctagaaacctagaaaaaatcgccttcgtggcctggcctgcccgtcgtgtgcggctctgcgcctctccctccctccctcccttccccgatcgtaaccgccgcctccgatcgatcgccacgatgcggctcttctgacgtaccgccgggcgtcaccgtcaccgaccgagacccgcgcccctcgcctggactccatggccgcgtcctccccgctggtgctgtcgctgctcctcttcgcgtcgctgacggcgctgctggtcctcgcgccgcgcctatccccgccgcagccgccggcggccgccggtggtggtggtggcaagaaggccgacgacctccgcctggtccgccgcgcggctctggagtcgtcggcggcggacgccctcccaggtggncttncctgtnctgacnannctcgactcacttcgcccctctctggnagcgcttcttcccgggaaacgaagcgcggctgcccgtgtacgtccacccggacccgtcccgggcgcctgctccttcacgcgtgcacgcagcagctaacttcaaggtggttggagggcaagccccaaatgggggtccggcttacccggcccccgggggggaaaagaagggctgtttccccggaaggggcgcaaaaaagcgggtcc

SEQ ID NO: 71127 - protein, 149 aa, Zea mays
  misc_feature: Ceres CLONE 1552140
  misc_feature (68)..(68): Xaa is any aa, unknown, or other
  misc_feature (70)..(70): Xaa is any aa, unknown, or other
  misc_feature (72)..(72): Xaa is any aa, unknown, or other
  misc_feature (73)..(73): Xaa is any aa, unknown, or other
MAASSPLVLSLLLFASLTALLVLAPRLSPPQPPAAAGGGGGKKADDLRLVRRAALESSAADALPGGLXCXDXXRLTSPLSGSASSRETKRGCPCTSTRTRPGRLLLHACTQQLTSRWLEGKPQMGVRLTRPPGGKRRAVSPEGAQKSGS

SEQ ID NO: 71128 - DNA, 729 bp, Zea mays
  misc_feature: Ceres CLONE 1552143
  misc_feature (360)..(360): n is a, c, t, g, unknown, or other
tggagctcaccgcggtggcggccgctctagaactagtggatcccccgggctgcaggaattcgtctcacccctagaaaaagccttctcttctctacctgccgcacccgcacagccacagccaaccacacaccccacatcacaacagctccctctgcatctccgcctcgtcgccgtcgtctgcctgcacaaccttcttcttcctcatctctctctctcttcttccgctgccaccctcccagcaccgagggaagggaagcccaggaatctccgtcccgctcccggccgccgtccttctcataacctcatcggatctgtattgggttttcagttaggagcagaaaacgcccttagggaatgcanaaacatgtgcttgcaggtggaagaacttactttgtgagggactttgccaggaaaagcccgccatactccttcattctttggccacctcttgatggacttccaaaccctcaaaagaccccgtttcctcccccccggggttttcccaaaatgggggtttgaacctggggggccccaaccgtttttttttaaataacccttccccgggggaaaacggttgaaaattttttcacccccctccggaaccctttgtgggggcccaaatttttttttaacggcggaaagggaaaaaaaaaggggaacccctctgggtggcacaaccccccccccccaatttttttgggatatacccgggggaccaaaagggggaaa

SEQ ID NO: 71129 - DNA, 722 bp, Zea mays
  misc_feature: Ceres CLONE 1552144
  misc_feature: Translation starting site: 548
  misc_feature (380)..(380): n is a, c, t, g, unknown, or other
  misc_feature (381)..(381): n is a, c, t, g, unknown, or other
  misc_feature (436)..(436): n is a, c, t, g, unknown, or other
  misc_feature (456)..(456): n is a, c, t, g, unknown, or other
aagctggagctccccgcggtggcggccgctctagaactagtggatcccccgggctgcaggaattcgtctcacccctagaaaaaaaacagaaacgaaagagcctccaaaacctcgcaacaaccccgtgacacccacacccatccgccctgcccctcctcgcgctccccaccaaccccgacgagcggcgatgaccggcacggtgtccaagctggcggcgccccggcctgcggcgccaccgctccggccggcgtccctccgcgccgccgcaatcgccttcgccccctccccgcgccgggtcagcgtctccgtcgccgggcgggccaggatcccctccgtcattgcgatggcttctgccaggaaggaaatggtgcaccgaccanngaaaccctcgctcacgatctctacgagctccaggccctctccccgtggtatgacnaccctctgccgactgtcacngacttgctgccccttatcgccagcggtggtcgtggaatccccaccacccctacatttttccagaaggcatctcattcctccaggcaaattgatgattagttcaagcagctcattccgggcggaaaggaaccgaaaaaccctttctgggaaacttgttttaaaggaatccccaaaaccgggcttctttttgacccttctcccaaaaaccaaaggggctaatagggtttcccccccgggagggccccccaggtgggaaataaacccaa

SEQ ID NO: 71130 - DNA, 754 bp, Zea mays
  misc_feature: Ceres CLONE 1552147
  misc_feature: Translation starting site: 135
  misc_feature (404)..(404): n is a, c, t, g, unknown, or other
  misc_feature (453)..(453): n is a, c, t, g, unknown, or other
  misc_feature (513)..(513): n is a, c, t, g, unknown, or other
aaagctggagctcaccgcggtggcggccgctctagaactagtggatcccccgggctgcaggaattcgtctcacccctagaaaaatcagccatcccctcccgcggcaagtctctctgaattgtgggtctccggcgatggcggctctagctccatccaagattctgggcaccaagctcaacttcgccggctcctcccgctacgccacggcagcgcccaccgcgggggctcagaagatcgtctccctcttcagcaagaagcctgcccagaagcccaagccctctgcggtgtcgtcctcttctccggacatcagcgacgagctcgccaagtggtacggtcctgacaggaggatctacctgccggatgggctcttggaccgctcggaggtaccggagtacctcaccggnagagtccctggagactatggctacgacccttttggcctgggcaagaagnccagaagactttcgccagtacccaggctacgagctgatccatgccagatggggcatgctncgtgccgctggcgctgtcatcccagaagcgtgcaaacagtccggcggctactgcggcccgaaggccgtcttggtcaaaaacggggcccctggctcctggaagggaaaacccctcagttatttcggaaaaagatccccattaaaactgggggcccccgtgatcccgagagggcccctcctctctgggggggcccaaatatttcccgaaatctccaggggattggccctcgggagaacaagcc

SEQ ID NO: 71131 - DNA, 671 bp, Zea mays
  misc_feature: Ceres CLONE 1552148
  misc_feature: Encodes the peptide sequence at SEQ ID NO. 71132
  misc_feature (344)..(344): n is a, c, t, g, unknown, or other
  misc_feature (362)..(362): n is a, c, t, g, unknown, or other
  misc_feature (391)..(391): n is a, c, t, g, unknown, or other
  misc_feature (617)..(617): n is a, c, t, g, unknown, or other
ctccccgcggtggcggccgctctagaactagtggatcccccgggctgcaggaattcgtctcacccctagaaaaaagcttgtcctcctcgtcgatttcccctgaccccccaccagtcgactcgccggaaccctaggtagcggcagatcctacgcgccgtgcacgcggccgcctccatggcgacgctcaaggatctcctaccggcgcccaagacgtcggcgtccaccttctacgaccacagcagcgacccctggttcaaggagcggtacggtggggagtcggcgcaggcggccgcggcgacgaggcccgcggcccgcgcccggcccgtgccctcgtacggaaagcngacggggttcgtgccccnacggccgggagacttcgggggatgcggcncctttcccgagatccacgtcgcgcagtacccgctcggcatgggacgccgtgatgataagggcggatccaagatccttgcgctcaccgtcgacgcacacggaagcgtcgccttcaacgccttcgttcaagcagggggagaacgcggcaaagatcgtctacctctaacatagcgaactcgtggcaaaaaaaagcccctgccgattccccaggcaacttccggaccacnacccagaaccaaaacccaatccggggaaaaccacttgaccgggaccaaggcccg

SEQ ID NO: 71132 - protein, 128 aa, Zea mays
  misc_feature: Ceres CLONE 1552148
  misc_feature (57)..(57): Xaa is any aa, unknown, or other
  misc_feature (63)..(63): Xaa is any aa, unknown, or other
  misc_feature (73)..(73): Xaa is any aa, unknown, or other
MATLKDLLPAPKTSASTFYDHSSDPWFKERYGGESAQAAAATRPAARARPVPSYGKXTGFVPXRPGDFGGCGXFPEIHVAQYPLGMGRRDDKGGSKILALTVDAHGSVAFNAFVQAGGERGKDRLPLT

SEQ ID NO: 71133 - DNA, 707 bp, Zea mays
  misc_feature: Ceres CLONE 1552149
  misc_feature (399)..(399): n is a, c, t, g, unknown, or other
  misc_feature (400)..(400): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
cccgctggagctccccgcggtggcggccgctctagaactagtggatcccccgggctgcaggaattcgtctcacccctagaaaaaatctttttcctcagcaaccgtgctcggttcctcctccctcgaaacggctcccacccccgcgccgcgataagaaaacccaccaaaccctaaccctagcagcggtgccacaaccgcccgcgttcccggccggagaggaagccgagccagcaaggatgccgcccgggtcggcgacgcaatttcggtacacgcagacgccgtccatagtgctgcatctttgggaacatgccatgggagggcccctagaaggagctcgtcgacctctgcaaacccttcggcggggtccccccccccgtgggggggggggggggggaaccnnaaccnnnctttcttccaactttgcaaattaaaaaccaggcaatttcaaggggggtcccattatggcctcaggcttcaaaaccctggtccaagttccggggaaaaactgggttatttccccattttccaaccggcgagaaaattccttaacagaggggggccctgggggtttcttctggggagtgtcctccctgtgcactttggaagggggttcaccccaaagtagggtgccccaaaagttgtttctggggggtttttcccaacttgggggtttgcccacaaaattccccatttttaaaaaacccgcg

SEQ ID NO: 71134 - DNA, 607 bp, Zea mays
  misc_feature: Ceres CLONE 1552152
  misc_feature: Encodes the peptide sequence at SEQ ID NO. 71135
  misc_feature (242)..(242): n is a, c, t, g, unknown, or other
  misc_feature (281)..(281): n is a, c, t, g, unknown, or other
  misc_feature (296)..(296): n is a, c, t, g, unknown, or other
  misc_feature (297)..(297): n is a, c, t, g, unknown, or other
  misc_feature (383)..(383): n is a, c, t, g, unknown, or other
  misc_feature (385)..(385): n is a, c, t, g, unknown, or other
  misc_feature (387)..(387): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (395)..(395): n is a, c, t, g, unknown, or other
  misc_feature (396)..(396): n is a, c, t, g, unknown, or other
  misc_feature (400)..(400): n is a, c, t, g, unknown, or other
  misc_feature (606)..(606): n is a, c, t, g, unknown, or other
atttgctggagctccccgcggtggcggccgctctagaactagtggatcccccgggctgcaggaattcgtctcacccctagaaaaatctcgccctcgctcacctacatctccgtccgcaagcgtcagccaggctgccccgggaggccgggaggaaacaaatcggagaaggtgatctgttgtaatggctcgattgtacatcggcaacctggatccccgggtgaccgctcgggagctggaggacnatttccgcacgttcggggtccttcccagggtctgggttncctcgtaaacccccnnggctttgcggtaattgattttgggattaaagacccaaaagatcattccggacctattttttcccccccccggagggaggagggggnantncnnnnntnntccnaaattttacccaaaaaaaaacttaaaccctggggggggggggggaaacccccctttttcctgaagcccctttaagaattgtttccaggactcaaagcaaaaagggcccaaacctattcctttctccacccccccccccaaatttgccgggccgacattgtttggaaagggttttttttttctgcccccccctctcccgctggcgang

SEQ ID NO: 71135 - protein, 35 aa, Zea mays
  misc_feature: Ceres CLONE 1552152
  misc_feature (21)..(21): Xaa is any aa, unknown, or other
  misc_feature (34)..(34): Xaa is any aa, unknown, or other
MARLYIGNLDPRVTARELEDXFRTFGVLPRVWVXS

SEQ ID NO: 71136 - DNA, 659 bp, Zea mays
  misc_feature: Ceres CLONE 1552153
  misc_feature: Encodes the peptide sequence at SEQ ID NO. 71137
  misc_feature (402)..(402): n is a, c, t, g, unknown, or other
  misc_feature (403)..(403): n is a, c, t, g, unknown, or other
  misc_feature (407)..(407): n is a, c, t, g, unknown, or other
  misc_feature (409)..(409): n is a, c, t, g, unknown, or other
  misc_feature (482)..(482): n is a, c, t, g, unknown, or other
ctccccgcggtggcggccgctctagaactagtggatcccccgggctgcaggaattcgtctcacccctagaaaaaggtgagccgcctctctcgagcgcctaccactctgccccctgcgccgcctgcggcctcccccctctccctctccccctctccctgcgcctcccaggtcgccgccgcgcgtgaagacggctcgctcgagctctggctcgtctccccgggctccgtcggctggcacaaccagctcactatacaaggcaacgccgcgtcgagggtcacatcactggtgtgggggcggaaaggtggagtgaccggccggctgctctcgtccagcattgatgggtcggtgtccgaatgggatctctttcacctgcagcaaaagactgttctagatactggtggnnagtncnatctgggcaaatggcatcgaaacctttggatgatgctaaaaatactgaaaataatagctcagagtttgctgtncatgggccatacaaaccaaaatgactccagcgattctgactttagtaacattgatgagggtgacacctctgaggatggagaaggggtctaccaacccaagaccttcaatatcaggggaatgattttccagcaattggcccttggcagggaaaggaaggtccccgaaaaattggttaa

SEQ ID NO: 71137 - protein, 73 aa, Zea mays
  misc_feature: Ceres CLONE 1552153
  misc_feature (15)..(15): Xaa is any aa, unknown, or other
MMLKILKIIAQSLLXMGHTNQNDSSDSDFSNIDEGDTSEDGEGVYQPKTFNIRGMIFQQLALGRERKVPEKLV

SEQ ID NO: 71138 - DNA, 717 bp, Zea mays
  misc_feature: Ceres CLONE 1552156
  misc_feature: Encodes the peptide sequence at SEQ ID NO. 71139
  misc_feature (558)..(558): n is a, c, t, g, unknown, or other
tcccccgggctgcaggaattcgtctcacccctagaaaaaccctcctcctatggcacgttctgcaggaccacctccccctccccctacctgtttctctggtagatgagcgctccgaagcttcatcggtctccggtggtccgccccccgtttccaggttatggagcgagctggtgagtccgtacccgttgttcatggcaagcccgggatactacttcagactcggagtaacctacttttaatgtttgtcaatgtcgacaaaaaacctagttgtcaataataaatgaacatgctcccaaaatgcctgaccctctcccctcgaattatctttcatcaaaaatatcagacccccacccccattgttcgtttttccgctaggtggtttgggtgagtttaaaacgcgcgtctccgttaacgcaaaaacccacacacagtgttccctacaaaggtgttcgcgtcctctcggggggcaatgaccgctgtttcttctcactccccctgtggcgtccccttttgcctcttcacaaaaaatagcctgggtcgcctctcgctctgtggctntcttctcttattgcgaaacactaccttgtgtctctacttggtcgttcttctcctttatttcctaggtgtcgcacgatgatttgccagtaccgttctcacctacgaccactacacgctcactccagtagagaaaacaactcacaccacactccgagctcc

SEQ ID NO: 71139 - protein, 39 aa, Zea mays
  misc_feature: Ceres CLONE 1552156
MERAGESVPVVHGKPGILLQTRSNLLLMFVNVDKKPSCQ

SEQ ID NO: 71140 - DNA, 696 bp, Zea mays
  misc_feature: Ceres CLONE 1552157
  misc_feature: Encodes the peptide sequence at SEQ ID NO. 71141
  misc_feature (412)..(412): n is a, c, t, g, unknown, or other
  misc_feature (464)..(464): n is a, c, t, g, unknown, or other
aaagctggagctccccgcggtggcggccgctctagaactagtggatcccccgggctgcaggaattcgtctcacccctagaaaaaccagaagctcactcactgctcgttgccggctgcccccgcggccccggccagtccatcccctcgctcgctccccaactccagcaggcagatcagatacatccatccattcgcggaccggaaggaaaggaagggttgaactatgagcgccgtggcggtttcgtcgtcgctgaacccggacgcgccgctcttcatcccggcggcgctgctgcaggtggaggacttctcgccgcagtggtgggacctcatcaccaccactgcctgggtccgcgaccactggtcccgcgagcgcgcccacctggacgagatggccgagcagatcgacgcgccnggcctcctccccgacgacgaggacctcttctacgacgacagctcgagagggnccccgtcgccgccgccctaagaccgattcggtgctcaggcgctgacatgacctccccgaaggcggcgcaacgccccgcgggggtccggggaaaccccggaccgccaagaagcgaccaatacgccggccgcccaaagcaacgtcccccgtgaaccaccaccccctaagtgtcctgggggaccttccggaggtggggccccctttgaccttgtcccgggttcccccctttttgg

SEQ ID NO: 71141 - protein, 86 aa, Zea mays
  misc_feature: Ceres CLONE 1552157
  misc_feature (81)..(81): Xaa is any aa, unknown, or other
MSAVAVSSSLNPDAPLFIPAALLQVEDFSPQWWDLITTTAWVRDHWSRERAHLDEMAEQIDAPGLLPDDEDLFYDDSSRGXPSPPP

SEQ ID NO: 71142 - DNA, 657 bp, Zea mays
  misc_feature: Ceres CLONE 1552158
  misc_feature: Translation starting site: 201
ctccccgcggtggcggccgctctagaactagtggatcccccgggctgcaggaattcgtctcacccctagaaaaatcgtcctcttcccattccactctctcactctctctaatcacaatttcgacactgatcggtactctctagtgtccgactcgtcacagttttagcgagagagacagagagcgagcgagggagaggaggatgggttccacttccacgggaccggtgagcgggttcgcggcgccggagcgggacatcgacgatctgccgcggaacgacgccaactacacggcgctcactccgctctggttcctcgagcgcgcggcgctggcgcatccgggcagggcctccgtcgtgcacggccccgtgcgctacacctgtggctgacacctatcgccgctgccgtcgcctcgcatcagcccctcgcgcgcctatcagtcggccacggaagcactggtgctgtgatagctcctaatgtcccggctgtctatgaagctcacttcggtgtccccatgtcaggagcctgtgtgaactgcgtcaatatccggctaaacgccgagacaatagcattcctctttgaacactccgttggcagaaattgtgatggtggaccaaaaaattcggccccctagccagaggaatcgctgaaaaataattg

SEQ ID NO: 71143 - DNA, 710 bp, Zea mays
  misc_feature: Ceres CLONE 1552159
  misc_feature: Encodes the peptide sequence at SEQ ID NO. 71144
  misc_feature (1)..(1): n is a, c, t, g, unknown, or other
  misc_feature (68)..(68): n is a, c, t, g, unknown, or other
  misc_feature (81)..(81): n is a, c, t, g, unknown, or other
  misc_feature (190)..(190): n is a, c, t, g, unknown, or other
  misc_feature (202)..(202): n is a, c, t, g, unknown, or other
  misc_feature (205)..(205): n is a, c, t, g, unknown, or other
  misc_feature (208)..(208): n is a, c, t, g, unknown, or other
  misc_feature (246)..(246): n is a, c, t, g, unknown, or other
  misc_feature (311)..(311): n is a, c, t, g, unknown, or other
  misc_feature (312)..(312): n is a, c, t, g, unknown, or other
  misc_feature (319)..(319): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (402)..(402): n is a, c, t, g, unknown, or other
  misc_feature (404)..(404): n is a, c, t, g, unknown, or other
  misc_feature (405)..(405): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (415)..(415): n is a, c, t, g, unknown, or other
  misc_feature (416)..(416): n is a, c, t, g, unknown, or other
  misc_feature (418)..(418): n is a, c, t, g, unknown, or other
  misc_feature (423)..(423): n is a, c, t, g, unknown, or other
  misc_feature (425)..(425): n is a, c, t, g, unknown, or other
  misc_feature (446)..(446): n is a, c, t, g, unknown, or other
  misc_feature (604)..(604): n is a, c, t, g, unknown, or other
  misc_feature (642)..(642): n is a, c, t, g, unknown, or other
nacgcgctggagctccccgcggtggcggccgctctagactagtggatcccccgggctgcaggaattcntctcacccctagnaaaagttcatgactctctattagaatagccaggggcctcgctcctctccaccacgtactccactccatccatccatcatcgtctatccatgaggagcttgcaggagganagggcggctttngtnccntccccgtggccccacaacagagaaagggacggcgcaancatgatccggagcagctgatggatgaggatgacggtgactttgacgcgggaggggggggagagcnncccccantatttttttggacgtcgacaaagaaggggggagtatttttttttttcccaccccccggggggggaagatagggggatnnntnntnntnnnnnttanntnttttncncaaaaaaaaaaaaaaaaaaanataattattggggggggggggggggggggtttgttattttgggtttgggggggggggggaagaaacacggcggcgtgcccaggaaaacaccccaaacaaacgcggggaatatccagcgcgaagaggcggcgggccgcggcgcgggcggagagtggcancatagggggggccgatagacgcgttccccgccgctgtngggggtggccgtggggaggggccgcgtgggcgggcgcggcggaccactccacacggatcggcgcgggg

SEQ ID NO: 71144 - protein, 31 aa, Zea mays
  misc_feature: Ceres CLONE 1552159
  misc_feature (7)..(7): Xaa is any aa, unknown, or other
  misc_feature (11)..(11): Xaa is any aa, unknown, or other
  misc_feature (26)..(26): Xaa is any aa, unknown, or other
MRSLQEXRAAXVPSPWPHNRERDGAXMIRSS

SEQ ID NO: 71145 - DNA, 665 bp, Zea mays
  misc_feature: Ceres CLONE 1552161
  misc_feature: Encodes the peptide sequence at SEQ ID NO. 71146
cgcggtggcggccgctctagaactagtggatcccccgggctgcaggaattcgtctcacccctagaaaaactccttattgccgccgctgccctgctccaaccccccgcctcctctttcctcgcaagaccacgtcctcatccactacatccaccagctagacgagcaagaagccgccaccatggtccgcaagcgccccgcgcccgacatggacctcccgccgccgcgccgtcacgtcacgggcgacctctccgacgttacggccgcagccgccgccgctggtggtcctggcgcgccgtcctccgctagcgcgcagctacccgcgctgcccacccagctccaccagctgccccccgcgttccagcaccacgcggcggaagtggacgtgcccccgcaaccgcacccgccggcccattcgcaggcgggcggcgaggcgcccgcgtccacgaccgcgtgggtggacggcatcatccgcgacatcatcgggagcagcggcggccgcgctgtctccatcacgcagctcatccaaaggtcctcattttccttctctgcctttcttccctggtcaatcttgatggcatcatgaccacttttcagctgctaaccctccgatgacttggggaaatgtgagctttacggcaagcatcaagttcgggggaagacatccg

SEQ ID NO: 71146 - protein, 134 aa, Zea mays
  misc_feature: Ceres CLONE 1552161
MVRKRPAPDMDLPPPRRHVTGDLSDVTAAAAAAGGPGAPSSASAQLPALPTQLHQLPPAFQHHAAEVDVPPQPHPPAHSQAGGEAPASTTAWVDGIIRDIIGSSGGRAVSITQLIQRSSFSFSAFLPWSILMAS

SEQ ID NO: 71147 - DNA, 711 bp, Zea mays
  misc_feature: Ceres CLONE 1552164
  misc_feature: Translation starting site: 241
  misc_feature (439)..(439): n is a, c, t, g, unknown, or other
  misc_feature (508)..(508): n is a, c, t, g, unknown, or other
aaagctggagctccccgcggtggcggccgctctagaactagtggatcccccgggctgcaggaattcgtctcacccctagaaaaatcgcttcagctcggcgtcttcacaaacgccggcgcaaactctcgcccgagcccgacagatcttcaattccccattccgcccaccgatcgaccttcacgccagtctcggtctcttccaaaagcgtcgcgcgcggttgtttgagaggagaggaggaagatgagggagtgcatctccgtccacatcgggcaagccggcatccaagtcggcaacgcgtgctgggaactttactgcctcgagcacggcatccagcctgatggccaagtgcctgcagataagaccgcgcgacatcacgatgatgccttcagcgacttacttcatcagactggtgctggggagcatcgtccccgtgcgatcntcgatgatctagacccactgtgatcgatgaggtgcgatctggcacgaacgtcggcttctgtcaccctgnacaggttatcagtggcaagcgagaatgcccctaacattcccaccgtgccaataacccattggcaagggaaattgttattttggcctttgaccctttccccaaatttgggaaaactgtccccgcccccgggggttcccgggctaaaaagcccaaggggggggaccggcccaagaaatttttctctccccctttaaaaccccgga

SEQ ID NO: 71148 - DNA, 660 bp, Zea mays
  misc_feature: Ceres CLONE 1552170
  misc_feature: Encodes the peptide sequence at SEQ ID NO. 71149
ctccccgcggtggcggccgctctagaactagtggatcccccgggctgcaggaattcgtctcacccctagaaaaaacattagctgacgatgtgaacttggaagagtttgttatgaccaaagatgagttctcgggcgctgatattaaggccatctgcacggaggctggattgctcgccttaagagaacgtagaatgaaggtgacccatgcagatttcaagaaagcaaaggagaaggtgatgtacaagaagaaggaaggtgttccggatggtctctacatgtagtagacgtctcctgccttgtcagaacaagttatcctcgtctctctcgtcatgggagatttgattgccacggcacttgttgcacacctataagtggtctgagaacgtgtattatgctttgattgtttcaagtataatttctctttggagaaaaaaaaaaaaaatgccgcccactacagccccggccgctgccgcggcgctcccatcaccttctcaccgcaggctccccgccgcgaaatccgtctggctgaaccccaacctcccctcttctcaccccctccaccagcgccacaagtccgccgccgagctccaacaacggcagcacgatgaccgtacgatcgacgtcccgggccctcgtcaccgcgctcttgggcggcgcgaa

SEQ ID NO: 71149 - protein, 92 aa, Zea mays
  misc_feature: Ceres CLONE 1552170
  misc_feature: SWISSPROT Homolog: EC 3.6.4.3 Microtubule-severing ATPase
PRGGGRSRTSGSPGLQEFVSPLEKTLADDVNLEEFVMTKDEFSGADIKAICTEAGLLALRERRMKVTHADFKKAKEKVMYKKKEGVPDGLYM

SEQ ID NO: 71150 - DNA, 717 bp, Zea mays
  misc_feature: Ceres CLONE 1552174
  misc_feature: Encodes the peptide sequence at SEQ ID NO. 71151
aaagctggagctccccgcggtggcggccgctctagaactagtggatcccccgggctgcaggaattcgtctcacccctagaaaaaatctgtgtgtctcttccacgagaggcaacctgaccgtatagtactgccgacatggtgctgtccggcggattagttttgtcgtggctcgaggcggccgtggcggtggtcctcctagtgatcaccgccgattcggtcggctcccatgcctacaagaactacaccgtctgggatgacaaggtgtggtacgaccgcctcattcagcccggggtcgactaccaggcgtgcgttgacagcgagaacttcagcctcggggatttcctcatcttcaatactgacaagaactactcgctggtgcagacgcggaacgtgacactgtaagagagctgcgactacaccaactcggggcccgacgacaccgttgagtgtgccgccgcgcctccggagttcagacaggacgccgtcactgtcgccgtgccgctcctctacgagggctgcgcatacttcttctcgagcaactacaaccgcgagcactgctagagcggacagcgtctcgccgtcaacgtgtcccactagcaggatctgccgactgacgtcaggccgcccgtcgcagacgctccggcgttctgctccgcggggcccgacgaacgggacgccgctctcgacttcgacacctcaagacgtctcacgaccagg

SEQ ID NO: 71151 - protein, 88 aa, Zea mays
  misc_feature: Ceres CLONE 1552174
MVLSGGLVLSWLEAAVAVVLLVITADSVGSHAYKNYTVWDDKVWYDRLIQPGVDYQACVDSENFSLGDFLIFNTDKNYSLVQTRNVTL

SEQ ID NO: 71152 - DNA, 694 bp, Zea mays
  misc_feature: Ceres CLONE 1552175
  misc_feature: Encodes the peptide sequence at SEQ ID NO. 71153
  misc_feature (487)..(487): n is a, c, t, g, unknown, or other
  misc_feature (502)..(502): n is a, c, t, g, unknown, or other
  misc_feature (513)..(513): n is a, c, t, g, unknown, or other
  misc_feature (514)..(514): n is a, c, t, g, unknown, or other
  misc_feature (529)..(529): n is a, c, t, g, unknown, or other
  misc_feature (576)..(576): n is a, c, t, g, unknown, or other
aaagctggagctcaccgcggtggcggccgctctagaactagtggatcccccgggctgcaggaattcgtctcacccctagaaaaagcgccgcctgcgtccaccctccgctcgccgctctccccgcgtatccctctcatacgcagctcgcccaggtaagatgtcgtccgtggcgtcgaaggtggcggtgccggagtctgtgctccgcaagcggaagcgcgaggaacagtgggccaccgagaagaaggagaaggccctagtcgagaagaagaagtccatcgagagccgcaagctcatcttcacccgcgcaaagcagtacgccgaggaatacgatgcccaggagaaggaactggtgcagcttaagcgtgaggcccgtttgaagggtggtttctatgtcagtcctgaagcaagctgctctttgtggtccgcatcccgggtattaacgccatgcaccctaagaccagaagatcttgcagcttctgcgattgangcaatctttcatggntgtgtcctcannagtcacaggcgactnatacatgctacgcagggttgaagcatatgttgcatatgggtaccaanctttgagagtgtcagggagtgatcctacagaagggctatggaagctgaacagcaaaggatccctctgtccaacaccagtctccaggaaggctgggcaacccaactctctgctttgagg

SEQ ID NO: 71153 - protein, 130 aa, Zea mays
  misc_feature: Ceres CLONE 1552175
  misc_feature (13)..(83): Pfam Name: Ribosomal_L30_N Pfam Description: Ribosomal L30 N-terminal domain
  misc_feature (110)..(110): Xaa is any aa, unknown, or other
  misc_feature (119)..(119): Xaa is any aa, unknown, or other
MSSVASKVAVPESVLRKRKREEQWATEKKEKALVEKKKSIESRKLIFTRAKQYAEEYDAQEKELVQLKREARLKGGFYVSPEASCSLWSASRVLTPCTLRPEDLAASAIXAIFHGCVLXSHRRLIHATQG

SEQ ID NO: 71154 - DNA, 722 bp, Zea mays
  misc_feature: Ceres CLONE 1552176
  misc_feature (712)..(712): n is a, c, t, g, unknown, or other
aaagctggagctccccgcggtggcggccgctctagaactagtggatcccccgggctgcaggaattcgtctcacccctagaaaaaggttggtttctttctctcctctcttctcttctctcctctccccgtggccacaccacagccgccggaagctcctcctcctcttctccatgagagagatctagcaaagcatagcctccttcctgctggcgggatctccttttgattcgtaacttataacagaagaggaggaggcacagcaccttgtcaaatgatgaactctcagaagctgcagctgcccgttcaggatctgatgagtctgagagggagatcattcatcatcagcaaggtgatgatgcaccagtgcactgcagctgcttcgtcgtcgtcttcacctgctcctgctgctagaggcctgcaggttgctgcccatcccagtcccagcaggaggcggcgtcctcgtggcctcgttgccgcggccggcagtgacgacgacgaatgcgcttcagatggtggtgagtccgagtcgtcgtcgtcgggcgggaaaacgacggcggcggcggcttgtcccgagaggatctggaacgcctggtcgggagtgacgaagatgccaagttcaatgggttggatcttgcaaacctcatcaggaagaagtacggtagatcgtacgatgtgacgctgataaagaaagagtcatggggaggaatctgcntggcatgaat

SEQ ID NO: 71155 - DNA, 652 bp, Zea mays
  misc_feature: Ceres CLONE 1552177
  misc_feature: Encodes the peptide sequence at SEQ ID NO. 71156
  misc_feature (400)..(400): n is a, c, t, g, unknown, or other
  misc_feature (401)..(401): n is a, c, t, g, unknown, or other
ctggagctccccgcggtggcggccgctctagaactagtggatcccccgggctgcaggaattcgtctcacccctagaaaaagggcagctcagctcagccagccgcacaagccccaaacagaaagagactcacccaccgcgccacgcaacagcccatctccgctctgctctctcgcccaccccgattcccccccatggctatggcgacgacggaggccaccacgctgacggcgctgctcaaggaggcggcggccgccttcccgacccgccgcgcagttgccgtaccgggcaggctggagctcacgcacgccgccctcgacgctctcgtcgacgcggcggccgcacgactcgcccgcgacgccggagttctcccggggcacgtcgtcgcgcttttcctccccnnacacgtcgagctggtgatcatgttcctggcggaatccgcgcgcgcggcgttgcggggccgctcaccccgcctacaagcaggaggaggtcaagtctacctctccaactcgaaggggccctccttgtcacaacgcggagggaaaccgggggggccagggggccccttgcaaatttgggttggcccaaggcggccccagagcttcaaaaaaggggccgggcctgttaacccttggggggcctcccgggccaatg

SEQ ID NO: 71156 - protein, 153 aa, Zea mays
  misc_feature: Ceres CLONE 1552177
  misc_feature (70)..(70): Xaa is any aa, unknown, or other
MAMATTEATTLTALLKEAAAAFPTRRAVAVPGRLELTHAALDALVDAAAARLARDAGVLPGHVVALFLPXHVELVIMFLAESARAALRGRSPRLQAGGGQVYLSNSKGPSLSQRGGKPGGPGGPLQIWVGPRRPQSFKKGAGPVNPWGASRAN

SEQ ID NO: 71157 - DNA, 631 bp, Zea mays
  misc_feature: Ceres CLONE 1552182
  misc_feature: Encodes the peptide sequence at SEQ ID NO. 71158
  misc_feature (297)..(297): n is a, c, t, g, unknown, or other
ctccccgcggtggcggccgctctagaactagtggatcccccgggctgcaggaattcgtctcacccctagaaaaagctcctcttcaggctgctagtactcagtagtcagtacagtggtgacgacgacgacatgacgaagatctcccgctcgttgctcgtcgtgccgccgctgctcatcgcgctgctcctcctcggccctcacctcccgccatccgacgcgctgacgcccaagcagggcgtcaagtccaagaccttcctgtccccgcccatcctgcttcgcccgggcgacgtggccgancagttctactacgacatccccttcccccggggccacctggcgctcaagagcttcaacggcaaggtggtggacgagcgcggcgcccccgtgccgctccacgagacgtacctccaccactgggtcgtgcagccctactacgccctggtagtatcgggcgagggcggcagcagccggccgcggaccatccccgcgcgcaacgcccggcgtgtgccagcggccacacgctggggccagtacttacgggctgggggccgaaaaccgggggcacggccccggggggggccccgacccgttccgggattccaaattggggaacccgggccggggggcccgc

SEQ ID NO: 71158 - protein, 167 aa, Zea mays
  misc_feature: Ceres CLONE 1552182
  misc_feature (56)..(56): Xaa is any aa, unknown, or other
MTKISRSLLVVPPLLIALLLLGPHLPPSDALTPKQGVKSKTFLSPPILLRPGDVAXQFYYDIPFPRGHLALKSFNGKVVDERGAPVPLHETYLHHWVVQPYYALVVSGEGGSSRPRTIPARNARRVPAATRWGQYLRAGGRKPGARPRGGPRPVPGFQIGEPGPGGP

SEQ ID NO: 71159 - DNA, 501 bp, Zea mays
  misc_feature: Ceres CLONE 1552185
  misc_feature (240)..(240): n is a, c, t, g, unknown, or other
  misc_feature (268)..(268): n is a, c, t, g, unknown, or other
  misc_feature (269)..(269): n is a, c, t, g, unknown, or other
aagctggagctcaccgcggtggcggccgctctagaatagtggatcccccgggctgcaggaattcgtctcacccctagaaaaacttgcgctcatcagtcgtctccgaccaagatcagcaaggacggcatggctctcgaagcagcgtacgactacctgcacgtcgccgtcgtccagtgcacgcccacacaagcagcagcagtcctcggcgtcctcctcctcctcgccatccggctagccgcnggcggcgaaggagctcgtccgcgacgtnncccccaaatgggaagcagcacaggctgccgccgacgcctccggggaagctccccatcatcgggcacctccacctcatcggtcccacccgcacgtctccttccgaacctccacgccaagtacggccacaacgggctgatgctgggtgcaggtcggcgccgtgcccaccatcggtggtgtccacgcccgcagggccgccgaggccgtggctccgcacgcacgaaccaccgtggc

SEQ ID NO: 71160 - DNA, 694 bp, Zea mays
  misc_feature: Ceres CLONE 1552186
  misc_feature: Encodes the peptide sequence at SEQ ID NO. 71161
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (410)..(410): n is a, c, t, g, unknown, or other
  misc_feature (503)..(503): n is a, c, t, g, unknown, or other
ctccccgcggtggcggccgctctagaactagtggatcccccgggctgcaggaattcgtctcacccctagaaaaagatccatttcccactcgatcgccaataatggagtttccgcaccaccaccaccaccacggccatcgccgcgacgacgacgaagacgaccgcagaggcccgcctcccccggtctacggcggctacggccagccaccgccacccgacccgtacggccgcgcgcccgtcgaccccgatccgtacggtcgacctccgccccagtccgcgtacggtgggggccggggacgcctacggccacagcggccaaggctacgcgcccccgccgggctacggcgccggggggcgggtacggcaacgtcggtccgcgttnnncgcaacaaaggtcggcgaacgagagancccttactacggggggcgggggcggcgggtcttggtggggccctaccggaggcggtgggctcccaattacggccccacaagggccgaaccgcnccccgggggggggggggatcccaggtacgggccccaaaaaacgccccccaccccgggggggggggggggcggggcccccccccttgtggggggccccaaaaatctccgggtttctttgcggaggggggtgggggggagaaaaaataaaccccctccccccccccgcaagaggagagggttccccctttggg

SEQ ID NO: 71161 - protein, 182 aa, Zea mays
  misc_feature: Ceres CLONE 1552186
  misc_feature (94)..(94): Xaa is any aa, unknown, or other
  misc_feature (103)..(103): Xaa is any aa, unknown, or other
MEFPHHHHHHGHRRDDDEDDRRGPPPPVYGGYGQPPPPDPYGRAPVDPDPYGRPPPQSAYGGGRGRLRPQRPRLRAPAGLRRRGAGTATSVRVXRNKGRRTRXPLLRGAGAAGLGGALPEAVGSQLRPHKGRTAPRGGGGSQVRAPKNAPHPGGGGGRGPPPCGGPQKSPGFFAEGGGGEKK

SEQ ID NO: 71162 - DNA, 706 bp, Zea mays
  misc_feature: Ceres CLONE 1552190
  misc_feature: Encodes the peptide sequence at SEQ ID NO. 71163
  misc_feature (522)..(522): n is a, c, t, g, unknown, or other
  misc_feature (572)..(572): n is a, c, t, g, unknown, or other
  misc_feature (606)..(606): n is a, c, t, g, unknown, or other
aaagctggagctcaccgcggtggcggccgctctagaactagtggatcccccgggctgcaggaattcgtctcacccctagaaaaaacactcgaacacttccaaagttctagcccctctcgtgagtcctgtccaaataatggccacgcgcagcagtgtcctcctgcttctgacggcgctcgccgcagccacgcctgtgccgtcagcggcgaccaggaagctcatgttcctcgtccagccacagccgaacctcctcacgtaccacaacggcgccgtgctgagcggcgacatccccgtctccatcctctggtatggccgcttcacgccggcgcagaaggctgtggtctccgacttcctcctcgccctctccggcgccgcgccgccgcaggggtcgccgtccgttgcccagtggtggagcagcgtccaccagctctacctctccaaggcggcgggcggccggcgtcagcaagaacggccgcggcacgggcggcggcgccaaaagcgcgcgggtggtgctgtccgggncaggcctccaacaagggctgctccctggggaaaaccctgaacttgtccanctttcccggcctggggggggcggcaccccccccnaaccccggccccaaagggggggcttcccccttgtgcttcacggcccggaaaatggccgtgaaaggtttcttacaaaaccgggggggggcaccccggggtt

SEQ ID NO: 71163 - protein, 141 aa, Zea mays
  misc_feature: Ceres CLONE 1552190
  misc_feature (129)..(129): Xaa is any aa, unknown, or other
MATRSSVLLLLTALAAATPVPSAATRKLMFLVQPQPNLLTYHNGAVLSGDIPVSILWYGRFTPAQKAVVSDFLLALSGAAPPQGSPSVAQWWSSVHQLYLSKAAGGRRQQERPRHGRRRQKRAGGAVRXRPPTRAAPWGKP

SEQ ID NO: 71164 - DNA, 668 bp, Zea mays
  misc_feature: Ceres CLONE 1552191
  misc_feature: Encodes the peptide sequence at SEQ ID NO. 71165
ctggagctccccgcggtggcggccgctctagaactagtggatcccccgggctgcaggaattcgtctcacccctagaaaaaaacccctgccgcgctagctgtctctccaccgcatcgaccggacggtctctctctcgtctctcccgacgcgcctccacggccggccccgccccggctcgctagcctcctcccactcccagtaccagcccccgcccctccagcaccaccagcagctcgccttcagaccatgagacgggtcggaggagacctgcagggcgacggcacgacgcctcggtccgcggcggcggggcaggccatgatggagcttcaggccaacgggtcggccgccgtcaggggcgccatggtggtggcgctcagcccgctcagcgaggccctgaggcgggacagcaatgcgctcccgctggggccggccccgacgcgctcatcggcgacgtgtccgccaggctcacgtggaaggacctctgcgtcaccgtggccctgggcccccggcaagacgccacacggggctggaacgagctaaccggggtacccaaaccccggggccttggaccgcttcaagggggccctcagggtccggaaaaacaatctggttaaaacccttttcggggcgggctggcaaaaaaggcgttacctttggggaaaatggtt

SEQ ID NO: 71165 - protein, 97 aa, Zea mays
  misc_feature: Ceres CLONE 1552191
MRRVGGDLQGDGTTPRSAAAGQAMMELQANGSAAVRGAMVVALSPLSEALRRDSNALPLGPAPTRSSATCPPGSRGRTSASPWPWAPGKTPHGAGTS

SEQ ID NO: 71166 - DNA, 674 bp, Zea mays
  misc_feature: Ceres CLONE 1552192
  misc_feature: Translation starting site: 385
  misc_feature: SWISSPROT Homolog: EC 2.1.2.1 Glycine hydroxymethyltransferase
  misc_feature (628)..(628): n is a, c, t, g, unknown, or other
  misc_feature (653)..(653): n is a, c, t, g, unknown, or other
ctccccgcggtggcggccgctctagaactagtggatcccccgggctgcaggaattcgtctcacccctagaaaaaactccagcccgcggtccagcccctgtccccgtcacctcctctgctccgtagcgccgccatccgtggcggcggcaatctaccgaacaccgtgcgtgcgtgtgttgccgcaatggcctcgcaccacctcgccagccccgccgcggccgcaacctccgccgccaccgtctccagggctctcttcaagcatgcctacactaaaccctcttactcccttctccacgccccgctcctccgcgccgtcgccgcccggcccgcgctcctctccgccgccaccgcggtctccactacggcggcgcccgcggccgcagctatggacaacgtggaggagtgggggctgaggccgctggccgaggtcgacccggaggtgtacgacctaatcgagcgcgagaagcggcggcagcgagcgggtatcgagctcatcgcctcggagaacttcacctcgctcgctgtcatggaggcgctgggctccccgctcacaacaagtactcggagggcatgccgggggcgcgctactacggcggcaacgaggtcatcgacgaaatcgaggagctctngcggacccgggcgctcgccgctttnccactcgacccgcccgctggg

SEQ ID NO: 71167 - DNA, 570 bp, Zea mays
  misc_feature: Ceres CLONE 1552193
  misc_feature: Encodes the peptide sequence at SEQ ID NO. 71168
  misc_feature (306)..(306): n is a, c, t, g, unknown, or other
  misc_feature (315)..(315): n is a, c, t, g, unknown, or other
aaagctggagctccccgcggtggcggccgctctagaactagtggatcccccgggctgcaggaattcgtctcacccctagaaaaaaaatcgtgaaactattgagaaaattccattccaacgacatcgaaggagcctgcgaagcgagcgagagtctataatggcggacggaggcgagctgcagctgctgggctcatggtacagcccctacgtgatccgcgccaaggtggcgctggggctgaaggggctcagctacgagttcgtcgaggaggacctctccccgcagagcgacctgctgctgaagctcanccggtgcancaggaaggtgcccgtgctggttcacgggggcccccccccgggtgccaaatcccctcgtcattcttggaaaaaggttcaaccaaaccctggggcaggggacccgggagacccttttttctttccccggcgaaaaaccttaaaaaacccgccccaggggttcccctttttggggggccccccacttcccaaaaaaaaaatttttttcaaaaggggggggggaaacaccgggttttgttttggggggaccaaaaaaaa

SEQ ID NO: 71168 - protein, 137 aa, Zea mays
  misc_feature: Ceres CLONE 1552193
  misc_feature: SWISSPROT Homolog: EC 2.5.1.18 Glutathione transferase
  misc_feature (50)..(50): Xaa is any aa, unknown, or other
  misc_feature (53)..(53): Xaa is any aa, unknown, or other
MADGGELQLLGSWYSPYVIRAKVALGLKGLSYEFVEEDLSPQSDLLLKLXRCXRKVPVLVHGGPPPGAKSPRHSWKKVQPNPGAGDPGDPFFFPRRKTLKNPPQGFPFLGGPPLPKKKIFFKRGGGNTGFCFGGTKK

SEQ ID NO: 71169 - DNA, 717 bp, Zea mays
  misc_feature: Ceres CLONE 1552194
  misc_feature (1)..(1): n is a, c, t, g, unknown, or other
  misc_feature (10)..(10): n is a, c, t, g, unknown, or other
  misc_feature (11)..(11): n is a, c, t, g, unknown, or other
  misc_feature (79)..(79): n is a, c, t, g, unknown, or other
  misc_feature (219)..(219): n is a, c, t, g, unknown, or other
  misc_feature (222)..(222): n is a, c, t, g, unknown, or other
  misc_feature (372)..(372): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (446)..(446): n is a, c, t, g, unknown, or other
  misc_feature (447)..(447): n is a, c, t, g, unknown, or other
  misc_feature (448)..(448): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (476)..(476): n is a, c, t, g, unknown, or other
  misc_feature (478)..(478): n is a, c, t, g, unknown, or other
  misc_feature (479)..(479): n is a, c, t, g, unknown, or other
  misc_feature (531)..(531): n is a, c, t, g, unknown, or other
  misc_feature (533)..(533): n is a, c, t, g, unknown, or other
naactccttnntacccactggagctccccgcggtggcggccgctctaaactagtggatcccccgggctgcaggaattcntctcacccctagaaaaaacactcatcaccagctagtagctctagcaaagcacttgccatctaccgaccgccgcattccaaacagcccgacgagctagcagagcggcaggcacctcctccaggaacatggcccgcacgcancanttggcagtagtggcgacagccctggtggccttggtgctcctggcggccgccacatcagaagggggcatcatcttctttcccgggggggggggggaaggggccccgggttcccttttttttgcgggccgaggtccagggggcccccccccntttttttttcccccccccccccgggggaaagaaagggggnnnnnnnnnnnnnnnnnnnnnnnnnnnntnnnntnnnaaaaaaaaaaaaaaaaaaaaannnnnanannagggggggggaccccacaccccccctgtattcccctccctagcctccccccncnaaggaccgccccattaactgttgccgcccacccaaaaccggcaccccgcccgcagggtcgcgcccccgcgtaaccagcccctcccgcgctcacccgcccccccccgggggggagccccgcgtgcgcaaaaaaatggatttctaccgccccccccccgtttggtcggtgggcccatgagtacccc

SEQ ID NO: 71170 - DNA, 658 bp, Zea mays
  misc_feature: Ceres CLONE 1552195
cccccgggctgcaggaattcgtctcacccctagaaaaaagaagcagccaccctcctgcgcctccaccctcgtcgccgcctcgctgcctatgaggtcgaagatccgtccagttagacgaagcgaaccgtacccatgggctccggtgagctctgctggacctacgccgccctcatcctcagcgactagccggtcgccttcaccgccgagaagatctccatgttcatgaagggagccaacatcaaggtcgagtcctactggcccagactctccgctaaactcccgtatacgaccactgctgaggatcttatcccgccccgttgaatctaccggtggggctgcctcaagtttgctgcttccggcccccgggtggacccccttaaaacttgctgctgccccctgcttaaatgggagaaaaatggagcaccccaagggcggggtcctgaagaccaacctggggttttgcaacatgtcccaacttgaggagccccccccctccccacccctttgagcaaattccccttatgcctttccaaggacttgtttttatagcttgggttaaatgccacttttttttattagaaagaaaacccagttttggccatttttcaaaatgtgggccatggcacaactcccattgaagacgccaagacccaccgtg

SEQ ID NO: 71171 - DNA, 855 bp, Zea mays
  misc_feature: Ceres CLONE 1552200
  misc_feature (14)..(14): n is a, c, t, g, unknown, or other
  misc_feature (15)..(15): n is a, c, t, g, unknown, or other
  misc_feature (17)..(17): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (855)..(855): n is a, c, t, g, unknown, or other
cccccccccccccnntnccgcgtgtggttgaaaaaaaattnnnnntttgctggggctccccgcggtggcggccgctctagaactagtggatcccccgggctgcaggagttcgtctcacccctagaaaaaatcccaagaagagccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtctagtagtagtagtagtaatttcatgtacgaagctccccttggttacaagatcgaggacggttcgcccagccggaggaaacccccacaaatttccgggagggggggctttattcccaactggcgtcccgccagcccatcctggatatccgccctcataattgccaattccgcgggttaaagtaaggatttttaaattcgaggtttttccctccttggggggccggagaggttttcccggttggggttcttggggctggcccttccctccggggctttcgggaaaaattccaaacttggttcctttgggccacactcttttcccttttattcctcgtgtgccactccccttttttttttttttgggaaccaccggttatttgccgggtgggggtaaatgtccttctcccccaaaaattcctttggggtggcgatgttctcccgggcgcgcgccgcctaattgggcctttgtgggggggtttaataagaaaggggcccccccgtaaaatcccgccctctcn

SEQ ID NO: 71172 - DNA, 672 bp, Zea mays
  misc_feature: Ceres CLONE 1552203
  misc_feature (408)..(408): n is a, c, t, g, unknown, or other
ggagctccccgcggtggcggccgctctagaactagtggatcccccgggctgcaggaattcgtctcacccctagaaaaagcctagcggcagggtgtttaagaacaaagactccgaaccaagacccgacgcgacatttttttttggaagggggtgggggctttgttggtgctgttgttagaagagatcaaacgggtccgtgggaaaaaaaaaagaggtttcattcgcgtgcgtgcgtgcctgcgccgagcgcccgagctaatctactagtatttagcacgcgacgggagcatctcgccgctcgattcgggcctccccgtgaattcaccccacagcgagccgagcgagcgagaattcgaattggagttggacttgcggctgctgcgtccggtgggtctggaattctcaccncctccccgtgcggggtgagaggcggtgggtcctggttgcggtcggcccgcaggagggtccaccgtctcgcgccattgggtacgaaaccggccgagactgcccggggggcggcctctctctggagacagctcagggcaggttgatccagagggttcaagcgccttcggttgcctggaggattttccgggggggtccttgttttttgggccgctataatccgtgaatccttccagctgctcctcggggggagagggcagccgaacc

SEQ ID NO: 71173 - DNA, 583 bp, Zea mays
  misc_feature: Ceres CLONE 1552209
  misc_feature (148)..(148): n is a, c, t, g, unknown, or other
aaagctggagctccccgcggtggcggccgctctagaactagtggatcccccgggctgcaggaattcgtctcacccctagaaaaaatcgacactcgccgcgcaccaccaccaccggctgcggctcacgggctacgcagcccgctctccngaccccccgtgccctctcttttgctactagcacatagagttttcgcccgaaatcgatcgcccgactgaactcccgcttaggggttcgggcccggattccccgttttcgttcttcccgggtttcccggggggggaccccccccccaaaaattttttaaatttggagatttctcccggggtgtgcccccaaatttttttttccccttttttggcccccccagggcccaggggggggggggaccacccccccctctttagggggggaaaaaaaaggggggggaaaaccccccttaaaaagagggggtttttgtggtggttgggcgccccacagggggggaaacatttttttttaaacaaaaaatatttttttctccccccccccgcgggggggggaaaaaaaaaaccccccccccctaaaaagtgtgcgcccccccaa

SEQ ID NO: 71174 - DNA, 670 bp, Zea mays
  misc_feature: Ceres CLONE 1552211
  misc_feature: Encodes the peptide sequence at SEQ ID NO. 71175
  misc_feature (384)..(384): n is a, c, t, g, unknown, or other
  misc_feature (399)..(399): n is a, c, t, g, unknown, or other
  misc_feature (489)..(489): n is a, c, t, g, unknown, or other
ctccccgcggtggcggccgctctagaactagtggatcccccgggctgcaggaattcgtctcacccctagaaaaagccgtcgcctgctcccatcccgccgccggcgctgccacccgcatctgccaaggggctcgccgccggggaggctgctcgcggtgccgcgctctctcccgcgcccgaccttggccctcccctcctccatgatctgcgcgatctccggcgaggtgccggacgagccggtcgtgtcgaagaagtcggggctactcttcgagcggcggctcatcgagcgctacattgaggaccatggcaagtgtcccgccaccaaggaggacctcaccatggatgatatcgtgccggtcaagaccaacacgatcgtgaagcccangcctttgcaggctgncagcattccaggactccttgggatttttcagaacgagtgggatgctctcatgctttctaattttgctttggagcagcagcttcacacagncagacaagaacttagtcatgcactctaccagcatgacgctgcctgccgtgttatgcccgattaaagaaggaagagatgacgctagagcccttttgctcaagctgagagacagatccctgcgtcagttgcaggaactgctcctgcaactggttgttccattggaaaaaagtaattgaaatga

SEQ ID NO: 71175 - protein, 117 aa, Zea mays
  misc_feature: Ceres CLONE 1552211
  misc_feature (64)..(114): Pfam Name: Prp19 Pfam Description: Prp19/Pso4-like
  misc_feature (62)..(62): Xaa is any aa, unknown, or other
  misc_feature (67)..(67): Xaa is any aa, unknown, or other
  misc_feature (97)..(97): Xaa is any aa, unknown, or other
MICAISGEVPDEPVVSKKSGLLFERRLIERYIEDHGKCPATKEDLTMDDIVPVKTNTIVKPXPLQAXSIPGLLGIFQNEWDALMLSNFALEQQLHTXRQELSHALYQHDAACRVMPD

SEQ ID NO: 71176 - DNA, 638 bp, Zea mays
  misc_feature: Ceres CLONE 1552212
  misc_feature (241)..(241): n is a, c, t, g, unknown, or other
ctccccgcggtggcggccgctctagaactagtggatcccccgggctgcaggaattcgtctcacccctagaaaaagccatacaattctcacacgcgcgcgcccaacacactagcctgcaggatcgtcgagcgcgaggcggctgccccgccggccggttcgttcgctctatagcttgagaccgatcctagctaggccaagacgatatcggcggcgatgatgatggacgcggcgagaatcctanagtacttcaaggggcaagtgcatcctcgtcaccggttcaacagggtttcttggaagatccttgtgagaaaatactgcgggtcagcctgacctgccaaaatttactgctttgacccccccccaccaacatgggggaagggggggtccaaaaaagggaataaccccgactttttccccttttaaaaaaaaaaccggaaggggttcccccaattttctaaaaggcaagggtttccctttgccccgaaaaatttataaaaaaggcgcggggggtggagggacccccttttggtaacccctctgcaaaaaaaacttcaaatttttttttaaaaggtcgcgaaaccccccccttttttttaaaaaaaaaaaaatttttttttcttcggagaaaaaaaaatgtg

SEQ ID NO: 71177 - DNA, 664 bp, Zea mays
  misc_feature: Ceres CLONE 1552215
  misc_feature: Encodes the peptide sequence at SEQ ID NO. 71178
  misc_feature (490)..(490): n is a, c, t, g, unknown, or other
  misc_feature (507)..(507): n is a, c, t, g, unknown, or other
  misc_feature (512)..(512): n is a, c, t, g, unknown, or other
  misc_feature (513)..(513): n is a, c, t, g, unknown, or other
ctccccgcggtggcggccgctctagaactagtggatcccccgggctgcaggaattcgtctcacccctagaaaaacgatcacatcatcagttcatcactcgctcgtctccacagccatcgacctcactcactagctagcgctagcttccagcagcagcagccttgtcgtgcaacagcagcaccaggagtccaggaccaggctaccaccagttagctgctggggacctggggtacggttgttgttccgtgactctcgtcgcacaacacaatgccggccatggtagaggaggggctcgtcaggcgggcggcgcccgagccgcacttcctggtggtgaccttcccggcgcagggccacatcaacccggcgcggcacctcgcgcgccgcctgctacgcgccacgggggcgcgggtcaccgtctgcacggccgtgtccgcgctccgcaagatgttcccgggcgccgaggcagacgcggaggaggagggccaccgcnacggcgcggggggtgcngtacnntgccctactccgacggctacgacgacggcttcgacggcgccgtgcacgacgccacgcgctacatggacccagtcagggtcgtggggtccgcacgctgggggacgtcctgggccgcctccgcggcgcgggcagcccgcacgctctctgaatc

SEQ ID NO: 71178 - protein, 132 aa, Zea mays
  misc_feature: Ceres CLONE 1552215
  misc_feature (75)..(75): Xaa is any aa, unknown, or other
  misc_feature (82)..(82): Xaa is any aa, unknown, or other
MPAMVEEGLVRRAAPEPHFLVVTFPAQGHINPARHLARRLLRATGARVTVCTAVSALRKMFPGAEADAEEEGHRXGAGGAVXCPTPTATTTASTAPCTTPRATWTQSGSWGPHAGGRPGPPPRRGQPARSLN

SEQ ID NO: 71179 - DNA, 664 bp, Zea mays
  misc_feature: Ceres CLONE 1552217
  misc_feature: Encodes the peptide sequence at SEQ ID NO. 71180
ctggagctccccgcggtggcggccgctctagaactagtggatcccccgggctgcaggaattcgtctcacccctagaaaaagttggcagttgcgacttgcgagtggctccaaaaggcaacacaatccaccggcaccaacccagcgcggcgccaccggcgacccgtacccccttccccggagagcgatggcgacggagctgacggcggcgcagctgcgcgcgtacgacggcaccgacccgtccaagcccatctacgtctccgtccggggcaaggtctacgacgtcacctccggccgcggcttctacggccccggcggcgcctaccccgtcttcgcgggccgcgaggccagccgcgccctcggcaagatgtccaaggacgaggccgacgtctcggggaacctctccgggctcaccgacaaggagctcggcctcctcgccgactgggagaccagttccaggccaagtaccccgtcgtcgccccactcgccgcccacgcctgaactcgggagtctccggtgaaaatttactctgtcctgcctcttgggggggtttcagggtggggcttgcctggcttggtgcctaggtggctttgcccccccaataatcccaaatggaaagggaccttttgtgtatggtccctgccttaaaaaacctcggaacccccct

SEQ ID NO: 71180 - protein, 110 aa, Zea mays
  misc_feature: Ceres CLONE 1552217
  misc_feature (4)..(81): Pfam Name: Cyt-b5 Pfam Description: Cytochrome b5-like Heme/Steroid binding domain
MATELTAAQLRAYDGTDPSKPIYVSVRGKVYDVTSGRGFYGPGGAYPVFAGREASRALGKMSKDEADVSGNLSGLTDKELGLLADWETSSRPSTPSSPHSPPTPELGSLR

SEQ ID NO: 71181 - DNA, 657 bp, Zea mays
  misc_feature: Ceres CLONE 1552220
  misc_feature: Encodes the peptide sequence at SEQ ID NO. 71182
aagctggagctccccgcggtggcggccgctctagaactagtggatcccccgggctgcaggaattcgtctcacccctagaaaacccgtgcgcttgcggtgcggacgcttcccctccacctccgcacacatctccaactaaccatgccagtctaccgcagtactgccgacttctagcagttgttttataggttagtttcgttgccttgtgtctttgttagtgtatcaaaaccaattcgcgacatcacttaggaaggggaaagcaggggccggaaaaagaagaagagacgggaatggcaagctccgactcaaatcccaccgatgcattcgagtacatgctgcttgagaaggatcctgatctctaccggacggttttctctggtccgagccagacaagtccatggattgacccgagtgtgttaaagctgaagcaccggatagggagaggtccatttggggatgtatggatagcaactcaccaccaaaggacagaggatttcgatcagtaccatgaggttgcggtgaagatgctgcatccaattaaagaggaccagctgcagatcttctcagcgaggttccatgagatcttcagcaaatgtcagggtctggggcacgttttgtttcttgcatggcatctctacacagaatgggaaggattgt

SEQ ID NO: 71182 - protein, 122 aa, Zea mays
  misc_feature: Ceres CLONE 1552220
MASSDSNPTDAFEYMLLEKDPDLYRTVFSGPSQTSPWIDPSVLKLKHRIGRGPFGDVWIATHHQRTEDFDQYHEVAVKMLHPIKEDQLQIFSARFHEIFSKCQGLGHVLFLAWHLYTEWEGL

SEQ ID NO: 71183 - DNA, 666 bp, Zea mays
  misc_feature: Ceres CLONE 1552225
  misc_feature: Encodes the peptide sequence at SEQ ID NO. 71184
  misc_feature (409)..(409): n is a, c, t, g, unknown, or other
  misc_feature (416)..(416): n is a, c, t, g, unknown, or other
  misc_feature (420)..(420): n is a, c, t, g, unknown, or other
ctggagctccccgcggtggcggccgctctagaactagtggatcccccgggctgcaggaattcgtctcacccctagaaaaaatcctcctctttccattccactctctcactctctctctaatcacactttcgacactgatcggtactctagtgtccgactcgtcacaattttagcgagaacgagcgagcgagcgagggagaggatgggttccacaggaccggcgagcgggttcgcggcgccggagcgggacatcgacgatctgccgcggaacgacgccaactacacggcgctcacgccgctctggttcctcgagcgcgcggcgctggcgcatccgggcagggcctccgtcgtgcacggccccgtgcgctacacctgggctgacacctatcgccgctgccgcccgctcgcnatcgccntcgnggggctatccgtcgggcacggaagcacggttgctgtgatagctcctaatgtcccgctgtctatgaagctcactttcgtgtccccatgtcaggagcctgtgggaaatgcttcaatattcggctaaaccccgaacaatagcattcctccctgaaacctccgtgggaaaattttggatgggggaccaaaattcttccccctacccaaaaaacccttaaaataattggcaaaaaaaaaaacccggctttc

SEQ ID NO: 71184 - protein, 113 aa, Zea mays
  misc_feature: Ceres CLONE 1552225
  misc_feature (72)..(72): Xaa is any aa, unknown, or other
  misc_feature (73)..(73): Xaa is any aa, unknown, or other
MGSTGPASGFAAPERDIDDLPRNDANYTALTPLWFLERAALAHPGRASVVHGPVRYTWADTYRRCRPLAIAXXGLSVGHGSTVAVIAPNVPLSMKLTFVSPCQEPVGNASIFG

SEQ ID NO: 71185 - DNA, 548 bp, Zea mays
  misc_feature: Ceres CLONE 1552229
  misc_feature: Encodes the peptide sequence at SEQ ID NO. 71186
  misc_feature (44)..(44): n is a, c, t, g, unknown, or other
  misc_feature (54)..(54): n is a, c, t, g, unknown, or other
  misc_feature (61)..(61): n is a, c, t, g, unknown, or other
  misc_feature (70)..(70): n is a, c, t, g, unknown, or other
ctccccgcggtggcggccgctctagaactagtggatcccccggnctgcaagaantcgtctncaccctagntatgcttgccggccgcctgaccttatctcctcctccaccccgagatatttccacgtctcctccgccaccatggagtccggcctcgttgcaagccaccgcctccgcgtcccgcccccctccgcctccgccgggcaccaccacctcatccgccaccgccacgcccacgccccggtggccgctgcgcccctccgcctcagtctcccgcgccacctcccccgggtcaccccgctccgcctgcccgacgcgttccccgctccgccaatgccttccgggccccttcggggcccccccccccccccccggggggggggccggcgcccggggaaaaaacttcccccaaattcccgggggggggagcccaaaaaccttcgagaagttctggccccccggggggggaaagtggtgtttgtggcaccccctttaaaaaaaaacccaatttcaggagaaaaaaaaccaaggggatccggacccccgacga

SEQ ID NO: 71186 - protein, 136 aa, Zea mays
  misc_feature: Ceres CLONE 1552229
MESGLVASHRLRVPPPSASAGHHHLIRHRHAHAPVAAAPLRLSLPRHLPRVTPLRLPDAFPAPPMPSGPLRGPPPPPRGGGRRPGKKLPPNSRGGEPKNLREVLAPRGGKVVFVAPPLKKNPISGEKKPRGSGPPT

SEQ ID NO: 71187 - DNA, 683 bp, Zea mays
  misc_feature: Ceres CLONE 1552230
  misc_feature: Translation starting site: 209
tccccgcggtggcggccgctctagaactagtggatcccccgggctgcaggaattcgtctcacccctagaaaagtttttctctctcctgcgctgcgccgtccttcacctccgccgccgaatccgagactctgatctcgggttcaccgcagcgcacagagcacccccgactcccgtcccgatccgcgctctcctctacgacgcttcagtcatggcaggaatggcacccgagggttctcagtttgatgctaagcactatgattctaaaatgcaggagctgctgagcactggtgagactgaggagttcttcacttcatatgatgaagtttttgaaagttttgatgacatgggccttcaagagaatcttttgagaggcatttatgcatatggtaggctgggagtcttctgttttatcttcttttttagcgagtttttctttacatggtattcctcgtactacccattcttcgatgtgtaggttttgagaaaccatctgcaattcagcagagagggaatgttcccttctgcaaggggtttgatgtcattcaacaagcacaatctggtacaggaaagacagcaacccttctgttctggggatcttgcagcagcttggaccatgggtctggttgaaaggcccaggcccttggttcttggctccccaccccgggagccttggccaagcaaaa

SEQ ID NO: 71188 - DNA, 667 bp, Zea mays
  misc_feature: Ceres CLONE 1552235
  misc_feature: SWISSPROT Homolog: EC 3.2.1.21 Beta-glucosidase
aaactggagctccccgcggtggcggccgctctagaactagtggatcccccgggctgcaggaattcgtctcacccctagaaaatacacacttcacaagcagctcaaagctctagttctagctagctagcaaagggggggaaaatggctccgcttctcgctgctgccatgaaccacgctgcagcccatcctggccttaggagccacctagtaggacccaacaatgagagtttctcacggcaccacctgccgtcttcttctccacagagcagcaagcgaaggtgtaaccttagctttactacacgatctgcaagagtaggcagccaaaatggagtccaaatgttgagcccctcggaaatcccacaaagggactgggtcccctctgacttcaccttcggtgccgccacttcagcgtaccaaatgaaagtgcttggaatgaagatggaaaagggggaaaagcaactgggatcacttctgccacaatcatcccgaaaagatcctggacgggagcattccagactttggagccaattcgtaccatatggtcaaaacggacctcaaaatgctcaaggaaatgggcttggaccccttttggttcccttatctcttggcccaaaatccttgcaaagggaaccaaaaggggggttttaccccggtgggcttcaaacca

SEQ ID NO: 71189 - DNA, 660 bp, Zea mays
  misc_feature: Ceres CLONE 1552236
  misc_feature: Encodes the peptide sequence at SEQ ID NO. 71190
  misc_feature (660)..(660): n is a, c, t, g, unknown, or other
aaagctggagctccccgcggtggcggccgctctagaactagtggatcccccgggctgcaggaattcgtctcacccctagaaaaaatggccgtcggcctctactctctcggcctctctccgccgccgcggcttgataccatcctcttcccacagctgcggcctcacctacgctgccgcgtgcccgctcgggttgctgcagccggcaccagctggtctcccgccgccggtgactccgaagacggggtcggcggctggtggtttcccgagtacaagaaatcgatgaaacaggcgagggggaggattgggtttaagagagctgtcgtggttgggttgggagcttctgcggtgatcgccttggctgggctggcgtggcgcttcccatcttcccagaagcgtatacaacaactcattgttgctccattacactatgttcaagagatattgccaacaatggagtcgacacagacaaccaacgaggatgcaagtgacatgtaatctgatgaaattaaaggatctagtgcaacacatgaatagatggctgaagcaatgactgatgattcatgcttaactacggaacaacaattgccagctcttttccagtttggagtgctacagatctgtgcatgaggaggcttatctgtactgaagaaactcagatan

SEQ ID NO: 71190 - protein, 136 aa, Zea mays
  misc_feature: Ceres CLONE 1552236
MAVGLYSLGLSPPPRLDTILFPQLRPHLRCRVPARVAAAGTSWSPAAGDSEDGVGGWWFPEYKKSMKQARGRIGFKRAVVVGLGASAVIALAGLAWRFPSSQKRIQQLIVAPLHYVQEILPTMESTQTTNEDASDM

SEQ ID NO: 71191 - DNA, 637 bp, Zea mays
  misc_feature: Ceres CLONE 1552238
  misc_feature: Encodes the peptide sequence at SEQ ID NO. 71192
  misc_feature (297)..(297): n is a, c, t, g, unknown, or other
  misc_feature (298)..(298): n is a, c, t, g, unknown, or other
  misc_feature (391)..(391): n is a, c, t, g, unknown, or other
  misc_feature (392)..(392): n is a, c, t, g, unknown, or other
  misc_feature (397)..(397): n is a, c, t, g, unknown, or other
  misc_feature (398)..(398): n is a, c, t, g, unknown, or other
  misc_feature (402)..(402): n is a, c, t, g, unknown, or other
gagctccccgcggtggcggccgctctagactagtggatcccccgggctgcaggaattcgtctcacccctaggaaagtttcccttgctcgccttcacccctcgccgccgccgccgccgtcgccgtcgcaagcgacgatgctcgacatcaacttgttccgcaccgacaagggcggcaacccagaccttattcgcgagtcccagcgcagtcggttcgcctccgtcgagctcgtcgacgaggtcatcgccctcgacaggcatggcgcgaaagcagttctagctggacagatccggcaggannctcacgctaccagcaagaagatcggcaagctcaaagccagcaagcaagaataggcccccccccacccgggggggggggggggggccatatttnnaaaanntttnccaccccaaaaaatttgaaggtgcaggagcccaagagccccctgcgccgccaaggttcccaacaattgggcacatccgtggctggaatcccctgccacgtcagcggcaaaaaaggcgaaaaaattgaatttgtcccggacttttgggaaagagaaaagactgaggggttctttggaaggacccgcccggcgccctttgggcgatgggcgtgggtagtgggccccctggacaaaag

SEQ ID NO: 71192 - protein, 71 aa, Zea mays
  misc_feature: Ceres CLONE 1552238
  misc_feature (1)..(71): Pfam Name: Seryl_tRNA_N Pfam Description: Seryl-tRNA synthetase N-terminal domain
  misc_feature: SWISSPROT Homolog: EC 6.1.1.11 Serine--tRNA ligase
  misc_feature (54)..(54): Xaa is any aa, unknown, or other
  misc_feature (55)..(55): Xaa is any aa, unknown, or other
MLDINLFRTDKGGNPDLIRESQRSRFASVELVDEVIALDRHGAKAVLAGQIRQXXHATSKKIGKLKASKQE

SEQ ID NO: 71193 - DNA, 596 bp, Zea mays
  misc_feature: Ceres CLONE 1552241
  misc_feature (22)..(22): n is a, c, t, g, unknown, or other
tccaccgcgggtgggcggccgnctctagaactagtggatcccccgggctgcaggaattcgtctcacccctagaaaatccctacatcaaccttagctagcttgccagggagggagtccttgaattccagcagaagcctcctctcttcgccactcttcgctagctcatcgtcaaacttcaggagcagtgctaccgtctcctcctccccatccccatccagatctgcagttcctatgatacatgacaccggctgctgctgagcatccactgcgtgccacgtcatcgcgtcacatgggacactagaccagcttcacggctgccaagactgcttgcaccttgcaggcgagatgctttgcacgagctcgtctaggaatgctccgggactgacgttgacgcaggaaccccttccctacaggaggctgaagataggacttcaaatgcccctcaaattaccccctgccaaatgctttacagaccaaatggcccgaacgggagttttataaatttccccccccaggaaaaaggaagaaaaagatttcttcttaaagaaaagtggcttcggcccctttggggcaaacccgggggagtatttgggaaa

SEQ ID NO: 71194 - DNA, 631 bp, Zea mays
  misc_feature: Ceres CLONE 1552242
  misc_feature: Encodes the peptide sequence at SEQ ID NO. 71195
acccgcggtggcggccgctctagaactagtggatcccccgggctgcaggaattcgtctcacccctagaaaaagtctgtctccacgactccacgcatgcttcagcttcacggagacacggttcacgccgcgatccgggatcgctctctctttgggctaccggctccgccgccgctccgccgccctaagccaggtgctgaaggccttcgtcggtcttttcaccggcgacgacgacccactaggaaaagaattttcctggcatatttttgtttccagaaatattcgtgtcaagttggtatgtcagggatcacagcaatttggcgtcggtcatgtccattagctgctagtcagattctaatggagacatattttggcccatctgtatcttctggtgttctgaggtggttcagcagcggcactaagcactcaagaaaacctgaattttctgttgctaaccatatcaggggtggtggatttgcattctgcttctgcagttaattatgtgtcaacgatcagaaggttgcccctttcatgccgtatggacactaatgggttgattactccaaagtccagactggtgcattgcaggattcttaggggttcaagcctcatcgggaatcccccagatctgga

SEQ ID NO: 71195 - protein, 66 aa, Zea mays
  misc_feature: Ceres CLONE 1552242
MSGITAIWRRSCPLAASQILMETYFGPSVSSGVLRWFSSGTKHSRKPEFSVANHIRGGGFAFCFCS

SEQ ID NO: 71196 - DNA, 645 bp, Zea mays
  misc_feature: Ceres CLONE 1552243
  misc_feature: Encodes the peptide sequence at SEQ ID NO. 71197
  misc_feature (273)..(273): n is a, c, t, g, unknown, or other
aagctggagctccccgcggtggcggccgctctagaactagtggatcccccgggctgcaggaattcgtctcacccctagaaaaaaagccgcgtggagccctcatccagatcggagccagcgcgccgtgtgatgccgttccggccgtgggagtagctgtcttgcccccgacccaggagccatggcggaggatggcgaggagaagctgctcgcgacggtgcagcgcatcgtgcagacgctggggagcagcgacaccatgacgggagacatcctcanggtgtttctcaactacgacgggcgcctctcgctcgacaagctctacgccgcgcgcgtcgccgctgcggcgctgcgtcgtggttgccccaggagagggggaaaaaaaaaatttgtaccaaaaccttcaatcccaaattcccccgccccggggggggggggttccggcccaggggcccaagccccccggtcccttttattgggcggaacctggccccccttggacccccaaatttcccaattttttggccctggacccgcttattttgggggaatccccccaaacggaacccttttctggggggggggaaaaatttttttcggccccttgggaggtttgggcccccgggggaaaaaaccccccctttttaaacc

SEQ ID NO: 71197 - protein, 155 aa, Zea mays
  misc_feature: Ceres CLONE 1552243
  misc_feature (32)..(32): Xaa is any aa, unknown, or other
MAEDGEEKLLATVQRIVQTLGSSDTMTGDILXVFLNYDGRLSLDKLYAARVAAAALRRGCPRRGGKKKFVPKPSIPNSPAPGGGGSGPGAQAPRSLLLGGTWPPLDPQISQFFGPGPAYFGGIPPNGTLFWGGGKIFFGPLGGLGPRGKKPPLFK

SEQ ID NO: 71198 - DNA, 637 bp, Zea mays
  misc_feature: Ceres CLONE 1552250
  misc_feature: Encodes the peptide sequence at SEQ ID NO. 71199
  misc_feature (381)..(381): n is a, c, t, g, unknown, or other
ctccccgcggtggcggccgctctagaactagtggatcccccgggctgcaggaattcgtctcacccctagaaaaaacgcctcttctccccccaaaaaaatccagcagcagcagcaagccccacgcaacattagcagcaggagaccaccccaatcccccacggacattcgccgcgaacccttatctgcacgccgcgccatggccgccgccgccgccgccgcggtcgcccacctctccatccacggccgcctacgccgctcaccggagcatcggccgtccatcaccaccaccaccacctcctcctcttccccgtccgctcaccgcccgtccctgctgcggtgccgcgcgttcaagcaggaggccagcgacggcgacccggctgnaggcgacgcgcgcaagcgcaggaagggcccgctgtacaagctcaaggcggcgatccagggcctcgcgggatcccgctccgccgccgccgaggtgtacggggggagagtaccagtacccagcgccccgtcgaggaaggcggaggagatattccttctcgggtggctactccgctaagccagatatggtatcactatgatgaagccgcggtggttgtaacttgggggtttgaattttccagccttgtcaggggggaaa

SEQ ID NO: 71199 - protein, 119 aa, Zea mays
  misc_feature: Ceres CLONE 1552250
  misc_feature (62)..(62): Xaa is any aa, unknown, or other
MAAAAAAAVAHLSIHGRLRRSPEHRPSITTTTTSSSSPSAHRPSLLRCRAFKQEASDGDPAXGDARKRRKGPLYKLKAAIQGLAGSRSAAAEVYGGRVPVPSAPSRKAEEIFLLGWLLR

SEQ ID NO: 71200 - DNA, 669 bp, Zea mays
  misc_feature: Ceres CLONE 1552251
  misc_feature: Encodes the peptide sequence at SEQ ID NO. 71201
  misc_feature (348)..(348): n is a, c, t, g, unknown, or other
  misc_feature (354)..(354): n is a, c, t, g, unknown, or other
  misc_feature (385)..(385): n is a, c, t, g, unknown, or other
ctggagctccccgcggtggcggccgctctagaactagtggatcccccgggctgcaggaattcgtctcacccctagaaaaaggtgcttcggcttcctttcgcgcccaattggaggcacaccccgcaataaaaaaaaatgagaattcgatgcgacaaacaagctcaaatgcttggtcggtccttttgaaggttcgagaccagccatgtcctcggcgccctgctggcctcctcgccgttgctggcgcgcgcctgggaccgctgcacagccgcctccgccgcagcgccgtggttcgttcacggcgaagacggcggcaaggtgtacgtgggggtctctggggtgcaggctgcncttacngcggcagggcccgcggtggccggcggcggcnccgacatcttcgcgccggtgagtctcggcggggacgccgcgggccggatgttcgcgccgctggtcgccgccgacccgacccggccgctaccggggagccggttgccgtgcaggccctggcgctgcagtgcttcctgaaactctgctgcaatcctgattttccgatgcttctgaatcagatcaggggcaaggcattcgtgttcaccggccacttcccttggggggccccctttgcggccctcacgggccttccccataccttgtggatctcatcggcaaggctcc

SEQ ID NO: 71201 - protein, 174 aa, Zea mays
  misc_feature: Ceres CLONE 1552251
  misc_feature (68)..(68): Xaa is any aa, unknown, or other
  misc_feature (70)..(70): Xaa is any aa, unknown, or other
  misc_feature (80)..(80): Xaa is any aa, unknown, or other
MRQTSSNAWSVLLKVRDQPCPRRPAGLLAVAGARLGPLHSRLRRSAVVRSRRRRRQGVRGGLWGAGCXYXGRARGGRRRXRHLRAGESRRGRRGPDVRAAGRRRPDPAATGEPVAVQALALQCFLKLCCNPDFPMLLNQIRGKAFVFTGHFPWGAPFAALTGLPHTLWISSARL

SEQ ID NO: 71202 - DNA, 648 bp, Zea mays
  misc_feature: Ceres CLONE 1552253
  misc_feature: Encodes the peptide sequence at SEQ ID NO. 71203
ctccccgcggtggcggccgctctagaactagtggatcccccgggctgcaggaattcgtctcacccctagaaaaacttttccggctgcgccttcccctcgcagccgccagccctcaacgttcctaccagctgccaccgcctgttacccgtgatgtctcccgcccttgccgctggcgtggagcccatggccgtcgacgattccgcctccaagaaggccaagcgcaagcagctcaaggccgccgccgccgccgcggaggcagaggcggaggccgcttcggtcaagaagaaagagaagaaagagaagaagcgaaaggtgaaggagccgtcccctccgctcccatcggccgcgtcctctgatgaggaagagaaaagcagcaccagctccgaggagacagcacccgcggcgaaaaaagcgaagaaggagaagacgaagaagaatgttgatgtctcgtcttcagcctcagatgacgatggcgagatcacagccagcagcgatgaggaccccgcggacccgaacgcgctgacgaacttcaggatatcggagtcgctgaggcagagcctcaggtccaaggggatcaagtcactgttcccccatcaggccaccactttcgatctcgtactcgatggcagcgacttggtttgccgagcc

SEQ ID NO: 71203 - protein, 166 aa, Zea mays
  misc_feature: Ceres CLONE 1552253
MSPALAAGVEPMAVDDSASKKAKRKQLKAAAAAAEAEAEAASVKKKEKKEKKRKVKEPSPPLPSAASSDEEEKSSTSSEETAPAAKKAKKEKTKKNVDVSSSASDDDGEITASSDEDPADPNALTNFRISESLRQSLRSKGIKSLFPHQATTFDLVLDGSDLVCRA

SEQ ID NO: 71204 - DNA, 658 bp, Zea mays
  misc_feature: Ceres CLONE 1552255
  misc_feature: Encodes the peptide sequence at SEQ ID NO. 71205
  misc_feature (531)..(531): n is a, c, t, g, unknown, or other
  misc_feature (532)..(532): n is a, c, t, g, unknown, or other
ctccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctggcccctgccgacgccatcctcgtggcgagctccatcctgcacatgctcaacctcgccaacctggccgaggaggtgcagatcgcgcaccgccgccgcaacacaatcnnaggaaaggtggcttcgccgacgaaggctccgccaccaccgagtccgacatcgaggaagacgctcagcgccctcgtgtccgaagtcggcaagtccccccgaggaaggtgttcgaggcgctcaagaac

SEQ ID NO: 71205 - protein, 167 aa, Zea mays
  misc_feature: Ceres CLONE 1552255
  misc_feature: SWISSPROT Homolog: EC 4.1.1.31 Phosphoenolpyruvate carboxylase
  misc_feature (126)..(126): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLAPADAILVASSILHMLNLANLAEEVQIAHRRRNTIXGKVASPTKAPPPPSPTSRKTLSALVSEVGKSPRGRCSRRSR

SEQ ID NO: 71206 - DNA, 643 bp, Zea mays
  misc_feature: Ceres CLONE 1552259
  misc_feature: Encodes the peptide sequence at SEQ ID NO. 71207
ctccccgcggtggcggccgctctagaactagtggatcccccgggctgcaggaattcgtctcacccctagaaaaaatctgacctcgatactgagcggatcgactgtgatgtcgtcgtctgtgcttcccgctgctgcccaaccaggaactggaatcaccatacggccgcagagacaaattcctggcctatccgcatcaatttgtcaagtacctcgtctcgtctaagaatgctgctgaccacatgatccgcatactctccggattagacgagtactctcctccatcctcaaagatcacctcttccgatcacgagaccttactgccacatccgcctcagagatctgtgccgctgacgcctcttatcacgctctttgatggctcgtctctctctgggacacgtccaggacgcgctctgtcttcgaggactccgaggacgaatctctcaggacatctctgcgtggacgagacatcaacatcttgctcacgcagcctgaggagaccagttccacctcaccaaccctcccatgggtccctcagggacgagctatgctacacatggcttgcaagccataccaatatgctcggggcctgttctttctatttcatgctttcgaaggatgctaaaaagctctaggctgatcctat

SEQ ID NO: 71207 - protein, 40 aa, Zea mays
  misc_feature: Ceres CLONE 1552259
MGPSGTSYATHGLQAIPICSGPVLSISCFRRMLKSSRLIL

SEQ ID NO: 71208 - DNA, 661 bp, Zea mays
  misc_feature: Ceres CLONE 1552260
  misc_feature: Encodes the peptide sequence at SEQ ID NO. 71209
gctccccgcggtggcggccgctctagaactagtggatcccccgggctgcaggaattcgtctcacccctagaaaaagattgttcctccccatgttcctcgcgttcccgtgaggccgtgacgcccccctcggcctcgcctcgccatcgctcgcggcatcgccgcctgccccctttcccccacgcgaataaagcgccggaagcgcgccccccaagcaaagtcctccggcgctcaggatcgggagccaccccctagggttagggctccgttttgcctcgttccggcgtcgaccgatgcgcggcgcatggcgacggtgaactgcctctacgtcgcggccgcctccacggcggtaagcaccgctgctctgcagtggtgggcgtcctcgctcctcgacggcgacgctggggccggcggggatggagactggcttggagccgtgctgcggtcaagggtcaccgtcgcgctcctggcgaatctggcggcccacgtgttcgtcgttgtcatcctcgcgctcaagactatattttttgttcagctaacttctgtagagaccagaaaagtgttggagcacatcattaactatgtacttcacaagggaacttttctcccgctggctgtgcctccaaacttctcaacaattatcctttggtcaacttggttggtc

SEQ ID NO: 71209 - protein, 120 aa, Zea mays
  misc_feature: Ceres CLONE 1552260
MATVNCLYVAAASTAVSTAALQWWASSLLDGDAGAGGDGDWLGAVLRSRVTVALLANLAAHVFVVVILALKTIFFVQLTSVETRKVLEHIINYVLHKGTFLPLAVPPNFSTIILWSTWLV

SEQ ID NO: 71210 - DNA, 655 bp, Zea mays
  misc_feature: Ceres CLONE 1552261
  misc_feature: Encodes the peptide sequence at SEQ ID NO. 71211
  misc_feature (344)..(344): n is a, c, t, g, unknown, or other
  misc_feature (352)..(352): n is a, c, t, g, unknown, or other
ctccccgcggtggcggccgctctagaactagtggatcccccgggctgcaggaattcgtctcacccctagaaaaaaagcggcactcgcacgatcaatgtacacattgcccgtccgtgccaccacatccagcatcgtcgccagcctcgccacccccgcgccgtcctcctcctccggctccggccgccccaggctcaggctcatccggaacgcccccgtcttcgccgcccccgccaccgtcgtgtaaacgggacggcgggcagctgaggagtcaaacgagagagatcgagagagaaagaaagggagggcatccaccagccggcggcaataagaggggaggagagagnagccaaanaaaaaggaggagagaagaagaagatgagcagctgcctctgccttccgaaaaaaaaagaggggccagcgaaggaagagccgtccacagatacccccacctcgtcactccttcagaacaagaagcccttcaaacttcaacttcctcctccaaggcttcccccaaagggatggaccccacccttcaagcccttgaaaaacgggtcccaaaattcaaaaaccaggttcttaaaaaaaacccgaagttttcaaaccccctagggccggccaaacccccagaacatggggttccccctcccccaccccc

SEQ ID NO: 71211 - protein, 49 aa, Zea mays
  misc_feature: Ceres CLONE 1552261
MYTLPVRATTSSIVASLATPAPSSSSGSGRPRLRLIRNAPVFAAPATVV

SEQ ID NO: 71212 - DNA, 662 bp, Zea mays
  misc_feature: Ceres CLONE 1552262
  misc_feature (318)..(318): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (324)..(324): n is a, c, t, g, unknown, or other
  misc_feature (325)..(325): n is a, c, t, g, unknown, or other
  misc_feature (326)..(326): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
ctcaccgcggtggcggccgctctagaactagtggatcccccgggctgcaggaattcgtctcacccctagaaaaaataataagcgaggccgagctggctgccatacataggtattgtgtggtgtgtgtgagagagagagaaacagagttcttcagtttgctatctctctctgcatgtttggcgtcagtctttgtgctcatgtacgtacgtgtgtctacctgcatgttggttgatccgattgcatctgctgtaaccatatattaattggtccacgatgatatgatttgatactatatatatactaaaaccggacttcttntnnnnnnnnnnnnnnnnnnnnnnnnnnnnnnnnnnnnnnnnnnnnnnnngggggggggnnnnnnnnaaaatgtgtgtccccaaatcccctaaaaaggggtcccgccttggggattatcccctcttccctttctttctccgggggccttatccgttggctgaaaaaaaaaaaacctgcggcccggagggtcccccccccccggcggggggaatttccccctcccgggggaaaaaaacccaccctaacccctccggggttttaataacccccaagtcccaaccccccccgttgttccccgtcccccgggagtttttgcgagaggcccccccccccccccgggcggg

SEQ ID NO: 71213 - DNA, 696 bp, Zea mays
  misc_feature: Ceres CLONE 1552263
  misc_feature: Encodes the peptide sequence at SEQ ID NO. 71214
aagctggagctccccgcggtggcggccgctctagaactagtggatcccccgggctgcaggaattcgtctcacccctagaaaaatcccttcttcaacctttgctagcttgccagggagggagtccatgaattccagcagaagcctcctctcttcgcccctctttgctagctcgtctccaaacttcaggagcagtgcttccgtctcctcctccccatccccatcccgcaccagagttccaatgatacatgacaccagcagcagcagagcatccacggcgtgccactactcgccgtcgcttgtggcagaggagcagcttcacggctccaaagacaccttgacctttaagggcgagaaggctttgctcgagttgcttctaggcatggctctggaccagcacgttgacggcaggaagctcattacccaacaggaggctgaggatagtgatttcgagagctatttgagagaagcacaagccgagtgctttaccagccaacattcatgtacgggacttctgaatttattagcagtgaaaaaggatgatgatgattctatttcggagagctctttcggcatcattgggccaaaccagctggaacttttggatctttggcaagctgaaccgaagggaaccccgaggtggatgtaaccacagcccttccccggccggagggtggggaatcccaaaccattgtcgat

SEQ ID NO: 71214 - protein, 135 aa, Zea mays
  misc_feature: Ceres CLONE 1552263
MIHDTSSSRASTACHYSPSLVAEEQLHGSKDTLTFKGEKALLELLLGMALDQHVDGRKLITQQEAEDSDFESYLREAQAECFTSQHSCTGLLNLLAVKKDDDDSISESSFGIIGPNQLELLDLWQAEPKGTPRWM

SEQ ID NO: 71215 - DNA, 621 bp, Zea mays
  misc_feature: Ceres CLONE 1552368
  misc_feature: Translation starting site: 118
cgattgggtaccgggccccccctcgagccactgcagtggtaaaggtagcgcaccaatcccatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccatatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccgcccgcctgaactccacgagcccaagaagaccgtcaaggcggagtagcggcgctgctgccttgcttctcgtgctgctgttcctggattggagagagcagtgggatcagttcgttgtgatgttccaccgctacaaggagaagacagagaaggaactccaagcagcggtgcggcttcagacggcagcacgagggttcctggcacgccgccaggtacagtcccttcgtggggagaaaca

SEQ ID NO: 71216 - DNA, 658 bp, Zea mays
  misc_feature: Ceres CLONE 1552369
  misc_feature (430)..(430): n is a, c, t, g, unknown, or other
  misc_feature (445)..(445): n is a, c, t, g, unknown, or other
  misc_feature (484)..(484): n is a, c, t, g, unknown, or other
ggggaccgggccccccctcgagccctgcagtggtaaaggccggagcaccccctccccgtctccagccccagtctcggtccccccggacttcgatatcttcggagaccgcctgcatgctcaaatcgtagacactctgggtaggcgcaaggtggagatccgtccgggcacggatcaatttcttcgttcgctggtactcaggctctaatatttttacaaaatcgatggaaagttctaaatctcctcagtcatcaaaaaacagtcggattgtggtgccttctgatagcaatcgctcccgatttgacaatgacggtttttgttcagaaactgcatcaaatcaaatggttgtgttcaactctgaagcagcagatgaactgggagacaaccgtttgcagaagtcagtgataacaaaggcgatatcaccatctattgnagcattcactgtccnatgtgctaaatgttttaatggaagcttatttccacaaangcagaattcgaagaaattcgtgaacgtattaaaccaggaaccttttggatttcaaaaaagctcgggaaatggaaacctgaaattacctgcaagggcccccaaaaaatttttcccaggaccggaaccgggttttttggcttttttgaaaaaacccaattttgcccaacccccccc

SEQ ID NO: 71217 - DNA, 646 bp, Zea mays
  misc_feature: Ceres CLONE 1552382
  misc_feature: Encodes the peptide sequence at SEQ ID NO. 71218
cgattgggtaccgggccccccctcgagccctgcagtggtaaagggtggtgtggactcctgcactgtgctccttcgtctcctcctcccctgcctgccaccaactgccaaggtgccaagcaagtgcagataccttccctgcctcacaaacaacgccatcagggtcttcaaccagggcaggttctcttctttcattcagctatgggcaacctgtgctgctgtgttcaagttgaccagtcgactgtggccatcagggagcagtttggcaagtttgacagcgtgcttgagccaggatgccactgcatgccttggttcgccggcaagcgtgtagctgggcatctcacactcaggctgcagcaactggatgtgcgctgtgagacaaaaacaaaggacaatgtttttgtgaatgtggtggcatctattcagtaccgcgctctggctgacaaagcaagtgacgctttctacaaactgagcaacacaaggtcccagatccaagcctacgtctttgacgtgatcagagcaagcgttcccaagctccatttggacgatgctttcgagcagaaggacgagatcgcaagggcggtggaggaagagcttgagaaggccatgtcggcttatggctttgagatcgtgcagactctcatcgtgg

SEQ ID NO: 71218 - protein, 149 aa, Zea mays
  misc_feature: Ceres CLONE 1552382
  misc_feature (8)..(149): Pfam Name: Band_7 Pfam Description: SPFH domain / Band 7 family
MGNLCCCVQVDQSTVAIREQFGKFDSVLEPGCHCMPWFAGKRVAGHLTLRLQQLDVRCETKTKDNVFVNVVASIQYRALADKASDAFYKLSNTRSQIQAYVFDVIRASVPKLHLDDAFEQKDEIARAVEEELEKAMSAYGFEIVQTLIV

SEQ ID NO: 71219 - DNA, 630 bp, Zea mays
  misc_feature: Ceres CLONE 1552384
  misc_feature: Encodes the peptide sequence at SEQ ID NO. 71220
cgattgggtacgggccccccctcgagcactgcagtggtaaaggggctctgcatccaccttactccctccagctctcagttctcccttcgccgccgccgggtactcggcgctccatccaggcactccagctctaccccccttccccccgccgtcgggtactcggcgctccatccaggcgtcccctccccgcggccgcctgctactcgttccggcgctccatccagcgtactccctccagctccagtctccggcgcgatgaagatcgcggtggaggggtgcatgcatggggagctggacatagtctatgacacgctgcgaaggctcgaggaggccgagggcgtcaagattgacctcctcctctgctgcggcgatttccaggctgttaggaatgagaacgatttacagtgtgttagcgttccacaaaagtatcgtaccatgaacacattttggaagtactactcaggagaagcagttgctccgtacccaaccatctttattggtggaaaccacgaagcatccaattatctgtgggaattgtactatggaggatgggcagcacctaacatatactttttggggtttgctggtgttgttaagtttggaaacatacgaattggtggattgtcagga

SEQ ID NO: 71220 - protein, 125 aa, Zea mays
  misc_feature: Ceres CLONE 1552384
MKIAVEGCMHGELDIVYDTLRRLEEAEGVKIDLLLCCGDFQAVRNENDLQCVSVPQKYRTMNTFWKYYSGEAVAPYPTIFIGGNHEASNYLWELYYGGWAAPNIYFLGFAGVVKFGNIRIGGLSG

SEQ ID NO: 71221 - DNA, 638 bp, Zea mays
  misc_feature: Ceres CLONE 1552399
  misc_feature: Encodes the peptide sequence at SEQ ID NO. 71222
cgattgggtacgggccccccctcgagccactgcagtggtaaaggggccttagtgtactggagtgttcgaggcttcccctccccactagctacagtaccacctcagcccaggtcccttcgcctccgctcaactgccgccgcagggcccgctgcaggcttccatgtgtggtagggcccggtgtaccctcagcccggccgaggttgccagggccttcggcttccccaccacctccgccaacgcgggcggcggtggtgacggccccgctgtgccgacgctccatcttaaccggttccggccgtcgtacaatgtgttgcctggggcgtacctgcctgtgggcgccatgcgggcactaccaggttgcgcccacggaggaggaggttcggatggggaggggccggtgatccagtgcatgaagtgggggctggtgcccagcttcaccggcaaggccgagaaacccgaccatttcaggatgttcaatgccagatcagagtccgtaaaagaaaaggtttcattccgtcgactaattcaaaaaaataggtgccttgttgcagtagaagggttttatgagtggaaaaagaatggatcaaaaaaacagccatactacatacatttccaagatcataggcctcttgtctttg

SEQ ID NO: 71222 - protein, 159 aa, Zea mays
  misc_feature: Ceres CLONE 1552399
  misc_feature (1)..(159): Pfam Name: DUF159 Pfam Description: Uncharacterised ACR, COG2135
MCGRARCTLSPAEVARAFGFPTTSANAGGGGDGPAVPTLHLNRFRPSYNVLPGAYLPVGAMRALPGCAHGGGGSDGEGPVIQCMKWGLVPSFTGKAEKPDHFRMFNARSESVKEKVSFRRLIQKNRCLVAVEGFYEWKKNGSKKQPYYIHFQDHRPLVF

SEQ ID NO: 71223 - DNA, 641 bp, Zea mays
  misc_feature: Ceres CLONE 1552432
  misc_feature: Encodes the peptide sequence at SEQ ID NO. 71224
cgattgggtaccgggccccccctcgagccactgcagtggtaaaggcgaggcaaaagcattgcgaccacagacagcgcgcgcttcaaggcctttttttttgagataacaaggaggagatggcggtcacgatcacgtgggtgaaggcgaggcagatcttcgacagccgcggcaaccccaccgtcgaggtggacgtgggcctcagcgacggcagctacgcgaggggggccgtacccagcggcgcatccactggaatatatgaggccttggagttgagggatggaggatctgattatcttggcaagggtgttcttaaggctgtcagcaatgtaaataacattattggaccagcaattgttggaaaggaccccactgagcaggttgagattgacaacttcatggtccaacagcttgatggaacctccaatgagtggggctggtgcaaacagaagcttggagcaaatgccatccttgcggtttcacttgctgtgtgcaaagctggagctatggtgaagaagattcctctttaccagcacatcgcaaatcttgctgggaacaaaactctggtgctccctgtacctgcctttaatgtgattaatggagggtcacatgctggaaacaagcttgccatgcaggagttcatg

SEQ ID NO: 71224 - protein, 175 aa, Zea mays
  misc_feature: Ceres CLONE 1552432
  misc_feature (4)..(140): Pfam Name: Enolase_N Pfam Description: Enolase, N-terminal domain
  misc_feature: SWISSPROT Homolog: EC 4.2.1.11 Phosphopyruvate hydratase
MAVTITWVKARQIFDSRGNPTVEVDVGLSDGSYARGAVPSGASTGIYEALELRDGGSDYLGKGVLKAVSNVNNIIGPAIVGKDPTEQVEIDNFMVQQLDGTSNEWGWCKQKLGANAILAVSLAVCKAGAMVKKIPLYQHIANLAGNKTLVLPVPAFNVINGGSHAGNKLAMQEFM

SEQ ID NO: 71225 - DNA, 670 bp, Zea mays
  misc_feature: Ceres CLONE 1552444
  misc_feature: Encodes the peptide sequence at SEQ ID NO. 71226
  misc_feature (568)..(568): n is a, c, t, g, unknown, or other
ccgaattgggtaccgggccccccctcgagtcactgcagtggtacaggtgtccctgactgaaagcgacccagggcgaggctatcaagaactactaccacgacaaccatgtgatccaggacatgctggtgccgctgtacaaggttggggatgcgctggagttcgtgcaccgcgagatggaggtgtatcctctgtggctgtgccctcaccggctgtacaagctgccggtgaagacgatggtgtacccggagcctgggttcgagcaccagcacaggcagggcgacactagctacgcacagatgttcacagacgtgggcgtgtactacgccccctgggcggtgctgaggggggacgagttcaacggcgcggaggctgtgcacaggctggagcagtggctgatctagaaccacaggtaccagccgcaaaacgcggctgtcggagctgaaccaaaaggatttctgggacaatgtcgaaccgtcccattaaaaaccctgcccgcaaaaaaaacggggccgggggcacacgtacaaaaagcgtggttctacaaacccaaaaaaggggcccaaaaaanggaaaaaggaaggccaaaaaagcagaaggccgcccatactgggaggcggggctttatacgaaaaaaaagaggcctaaaaaaccccggggggctttttttgct

SEQ ID NO: 71226 - protein, 93 aa, Zea mays
  misc_feature: Ceres CLONE 1552444
MLVPLYKVGDALEFVHREMEVYPLWLCPHRLYKLPVKTMVYPEPGFEHQHRQGDTSYAQMFTDVGVYYAPWAVLRGDEFNGAEAVHRLEQWLI

SEQ ID NO: 71227 - DNA, 642 bp, Zea mays
  misc_feature: Ceres CLONE 1552450
  misc_feature: Encodes the peptide sequence at SEQ ID NO. 71228
  misc_feature (591)..(591): n is a, c, t, g, unknown, or other
cgattgggtaccgggccccccctcgagccactgcagtggtaaaggttcgccagattcggagttttctgggattggctggttattaccgaagatttattccggacttctctcgaattgcgaagcctattactgagttgctgaagaaagaagtcaaatttgtgtggagtcagaagtgcgaagatgccttccatgcattaaggcagcatctgaccacagcaccagtattggcgcaacccgacagcagcaagccttttgatgtatattgtgatgcctctggcaccgggctaggttgtgtcttgatgcaagacaaccgagttattgcttatacctcaagagcactcaggcctcatgagcagaattatcccactcatgaccttgagttagcagcagtggttcatgcattgaagatgtggaggcactatctaatgggaacccactgcaacatcttcactgatcataagagccttaagtacatttttactcaggctgatctcaacatgaggcagagaagatggctagagctgatcaaggattatgacctggaggtacattatcacccagggaaagctaatgtggtagcagatgccttgnagtcggaagttgcaatgcaactgtattctgatggattctcatgttaacacc

SEQ ID NO: 71228 - protein, 211 aa, Zea mays
  misc_feature: Ceres CLONE 1552450
  misc_feature: SWISSPROT Homolog: EC 2.7.7.49 RNA-directed DNA polymerase
  misc_feature (197)..(197): Xaa is any aa, unknown, or other
IGYRAPPRATAVVKVRQIRSFLGLAGYYRRFIPDFSRIAKPITELLKKEVKFVWSQKCEDAFHALRQHLTTAPVLAQPDSSKPFDVYCDASGTGLGCVLMQDNRVIAYTSRALRPHEQNYPTHDLELAAVVHALKMWRHYLMGTHCNIFTDHKSLKYIFTQADLNMRQRRWLELIKDYDLEVHYHPGKANVVADALXSEVAMQLYSDGFSC

SEQ ID NO: 71229 - DNA, 624 bp, Zea mays
  misc_feature: Ceres CLONE 1552456
  misc_feature: Encodes the peptide sequence at SEQ ID NO. 71230
  misc_feature (426)..(426): n is a, c, t, g, unknown, or other
  misc_feature (456)..(456): n is a, c, t, g, unknown, or other
  misc_feature (485)..(485): n is a, c, t, g, unknown, or other
cgattgggtaccgggccccccctcgagccactgcagtggtaaagggaagtctcggcggcgccggcgtgcttgtgatctcaacccaagtcgtgactccgatccggtcacccgtcgctccacgcaaccatgtcgaggaggaagacccgggagcccaaggaggagaacgtcacccttggacccactgtccgtgaaggagagtatgtctttggtgtcgctcacatctttgcatccttcaatgacaccttcattcatatcaccgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcacattatgcttcgtgccaccggnagcaagcagacctagacgcccggacctggntgccagtctgtcctcagggcgcttgctcngtctgggatgaaaaatcgacgcattgaggacgtgaccccgtccgcactgaaagcacttcgagaaaagccgttggaagggaaagaagcttgtagcgtcccttctggtggcatttgccgggtcctggcggtgggcttaata

SEQ ID NO: 71230 - protein, 104 aa, Zea mays
  misc_feature: Ceres CLONE 1552456
  misc_feature (28)..(105): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALHIMLRATGSKQT

SEQ ID NO: 71231 - DNA, 639 bp, Zea mays
  misc_feature: Ceres CLONE 1552461
  misc_feature: Encodes the peptide sequence at SEQ ID NO. 71232
  misc_feature (1)..(1): n is a, c, t, g, unknown, or other
ncgattgggtaccgggccccccctcgagccctgcagtggtaaaggtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatggagagtggtgccaagggttgtgaggtgattgtgagtgggaagctcagggcccaaagagccaagtccatgaggttcaggatggctacatgatctcatctggtccgccagtga

SEQ ID NO: 71232 - protein, 156 aa, Zea mays
  misc_feature: Ceres CLONE 1552461
  misc_feature (45)..(102): Pfam Name: KH_2 Pfam Description: KH domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMRFRMAT

SEQ ID NO: 71233 - DNA, 642 bp, Zea mays
  misc_feature: Ceres CLONE 1552468
  misc_feature: Encodes the peptide sequence at SEQ ID NO. 71234
cgattgggtacgggcccccctcgacccccacgggtgaaggcttttttgggatctttcggttgcgggccagggcttctatcgatgaaggaagcagggtctttttcggggtcaataaggtgccgtctaagtcgagagcaatcacgcgtgtggtcatggcgtattccagattaaggttaagaattttcgtctgcgcgaatggtacaccgataccactatcggacaaaattctgcgttttaattcagcattcaccgccaaaagcgactaattttagctgttacagtcagttgctaaatgcaaaggagcattcatgaagcaaacagtttatatcgccagccctgagagccagcaaattcacgtctggaatctgaatcatgaaggcgcactgacgctgacacaggttgtcgatgtgccggggcaggtgcagccgatggtggtcagcccggacaaacgttatctctatgttggtgttcgccctgagtttcgcgtcctggcgtatcgtatcgccccggacgatggcgcactgacctttgccgcagagtctgcgctgccgggtagtccgacgcatatttccaccgatcaccaggggcagtttgtctttgtaggttctttacatgcgggtaacgtgagcgtaacgcgtctgg

SEQ ID NO: 71234 - protein, 87 aa, Zea mays
  misc_feature: Ceres CLONE 1552468
IGYGPPSTPTGEGFFGIFRLRARASIDEGSRVFFGVNKVPSKSRAITRVVMAYSRLRLRIFVCANGTPIPLSDKILRFNSAFTAKSD

SEQ ID NO: 71235 - DNA, 638 bp, Zea mays
  misc_feature: Ceres CLONE 1552469
  misc_feature: Encodes the peptide sequence at SEQ ID NO. 71236
  misc_feature (638)..(638): n is a, c, t, g, unknown, or other
cgattgggtccgggcccccctcgagccactgcagtggtaaaggggctcgttcttcctcttctcttctttgcgttttgggccggttttctgcatccacgattttgtggagtttgatcgtctcttaccaagaggggtgtaaccttgtttcatttgcgaaatttgagggcaccttgaagttgtttcgatcgctgggttgctttactcaggcttagttcatgggtgttcgtgtttttgagtattctttatttggtgttggcagattgccctggaacgcagtcggaggaggcggggaaggcggatgcctgcgctgggtgccccaaccagcagatttgcgccaccgcccccaagggccccgatcccgatgtggttgctattgttgagaggttggctactgtgaaacacaaattattagttttgtctggaaagggaggtgttggaaagagcacattctcagcccaactctcctttgccttagctgaaatggaccatcaggttggccttcttgacatagatatatgtggccctagcatcccaaaaatgttaggcctcgagggacaagatattcatcagagcaaccttggttggtcacctgtgtatgtcgagtccaccttggcgtgatgtcgattggtttcatgctn

SEQ ID NO: 71236 - protein, 45 aa, Zea mays
  misc_feature: Ceres CLONE 1552469
MDHQVGLLDIDICGPSIPKMLGLEGQDIHQSNLGWSPVYVESTLA

SEQ ID NO: 71237 - DNA, 651 bp, Zea mays
  misc_feature: Ceres CLONE 1552472
  misc_feature: Encodes the peptide sequence at SEQ ID NO. 71238
cgattgggtccgggccccccctcgagccactgcagtggtaaaggtcgccctcgtaatcaatctccgcctccctgcctgcttaccccgaccccgtcggcatctcggagaatcgcggcggtcaaagcccagcctaccccacctcgcgccgcgtcgccgcggtttccgcgggccagtgctctcgggagtcgggagctcagatcaggagggacgggctaggtagggttcgcgagcgagcgagggtgctgccgtccggcgccggtgtccgagtagcaagaggagagatggacgcgttcctgcagaggctcaagcggttggacgcgtaccccaaggtgaacgaggacttctacaagcggacgctctccggcggcatcgtcacgctcgtcgccgccgtcgtcatgctgcttctcttcatctccgagaccaggtcatatttttattcagcaacagagactaagttagttgtggacacatcaagaggagaaaggctacgagtaaattttgatattacttttctgagcattccttgcaccctcctcagcgttgatacaatggatattagtggagaacagcaccaggacattaggcatgacatcgaaaagatacgattagatgcacatggtaatgttattgaagcaagaaaagttagcattg

SEQ ID NO: 71238 - protein, 123 aa, Zea mays
  misc_feature: Ceres CLONE 1552472
MDAFLQRLKRLDAYPKVNEDFYKRTLSGGIVTLVAAVVMLLLFISETRSYFYSATETKLVVDTSRGERLRVNFDITFLSIPCTLLSVDTMDISGEQHQDIRHDIEKIRLDAHGNVIEARKVSI

SEQ ID NO: 71239 - DNA, 677 bp, Zea mays
  misc_feature: Ceres CLONE 1552476
  misc_feature: Encodes the peptide sequence at SEQ ID NO. 71240
  misc_feature (309)..(309): n is a, c, t, g, unknown, or other
cgattgggtaccgggccccccctcgagcactgcagtggtaaaggcattgtctccgccgcgatttgtcaacgtgacgtcacgccgcgcctccgagagggagccagtgtggtggaggacacgaggctgccggagccgcaggaggcaggtgttgctccggtcagcatcggcatggcggggcggatggtgcggagctgcgtgcagacggcgctcaaggcggccaactccgtcgtggggctcgccggcatggccgtcatcctctacgcgctctggatgctccgcgcttggtacagggagggtcgcgtactccancgacactgccggtcccctggtgcatctacacatttctggactggggatctttctgtgcctactgacttgctctggccttttgcttcccaaactgcaaagggccccgcccccctgggggaccctttgagcgaaaaaaccgggggttaaatttgtcttaaaaccccccttccttttttttggttttttcggcgcccccctgggggggtgggggaaaaactggggcgcccttttttaaaaacccccccccccccccggggggggtttgtttgcccaccccaaaaaaaaaaaagggggcccccccctccccccccccagggttttttgggggggaaaacaaacccttttttttggggggaaaaaaaaaaaaa

SEQ ID NO: 71240 - protein, 95 aa, Zea mays
  misc_feature: Ceres CLONE 1552476
  misc_feature (47)..(47): Xaa is any aa, unknown, or other
MAGRMVRSCVQTALKAANSVVGLAGMAVILYALWMLRAWYREGRVLXRHCRSPGASTHFWTGDLSVPTDLLWPFASQTAKGPAPLGDPLSEKTGG

SEQ ID NO: 71241 - DNA, 698 bp, Zea mays
  misc_feature: Ceres CLONE 1552510
  misc_feature: Encodes the peptide sequence at SEQ ID NO. 71242
  misc_feature (289)..(289): n is a, c, t, g, unknown, or other
  misc_feature (691)..(691): n is a, c, t, g, unknown, or other
  misc_feature (697)..(697): n is a, c, t, g, unknown, or other
cgattgggtaccgggcccccctcgagccctgcagtggtaaaggtcgggcagcggtagccggtaggcgagagagtcaggattcaggacgcggcgaggccaccatgagcactctcaagttctgccgggaatgcaacaacatgctgtacccgcgggaggacaaggagacgcgcaccctcctgtacgcgtgccaaacgtgcgagcatgaggagattgccactgatacttgtgtgtacaaaagggttatccgtaagcctggtggtgagcccaaagatgtcctgaaggatgcagncactgatcctagcctgcctcgcaccagaagcgtcagatgttaacactgcaaccatccagaagctgccttttttcaggccccgactaaggaagaaaagccctggacccttgacttattgtggtggaacccaagtcttggggcccgggggaggggacttaaaaaagttcgggttttggctttccccgaaaaccccccctttttttacccccagcacaattttgcccccccaaagaggttttgtccggctttttaaacactatataaccccccaaaaaaaaatgttgtgtgtggggggaaaaaatttttgttttttcttttgtgaaaaaaaaaaaaaccttttttttttcccctctaaaaaaaaaaaaaaaaaaaaaaaaacccgggggaatcccccccccaggngggggng

SEQ ID NO: 71242 - protein, 76 aa, Zea mays
  misc_feature: Ceres CLONE 1552510
  misc_feature (4)..(58): Pfam Name: RNA_POL_M_15KD Pfam Description: RNA polymerases M/15 Kd subunit
  misc_feature (63)..(63): Xaa is any aa, unknown, or other
MSTLKFCRECNNMLYPREDKETRTLLYACQTCEHEEIATDTCVYKRVIRKPGGEPKDVLKDAXTDPSLPRTRSVRC

SEQ ID NO: 71243 - DNA, 518 bp, Zea mays
  misc_feature: Ceres CLONE 1552531
  misc_feature: Pfam Name: Aconitase Pfam Description: Aconitase family (aconitate hydratase)
  misc_feature: SWISSPROT Homolog: EC 4.2.1.3 Aconitate hydratase
  misc_feature (279)..(279): n is a, c, t, g, unknown, or other
  misc_feature (288)..(288): n is a, c, t, g, unknown, or other
  misc_feature (436)..(436): n is a, c, t, g, unknown, or other
ccgattgggtaccgggccccccctcgagccactgcagtggtaaaggcttcagagtggtcttcaagaatacctcaaccagcaaggattccatatcgttggctatggctgtaccacttgcattggaaactctggtgatctcgatgaatccgtatcaactgccattacagaaaatgatgttgttgctgctgctgttttgtcgagtaaccgtaacttcgagggtcgtgtgcaccctttaactcgggctaactatcttgcttcaccacctcttgttgttgcttnatgcacttngcccggaacctgttgatattggattttgaaaaaaaaacccctttggatttttggaaaaaagattggggccgaagagaaaaacctcctcctctgggagattatggccccccccaaaaaaaaaaattcgcccggggggtttccccacccnaagggggccccccccccaaaaatttttttaagggggcgccctccccttttggggtgttttcaaaaaaagggccgccccccct

SEQ ID NO: 71244 - DNA, 674 bp, Zea mays
  misc_feature: Ceres CLONE 1552536
  misc_feature: Encodes the peptide sequence at SEQ ID NO. 71245
  misc_feature (398)..(398): n is a, c, t, g, unknown, or other
  misc_feature (399)..(399): n is a, c, t, g, unknown, or other
  misc_feature (401)..(401): n is a, c, t, g, unknown, or other
  misc_feature (407)..(407): n is a, c, t, g, unknown, or other
gccattgggtaccgggccccccctcgagccactgcagtggtaaaggggggaccaaaccaactcgactcatcgagttccacagctctcgcgtcgcgcgcagccaatccctctccctccggcctacacagcccagaactcccttctccatctctctctctcgtccgtgtcgccccctgtttgtgtacaaccccatggcgacccacgccggcgagaacggcagcgggcacgcgaacggcggcgggcacgcggagtggcggttcgcgcgggcggcgaaggagggcgcgctggccgtggcgggggacaagatgagcatccgggcggtgcggttcaagatcagcgcgagcctggacgcgcgcgaccctttttcccccctgccgcgggcacagaaagacccctcnncnttcccngcctcccccaccgccgcctaggccgaagacgccgtggccgccgcgcgcgggaccggcaatttcaactgctacccctccggcgtcggcctccccgaagcccggccgtgctcctggcaaagcccttgtcgagccaccttccctacgagccgtcgagcgaccaacatctttcttcaccgccggaagggccgcaagccattcgggggggggggccgcggtcccccgtctaaccagggccccaatatactggtcccccgaggcccgggtttg

SEQ ID NO: 71245 - protein, 78 aa, Zea mays
  misc_feature: Ceres CLONE 1552536
  misc_feature (70)..(70): Xaa is any aa, unknown, or other
MATHAGENGSGHANGGGHAEWRFARAAKEGALAVAGDKMSIRAVRFKISASLDARDPFSPLPRAQKDPSXFPASPTAA

SEQ ID NO: 71246 - DNA, 645 bp, Zea mays
  misc_feature: Ceres CLONE 1552537
  misc_feature: Encodes the peptide sequence at SEQ ID NO. 71247
cgattgggtaccgggcccccctcgagccctgcagtggtaaaggtcggtagccgtcggttcacttctccaggtaaggaaagggttcgtactcatggcgccgacgcagcctaagtcgggcctcttcgttggcatctacaagggtcatgtcgtcaccaagcgcgagctgcctccccgcccgtgccaccgcaaggggaaatcaacgaagagggtgtctatggtcaggggcctgatcagagaggttgctgggtttgctccttatgacaagcgtatcactgagcttctgaaggttggcaaggacaagcgtgccctgaagcttgctaagagaaagcttggaactcacaagagggcaaagaagaagagagaggagatggcgggcgtcctcaggaagatgaggtcggctggtacgcacactgacaagaagaaatagagagcatttcaagttcatggagcctgccagagattatgttccagtgtctgattttccatacatgtagaacctaatagacatgtcaaagtattatgtatcaaaccagctcatgggattttgctcattccaatgcatccacagtttatgtatcgaaccagtttatgggatcttgctcctattgcaatgcatccatggtttgtgaaaagcaaaaagacaaa

SEQ ID NO: 71247 - protein, 111 aa, Zea mays
  misc_feature: Ceres CLONE 1552537
  misc_feature (5)..(103): Pfam Name: Ribosomal_L36e Pfam Description: Ribosomal protein L36e
MAPTQPKSGLFVGIYKGHVVTKRELPPRPCHRKGKSTKRVSMVRGLIREVAGFAPYDKRITELLKVGKDKRALKLAKRKLGTHKRAKKKREEMAGVLRKMRSAGTHTDKKK

SEQ ID NO: 71248 - DNA, 687 bp, Zea mays
  misc_feature: Ceres CLONE 1552550
  misc_feature: Encodes the peptide sequence at SEQ ID NO. 71249
  misc_feature (381)..(381): n is a, c, t, g, unknown, or other
tcccccgggctgcaggagttcgtctcacccctagaaaaaattaccaccactgaacccgctgattcccctcctcccacctatcggtttcgggaaacctctcccccgttcccctcgaagcctacgggctcggggggcttcgatcgaatcgaatcggatcggatcggaagcatggagatctcgctcgatgcgtcttgtgtgggcgtgcagcggcactggcaggacctggctgaccgactcgcacaaggcttctcagggctcctcctccatgcgcagcagccccaactgcctccatgttcgccgggggctctgttggcgcccaagctcgtcatcaccttcgagctctacctcctggttgtcacctccccccccttggttaaaccnaggggtcggggaccgtggacctccccaccgtggccgcttcggcgtttgtaaagattagtggcgggctcggggcagcggggtccgaaatcggggcgggggttttaacttcctcccgccaagttcctgggcctttggcctttccgaaaagggaagctccccaggcgccctccctgggtgaacggggaatgttccctttccttttggggtaactgttgggatcgccgaacgttcctttttggaaaagggctggtaaacctcgggttccctttggggttgtgctacggttttctttttggtgggaagccc

SEQ ID NO: 71249 - protein, 87 aa, Zea mays
  misc_feature: Ceres CLONE 1552550
MEISLDASCVGVQRHWQDLADRLAQGFSGLLLHAQQPQLPPCSPGALLAPKLVITFELYLLVVTSPPLVKPRGRGPWTSPPWPLRRL

SEQ ID NO: 71250 - DNA, 747 bp, Zea mays
  misc_feature: Ceres CLONE 1552552
  misc_feature: Encodes the peptide sequence at SEQ ID NO. 71251
gagctggagccgctccaccgatgcgctcacactctagaactagtggatcccccgggctgcaggaattcgtctcacccctagaaaaagtccgccccagtctagtccgattcaaacccgcccgttccccgtgtccgagccacgcaagccgagctcaatccccagaggccagagccagctgctcggcgctccacgccatggcgcacaaggacaccaatggcaacaacggcgagcacatctccacgcgcccgccggcgaccccgttgcccctccgcttctccaagtacttccaggctaacctgcggatcctggccactggtggggcgggcattatcggctcgacactcgtgtacaggctcatggagaacgagaagcacgacgtcattgttgctgataactttttcaccagttcacaagatcacctggagaagtggatcggaccaccaagatttgagctcatcagctatgatgtcactgagccacttcttgtggaggtcgaccagatctatcaccttgcttgccctgcttcacaaatcttgctacagcacaatcctgttaagaccgtccagacagatgttattgggtaccctcatcatgctgggacttgccaagagaagttgagccttagattttgttgacatcaacatctgaaagttaaggggggatccactggagcatcccttcaaccgaggctactgggggcattgtaaccccaattgaaactcaggatttgttattatgaagggtaac

SEQ ID NO: 71251 - protein, 146 aa, Zea mays
  misc_feature: Ceres CLONE 1552552
  misc_feature: SWISSPROT Homolog: EC 4.1.1.35 UDP-glucuronate decarboxylase
MAHKDTNGNNGEHISTRPPATPLPLRFSKYFQANLRILATGGAGIIGSTLVYRLMENEKHDVIVADNFFTSSQDHLEKWIGPPRFELISYDVTEPLLVEVDQIYHLACPASQILLQHNPVKTVQTDVIGYPHHAGTCQEKLSLRFC

SEQ ID NO: 71252 - DNA, 678 bp, Zea mays
  misc_feature: Ceres CLONE 1552556
  misc_feature: Encodes the peptide sequence at SEQ ID NO. 71253
  misc_feature (318)..(318): n is a, c, t, g, unknown, or other
  misc_feature (385)..(385): n is a, c, t, g, unknown, or other
ctccccgcggtggcggccgctctagaactagtggatcccccgggctgcaggaattcgtctcacccctagaaaaaacgacaaatcgacgatcgccgcttctcttggccattgtagagggagagagagagcgcgagcgacctaggtcagtcggtttcggttttgggcgtcagcttcagctatccgcgaccgcgacgatgggtctgcgcgtggccgccaccgcgccagctccggccggcgtgcgcgtgctcggcaggggcgccgcgcgcgtgacgccgcgaccgtgggcggctgtcggcggcaggagacgcttctccgtgncgggatgtccgtcgcgaccaccgaggccaccaccacccattcgccgtgggcgccctcggaggaccanggcgctggaggctaggaactcccaagacgggtgggtggcggtcatccctcggcccgtgggcgcccgggacccagggtcttttcccggtttaccaaaacccagggccaaaccccccgggggccaattgggggggcccgtaaaggggtttattcaaagttggccaattgagaaaactcgtttaaaacacggggggtatcaacaagggggttttattttccccccccgggtttgtaaaaaggggaaaaatccccccgaataccccccctcctccaagagagccaaatatttttttt

SEQ ID NO: 71253 - protein, 161 aa, Zea mays
  misc_feature: Ceres CLONE 1552556
  misc_feature (42)..(42): Xaa is any aa, unknown, or other
  misc_feature (64)..(64): Xaa is any aa, unknown, or other
MGLRVAATAPAPAGVRVLGRGAARVTPRPWAAVGGRRRFSVXGCPSRPPRPPPPIRRGRPRRTXALEARNSQDGWVAVIPRPVGARDPGSFPGLPKPRAKPPGGQLGGPVKGFIQSWPIEKTRLKHGGYQQGGFIFPPRVCKKGKNPPEYPPSSKRAKYFF

SEQ ID NO: 71254 - DNA, 717 bp, Zea mays
  misc_feature: Ceres CLONE 1552558
tggagctccccgcggtggcggccgctctagaactagtggatcccccgggctgcaggaattcgtctcacccctagaaaaaaaacgtgctcctatactcggatacatcttatccttgctgatttatgacctttttcttcgtaggctggccatcgcatgtagtggtctcaaattgagggagaaggggaaaccaccaccaccatggctattaataactaatgggggcgcaaacacctgcccgattccgggacttgcaatggacacctggcaggccaccgaggcgggatgctacccggtgcggacctctagaccgggacatccgtcgtagatattaggaatgctgctcattggagagactgcgacaatgagctcatgcggctcgcgcttagtcccgagcagctcttccacccactaatatccgccgcgcgcggcgatctcctcctcagcgctcgtctccgtcgacgacgcctgctgaggaacatctccaacagatatgtctagcacggcctcatgggaaggctagcgctggatacgaccacagcattacgtggactgaggaggagaactggcgattcgttacgagtttgaagaagccggcgaagggcgattagcgatgcttctccaggacttcatggctagtcagacgccgaggccgtggaccgccacagcttgtaagtcttcataccgaagacaccctgaccacaaaagaagaggttctgg

SEQ ID NO: 71255 - DNA, 685 bp, Zea mays
  misc_feature: Ceres CLONE 1552559
  misc_feature (391)..(391): n is a, c, t, g, unknown, or other
  misc_feature (658)..(658): n is a, c, t, g, unknown, or other
agctccccgcggtggcggccgctctagaactagtggatcccccgggctgcaggaattcgtctcacccctagaaaaaccttttccgctccagacacagcagcccctcttgtaccagtaaaccgtgctgctatcccccgctagccgccgcgctgctgcgggtcgactccctcctccccagaccccacgccccggcgccgccaccgccacctcctctcgctccctccttttaccacgagcttaagatcgcgcggacctgcctacctatccgtaggagaggaagacgggacaaggcccggtcggtcagactgtcggtcggggggttctcggatctcggcgctgcctccccgtacgttcgttcgttccgggggagggagcgccatggccgccatcnctgcgaccccggcccccgcgccggcaccggttcctgctcctgctcctgccaccggtgctagttcggaataaaaaccttccttcgctgccgtgcggcacagggttttgccctaccggggttacttcgcctggacccaccacggggggaaaagggttatttttcccttgatgcctccactcgcctgattgggtggcgcggcgcgtaaaagggggttccggcccccccaaggggggcctgggccaaggggacccggggggagaatcgtcngttccccactcgggcgtccccccttcg

SEQ ID NO: 71256 - DNA, 706 bp, Zea mays
  misc_feature: Ceres CLONE 1552560
  misc_feature: Encodes the peptide sequence at SEQ ID NO. 71257
ctccccgcggtggcggccgctctagaactagtggatcccccgggctgcaggaattcgtctcacccctagaaaaagtcaagtttaggaaaggaagcaccggagcaggcgaaacggcgccgacgacaatggcagcaacaagggcttccccggtgcttctcttgctgctgctcaccgtccagctgagcttgctcttccgcctccccgactccccctccaccctcgccctcgccctcgccctcgccgcggaaccagaccaacagaacgccaagcagcatcgccagcccgcgctgctggtgcagtcgacgtgcaactccaccagcttctacgacctctgcatcgccgcgctcgccgccgaccccgccagctccaccggcgacgtcccgggcctgggcggcatcgccgtgtcccccaccgcaaacaacgcctccggcacggccgccttcctcggcaacgccagcgacgccgcggccaccccgcaggcggaccgcgcgctcctccgcgcctgcgccggcaagtacggcgccgcccgcgacgcgctcgtgcaggcacgcgcgtccctcgccgagctagcctacaactacgcctttcgtgcacgtgagcgcccccggccaagtaccccgaggtgtgcccgcaggctgttccgggcgcccggaacaggagcaatggtggggcgagatagactgcctactccccgggacctggccaa

SEQ ID NO: 71257 - protein, 193 aa, Zea mays
  misc_feature: Ceres CLONE 1552560
MAATRASPVLLLLLLTVQLSLLFRLPDSPSTLALALALAAEPDQQNAKQHRQPALLVQSTCNSTSFYDLCIAALAADPASSTGDVPGLGGIAVSPTANNASGTAAFLGNASDAAATPQADRALLRACAGKYGAARDALVQARASLAELAYNYAFRARERPRPSTPRCARRLFRAPGTGAMVGRDRLPTPRDLA

SEQ ID NO: 71258 - DNA, 696 bp, Zea mays
  misc_feature: Ceres CLONE 1552561
caaagctgggctctcgcctcgcagccgtccaccaatcttcataggacccccgggctgcaggaattcgtctcacccctagaaaaatacaattctcacacgcgcgcgcccaacacaatagcctgcaggatcgtcgagcgcgaggcggctgccccgccggccggttcgttcgctctgtcgcttgagaccgatcctagctaggccgtgacgatatcggcggcgatgatgatggacgcggcgaggatcgtagagtacttctagggcaagtgcatcctcgtcaccggctcaacagggtttcttggagagatccttgtggagaagatactgcgggtgcagcctgacgtgcgcaagatttacctgcttgtacgcgcggtcgactagccatcagcgaagcagcgcgttcaacaagaggtgatatacacggagctgttcggcctgctgagagagaacacggcaagggcttccagcagttcttgaggccaaggtcgtcgctttggccggagacatcgtatacgacagcctgcggctggaggcatccgtgctggacgctctggacaggtacgtcgacgtcatcttcacgtcgctgcaacctcaacttctacgaaagatccatgtttcgctggaactgaacctgcttggagttgagcacctgttgctgttcgccttcattgcccgagcctcaggatgtcatgccttctc

SEQ ID NO: 71259 - DNA, 668 bp, Zea mays
  misc_feature: Ceres CLONE 1552562
  misc_feature: Encodes the peptide sequence at SEQ ID NO. 71260
  misc_feature (484)..(484): n is a, c, t, g, unknown, or other
tggagctcaccgcggtggcggccgctctagaactagtggatcccccgggctgcaggaattcgtctcacccctagaaaaatccgcaatctatctatctatcagccattcaggcctgcaggctgcagctctctccactgcacactagagcgagctgccacagacaaggacacaatgccacccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcccggacgtcatctgcgcggccgtgaaccgcaccgaggacgtggtggtcgccacgtccagcaactgctcgtactacctgcaggacaggtcccctgtcgggcgcgggaccngcctggccatcaacgactgcctggagctgctgtccaccacgatggacgaagctcggcgcagcaccgccgaactggcgtccccgcccggaagggggtcggcttccgcgggcgtgtccaagggccccaggccccggacaatggacccccgaatgaccgggctttcgggggccataccaaaccaaac

SEQ ID NO: 71260 - protein, 165 aa, Zea mays
  misc_feature: Ceres CLONE 1552562
  misc_feature: SWISSPROT Homolog: EC 3.1.1.11 Pectinesterase
  misc_feature (105)..(105): Xaa is any aa, unknown, or other
MPPIPKRGEHLLVLLIVACAATAATAAGTVPFYPSAESAAAAHCDGTLYPELCLSTLADIPDLHKKPLPDVICAAVNRTEDVVVATSSNCSYYLQDRSPVGRGTXLAINDCLELLSTTMDEARRSTAELASPPGRGSASAGVSKGPRPRTMDPRMTGLSGAIPNQ

SEQ ID NO: 71261 - DNA, 713 bp, Zea mays
  misc_feature: Ceres CLONE 1552565
  misc_feature: Encodes the peptide sequence at SEQ ID NO. 71262
ctccccgcggtggcggccgctctagaactagtggatcccccgggctgcaggaattcgtctcacccctagaaaaattccgtcgccccgcattgctcgcccagagttcttgtttaggcaaaggcaaaagcaggagcaaaaaggtttcgttggcgatggcgagctcgtggacgcttcctgaccacccgaagctccccaaggggaagccggtggctgtcgtcgtgctggacggatggggcgaggccaaccccgaccagtacaactgcatccatgtcgctcagactcctgtcatggactcgttaaagaatggtgctcctgagaaatggagactagtgaaggctcatggaacagctgtgggtctcccatctgatgatgacatgggcaacagtgaagttggtcacaatgcaccccgtgctggtcggattttcgcccaaggtgctaagcttgttgatcaagctcttgcctcacgagagatttatgatggagatgggttcaactacatcaaagaatcttttgaaaatggtactcttcaccttattgggttgttgagtgatggtggtgtccactcccgccgttgacaactgcagttacttctgaaaggtgtcagtgagagaggagcaaaaaaaattcgtgtgcacatccttaccgatgggcgtgacgttctggatggcagcagtgatggtttcgtggagaccctacagaatgatcttcttgag

SEQ ID NO: 71262 - protein, 140 aa, Zea mays
  misc_feature: Ceres CLONE 1552565
  misc_feature (15)..(141): Pfam Name: iPGM_N Pfam Description: BPG-independent PGAM N-terminus (iPGM_N)
  misc_feature: SWISSPROT Homolog: EC 5.4.2.1 Phosphoglycerate mutase
MASSWTLPDHPKLPKGKPVAVVVLDGWGEANPDQYNCIHVAQTPVMDSLKNGAPEKWRLVKAHGTAVGLPSDDDMGNSEVGHNAPRAGRIFAQGAKLVDQALASREIYDGDGFNYIKESFENGTLHLIGLLSDGGVHSRR

SEQ ID NO: 71263 - DNA, 719 bp, Zea mays
  misc_feature: Ceres CLONE 1552566
  misc_feature: Encodes the peptide sequence at SEQ ID NO. 71264
ctggagctccccgcggtggcggccgctctagaactagtggatcccccgggctgcaggaattcgtctcacccctagaaaaaaccgagctcaagcacggatccagaaagcaagaaagaaaagactgtaattagctagccaccgcgcgcgcgcacgagtagtctagctagaatacagtcgcgttcaaaacaaacacacagcgtcgtgctgcgtgatctctgatcgcgtcgacaactaccgctagcacctagcagctgatggcgagccaccgaatcttcctgcctgagcctcgtccccaccgtgcaccaccgggacggcgggttccacagcagtgtggcactgatgaacacgcttcatcgccgtcgacgttctcgccgctatcgtgtaggtgcctcggctacgagagccgaacaccaccccccccctgtgacgatcgaggacgtggacctcatctctcatcaagccgcggccgaccacggggagctcgccgcgcggtggcgggaggtccaccgcagcgacaagtgggagggtctgctgcgacccatcgacggtgtgctgctccaggagctcatccgctacggcgagttcacccaggccacctacgacagattccactacgacagcttctcccgctactgcggcagctgcaagtacccgggcgagaaccttcttcacgacgtcagcttcggcggcatccgctacgagggcacccgctacatctg

SEQ ID NO: 71264 - protein, 126 aa, Zea mays
  misc_feature: Ceres CLONE 1552566
MNTLHRRRRSRRYRVGASATRAEHHPPPVTIEDVDLISHQAAADHGELAARWREVHRSDKWEGLLRPIDGVLLQELIRYGEFTQATYDRFHYDSFSRYCGSCKYPGENLLHDVSFGGIRYEGTRYI

SEQ ID NO: 71265 - DNA, 706 bp, Zea mays
  misc_feature: Ceres CLONE 1552570
  misc_feature: Encodes the peptide sequence at SEQ ID NO. 71266
  misc_feature (579)..(579): n is a, c, t, g, unknown, or other
ggagctcaccgcggtggcggccgctctagaactagtggatcccccgggctgcaggaattcgtctcacccctagaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctcctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtgcggagacgccgcctaccaccaggagacgctcgagaaccctcagctcgccatcaagtccaccaagaagctgtgcgctgttatgcttgacacggttggnaccggagctgcaggtgggtcacaagagtgaaacccccatctccctcgaggagacgggactgtcgtgctcacgccgcatcagggccaagaagcctccctcacctgctgcccatcaacttcgatggacc

SEQ ID NO: 71266 - protein, 104 aa, Zea mays
  misc_feature: Ceres CLONE 1552570
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSCGDAAYHQETLENPQLAIKSTKKLCAVMLDTVGTGAAGGSQE

SEQ ID NO: 71267 - DNA, 726 bp, Zea mays
  misc_feature: Ceres CLONE 1552571
  misc_feature: Encodes the peptide sequence at SEQ ID NO. 71268
  misc_feature (726)..(726): n is a, c, t, g, unknown, or other
ctcaccgcggtggcggccgctctagaactagtggatcccccgggctgcaggaattcgtctcacccctagaatatagacactcccagtcccttcctctcctgctgcctatctctcttctcggagaagcgtgtgttcatactcactgtgactggttcctcctcccgcgccttcttctaccccgtgctcctgactagcgctggaaccaagaaagccacgaggggcagcctgccaacgagcagtagagaggctgatatgcgctgggcccctaagaggctgctctggctgctcggcggaggctggaaggccgccgtgacgaaccctgctaatgataccaagctctggggattcaggaagtccttcctggaaaaggaccccgcgccatcctcggacctgcctcggacgccctctgtgcagcccacggcgacgccacgccagggatttgcggctgccacggatgatcgccacgacaagcacagcaagcgtgctatcgatccctgcttcggctacagaagtacgcggcagaggccacacgacaatgcatgcctggcgagcaccaccgtgttgctgtctgacgagcatcttgcggatctcgccaccagcactctgctaacaagtagtatcgcctggtactccgaaccttgccggattctccatcctacctgcctatgcaggcactaaacgggtccaggggcagattatcagcggcgcctgccccgggaaaaatcn

SEQ ID NO: 71268 - protein, 141 aa, Zea mays
  misc_feature: Ceres CLONE 1552571
MRWAPKRLLWLLGGGWKAAVTNPANDTKLWGFRKSFLEKDPAPSSDLPRTPSVQPTATPRQGFAAATDDRHDKHSKRAIDPCFGYRSTRQRPHDNACLASTTVLLSDEHLADLATSTLLTSSIAWYSEPCRILHPTCLCRH

SEQ ID NO: 71269 - DNA, 937 bp, Zea mays
  misc_feature: Ceres CLONE 1552572
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (423)..(423): n is a, c, t, g, unknown, or other
ggggggggctctttattcacaaaannnnnattcctannnnnnnaaaacctggagctccccgcggtggcggccgctctataactagtggatcccccgggctgcaggaattcgtctcacccctagaaaaacgcctgcgcctgcgcctccgcttcctcgaggccgcgtttcgccggctgcctgccggcggtccaccataacatgggcggcgggcggaagcggcggcggcacgacggctcagagactccgtcgatgcacccgcggaaccgctacgctggccgccgcgccggacttcgccgcgctggcggagctctacccgtcctttcgccccttcttctccggctccgggagcgggcgcccgtccgttgatttcaccaactttccctccaccaaggaagcttcacccgcgttgctccccccccccgngggggggggggggggggggttggaattccaaaaagaaacccccccccccgggcggccccacaaatatggtccacaattaagctcttctttgtgttctcgggggtacttttttcccccccccgagatgtaggatccccacgcgctatctttccagctcttgccactgggacacgtgagctgaaacgctgccgtgcgccccgttctggcgccacctcgtgacgcctcgcatatgtggccgctcttcctccgtctctccttttcgtgttgcctgtcattcgtcccgcgcgcgaccctcaccggctcgtggtagagaccgtgtcccaggcacgcgctattccgtgctcgtcgcgtgctcgcttgcggttggcggcgcgcggacatcggacgagcaccactcgctcctctcgccgcgcttcaatccgtcgcctcggcggttgtcgtcggttagatcgtccctcacatctctccgcgttattcgtcgcgcctactgccctcgtacgcggctcgcactcta

SEQ ID NO: 71270 - DNA, 715 bp, Zea mays
  misc_feature: Ceres CLONE 1552573
  misc_feature: Encodes the peptide sequence at SEQ ID NO. 71271
  misc_feature (546)..(546): n is a, c, t, g, unknown, or other
  misc_feature (662)..(662): n is a, c, t, g, unknown, or other
  misc_feature (699)..(699): n is a, c, t, g, unknown, or other
  misc_feature (715)..(715): n is a, c, t, g, unknown, or other
acccgcggtggcggccgctctagaactagtggatcccccgggctgcaggaattcgtctcacccctagaaaaagtgctcctctcctcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtggtttgacaccaactaccactttattgtccctgaattgggcccaaacaccaagttctcctatgcttctcancaggctgttaacgaatataaggaggctaaggcgctcggtgttgataccgtgccagtactttgtgggacagtctcgtacctgttgctctcaagcctgccaagggtgtggagaagggnattcctcttcttcccttctagcagcatcctccagtcntacaggagtcattgcn

SEQ ID NO: 71271 - protein, 191 aa, Zea mays
  misc_feature: Ceres CLONE 1552573
  misc_feature (2)..(190): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
  misc_feature (135)..(135): Xaa is any aa, unknown, or other
  misc_feature (174)..(174): Xaa is any aa, unknown, or other
MASHIVGYPRMGPKRELKFALESFWDGKSTAEDLEKVATDLRASIWKQMADAGIKYIPSNTFSYYDQVLDTTAMLGAVPERYSWTGGEIGFDTYFSMARGNATVPAMEMTKWFDTNYHFIVPELGPNTKFSYASXQAVNEYKEAKALGVDTVPVLCGTVSYLLLSSLPRVWRRXFLFFPSSSILQSYRSHC

SEQ ID NO: 71272 - DNA, 707 bp, Zea mays
  misc_feature: Ceres CLONE 1552574
  misc_feature: Encodes the peptide sequence at SEQ ID NO. 71273
  misc_feature (255)..(255): n is a, c, t, g, unknown, or other
  misc_feature (333)..(333): n is a, c, t, g, unknown, or other
  misc_feature (451)..(451): n is a, c, t, g, unknown, or other
ggagctcaccgcggtggcggccgctctagactagtggatcccccgggctgcaggaattcgtctcacccctagaaaaagttcttcagccggcgcctcccacgtctccagtccgacactccgactcactccccctcccccgcccaacccgtcgcaatggccgccgtctccgcagccccgaggccctcgatgcctccccgactcgccctccgtgcccacctcttctcctccgcctctccgctcccaatgcgcgcgctncccttactccgcagccgcttccgctccttgacacggcctacgctgtcaagcaggacacggccctctggacccctgcanccgtctccgccatcagtgctgccaccgacgacggctccgtctccctcatcgccgtcgacctatctgaccccacggacctcgtggactcgtacacgaacccgggggcatacctcctgantcgcgtacccggcgaggagctcaagcgggcgtacatggtcatctcctcgccgcctaaagcggggcccccgggtcgaatccctcgtcaaaagcgtgccgggagctaccgcggggcggctctgcgcccttcaagacgggatgttgtggagctcggcgccgtcccggggaagggggtcccccctcacggggtaaattccgcccgaagtcgggaaaaccgggctaattttccgggggggggaaggggataaggggaattc

SEQ ID NO: 71273 - protein, 70 aa, Zea mays
  misc_feature: Ceres CLONE 1552574
MVISSPPKAGPPGRIPRQKRAGSYRGAALRPSRRDVVELGAVPGKGVPPHGVNSARSRENRANFPGGGRG

SEQ ID NO: 71274 - DNA, 735 bp, Zea mays
  misc_feature: Ceres CLONE 1552575
  misc_feature: Encodes the peptide sequence at SEQ ID NO. 71275
tcaccgcggtggcggccgctctagaactagtggatcccccgggctgcaggaattcgtctcacccctagaaaaaaagtaaagaaaagatggcgctgccatccatgagtcttgcggcaaagggtgtgcttcccttctcagcacgtacctcgagtggtgtcacacaaaggccggtgtcagtgaccgcttccttggagcacaaaccagcgatgccagaaggaagttcctaaaacttgcgcttgggaaccttggagtgggactgcccaccttgttgggcgctaacaaagctctcgctgatgagccaagcgtctcgtcctcgaggatgtcttattcgaggttccttgagtatcttgacacgatacagtgaagaagggggattggtttaaaaatggacaattgcaccccccaacgccatttctcctgacctgggtaacccgctgcaaagagtccgtgtgcaccttccttgtctaagccaggaccttcttcagaaattaaaggaaaaaaacatccattttgcttcctcacacccacccagaaacactcctggtttccttcggtcaaccctaattgaaaatttgggcctttccccctattccctaaacccggggccggtttttccctccaaaaaaggggaacagggggtcccctcggcgaaacaaaaggaccctggtcttacacccgggaattcgaacacacaaggggcccacatttctaaaaagaacccccaaccgggggcgt

SEQ ID NO: 71275 - protein, 46 aa, Zea mays
  misc_feature: Ceres CLONE 1552575
MALPSMSLAAKGVLPFSARTSSGVTQRPVSVTASLEHKPAMPEGSS

SEQ ID NO: 71276 - DNA, 728 bp, Zea mays
  misc_feature: Ceres CLONE 1552576
  misc_feature: Translation starting site: 175
  misc_feature: SWISSPROT Homolog: EC 2.7.7.27 Glucose-1-phosphate adenylyltransferase
  misc_feature (521)..(521): n is a, c, t, g, unknown, or other
ggagctcaccgcggtggcggccgctctagaactagtggatcccccgggctgcaggaattcgtctcacccctagaaaaagtctcgcaccgtcgcggccacccattctctctcgtccatcgcatcgctccggctcccagcgcaatcgatccatccgtccctaggtgtgcttcagctatgcagttcagcagcgtgcttcccctagagggaaaagcgtgtatgagcccagtgaggagaggcagtggaggttatgggagtgagaggatgaggatcaactgctgcagcatcaggcgcaacaaggcactgaggaggatgtgtttcagtgcaaggggtgctgtgagcagcacgcagtgtgtgctcacatcagatgctggcccagacactcttgtcgtccgaacatccttccccacgaattatgctgatcctaatgaagtcgctgccgtcattttgggtggtggtaccgggactcagcttttccctctcacaagcacaaagggcacccctgctgttcctattggaggatngtacaggcttattgatattcccctgagcaactgtttcaacagtggcataaacaagatattgttatgactcagttcaactcagcttctcttaagcgtcccattcatcgtacctatcttgggtggggggacaacttccctgatggatctggtgaagggctggctgcaacaaaatgcctggggaggctgcggttgggtcccggggacagc

SEQ ID NO: 71277 - DNA, 715 bp, Zea mays
  misc_feature: Ceres CLONE 1552580
  misc_feature: Encodes the peptide sequence at SEQ ID NO. 71278
  misc_feature (715)..(715): n is a, c, t, g, unknown, or other
tggagctcaccgcggtggcggccgctctagaactggtggatcccccgggctgcaggaattcgtctcacccctagaaaaaaactctgacgagcgcgatcgattgtttcttttcgtgccgggcggatgatgatgatggagcgccccctggcggtgtgagacctccaaatccgagttccggagccgctatgatgaactcactgctgccgcagatccacctgcagcactcagcggttgccgccgcgcggtcctccggatgcggtgccccggtggcatatcgggctatgttctacggttgcggctcggggcctcgggagccctcctcctccaccttctggttcctgctccacgcgctctgctgcctcatctctctcttcctcggcttctgcttctcacgtcacccccaccccctgctcttctccaccaccgcgctctaccgttgctgtgcctcctcctcctaggccgcggtccttctcgccagcaccaagagcaccaccgctacgaccacgaggacagacgactactagggccttcgcgctctccttcgccgccgacgacactccccactgcatcccccgcgaaccgcacccctctggatgctgccgacaacggggagggcgttcggggaacccactgaaacacgccatgggtgggaagcacaggtattctaatcgggccggggacacatgctggaccccgtaaagaagatgcctttcgn

SEQ ID NO: 71278 - protein, 90 aa, Zea mays
  misc_feature: Ceres CLONE 1552580
MMNSLLPQIHLQHSAVAAARSSGCGAPVAYRAMFYGCGSGPREPSSSTFWFLLHALCCLISLFLGFCFSRHPHPLLFSTTALYRCCASSS

SEQ ID NO: 71279 - DNA, 730 bp, Zea mays
  misc_feature: Ceres CLONE 1552583
  misc_feature: Encodes the peptide sequence at SEQ ID NO. 71280
  misc_feature (1)..(1): n is a, c, t, g, unknown, or other
  misc_feature (34)..(34): n is a, c, t, g, unknown, or other
  misc_feature (36)..(36): n is a, c, t, g, unknown, or other
  misc_feature (40)..(40): n is a, c, t, g, unknown, or other
  misc_feature (407)..(407): n is a, c, t, g, unknown, or other
  misc_feature (413)..(413): n is a, c, t, g, unknown, or other
  misc_feature (730)..(730): n is a, c, t, g, unknown, or other
nggttgcatgccgtccaacagtctatcatctatngnactngtggatcccccgggctgcaggaattcgtctcacccctagaaaaaaacccacccacctcccactctcgccaccgtgtggtccagacgaccagtcctctaaccgaaccaggaagcaccaggcagcggaagctcgcgctgggatcggctaccaacaataatatcgttccccgcctccctcacctctgaacgagaacgcgaacgcgccctgtgatcactaccccacagcatgtgctcaggacctcgcaagccgtccacaccccctctgccggcggcgacggccaaggactcctcggcgatggcggtgctgctggagctggcggcggcggacgacgtcgtggggttcaggcgcgccgtggagggcgacaaanccccanccttggacgacgcgggtcactggtacggcccgtccgccgcggccgccggccgcctccgcctgcgcctcgaggcgcgcactccggccatggtggccgcgctctacggcagcacggcggtgctggcgtacgtgctgtcccccgcgccggcggaggccgcgcgcgcctcgcccagggacggcgcaacggcgctccacctcgccgcggccggggggccgccgggcgccgtcgcgggcccgcacctgctcctggccgctggcgcgtccgccgacacgctcgctttctcgggccttcgggccggggaactcctccggggcggn

SEQ ID NO: 71280 - protein, 132 aa, Zea mays
  misc_feature: Ceres CLONE 1552583
  misc_feature (25)..(25): Xaa is any aa, unknown, or other
  misc_feature (27)..(27): Xaa is any aa, unknown, or other
MAVLLELAAADDVVGFRRAVEGDKXPXLDDAGHWYGPSAAAAGRLRLRLEARTPAMVAALYGSTAVLAYVLSPAPAEAARASPRDGATALHLAAAGGPPGAVAGPHLLLAAGASADTLAFSGLRAGELLRGG

SEQ ID NO: 71281 - DNA, 740 bp, Zea mays
  misc_feature: Ceres CLONE 1552584
  misc_feature: Encodes the peptide sequence at SEQ ID NO. 71282
  misc_feature (1)..(1): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (50)..(50): n is a, c, t, g, unknown, or other
  misc_feature (52)..(52): n is a, c, t, g, unknown, or other
  misc_feature (402)..(402): n is a, c, t, g, unknown, or other
naaaacannnnnaaaagagtagagtcgtctacgagtgctccaatnnngantngtggatcccccgggctgcaggaattcgtctcacccctagaaaaacggacgccgtgactccgccgcagagagagggagagtccacgctctgaagaagcaacggcgacgtcctcgacgacgagcacaggtgcacagcaaactagcagcgccctcgtcagttccgtctcgttcgcaaccactcctggattcgattcgattgacccgtccgctccaaatcggatctaatcagcacttttggagttgcttgaacggagaaagagagaggagaggggcatggatcaggtgctcaacaaggtggggagctactggttcagcaattggttcccccggaaatcgggggggggggggacnacttcttctctatctcccccccctttggagggtcaaccaaatggatggtgcaacaaaattaaggggaagatgctgaaagccctggcggatttctctcaggaatatgaaatggccgcagggttctttccacggggacccgactgactaatgacttccatgaagaaaacaaagatgctaacgggggacatcccgttgggcctggggtgtttggttaccagggcttctccggggctaggatgttcttatcctgtgttgacgcggctaccctggagggggggaaatttttcggaggtggtaggggtcgtgtttacaaaatgggtggggcttggaatgaggtt

SEQ ID NO: 71282 - protein, 73 aa, Zea mays
  misc_feature: Ceres CLONE 1552584
MDQVLNKVGSYWFSNWFPRKSGGGGTTSSLSPPPLEGQPNGWCNKIKGKMLKALADFSQEYEMAAGFFPRGPD

SEQ ID NO: 71283 - DNA, 719 bp, Zea mays
  misc_feature: Ceres CLONE 1552588
  misc_feature: Encodes the peptide sequence at SEQ ID NO. 71284
  misc_feature (394)..(394): n is a, c, t, g, unknown, or other
  misc_feature (397)..(397): n is a, c, t, g, unknown, or other
aagctggagctccccgcggtggcggccgctctagaactagtggatcccccgggctgcaggaattcgtctcacccctagaaaaaaccagtcaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgctcggtccccggggctggccggtgctgggcaacctgccgcaggtcggcgccaagccgcaccacaccatgtgtgctctggcgcgggagtacggcccgctgttccggctcctgttcggcagcgccgaggtggtggtggccgcgtcngcncgggtgggcgcccacctcctgcgcgctcacgacggcaacttcagcaaccgcccgcccaactccggggccgagcacgtggcgtacaactaccaggacctggtgttcgccccgtacggctcccggtggcgcgcgctacggaagctgtgcgcgctccacctctttctccgcaagggccctggacgacctgcgcggcgtcaaggagggcaaagtggctctcatgttaagggagctcgccccggaaggagaagcaaaaacgcctccccttggccttgggcaattggcccacctcttcccgaccaaacccctgggccggggaaacttg

SEQ ID NO: 71284 - protein, 192 aa, Zea mays
  misc_feature: Ceres CLONE 1552588
  misc_feature: SWISSPROT Homolog: EC 1.14.13.21 Flavonoid 3'-monooxygenase
MDVPLPLLLGSVAVSLVVWCLLLRRGGAGKGKRPLPLGPRGWPVLGNLPQVGAKPHHTMCALAREYGPLFRLLFGSAEVVVAASARVGAHLLRAHDGNFSNRPPNSGAEHVAYNYQDLVFAPYGSRWRALRKLCALHLFLRKGPGRPARRQGGQSGSHVKGARPGRRSKNASPWPWAIGPPLPDQTPGPGKL

SEQ ID NO: 71285 - DNA, 727 bp, Zea mays
  misc_feature: Ceres CLONE 1552590
  misc_feature: Encodes the peptide sequence at SEQ ID NO. 71286
  misc_feature (406)..(406): n is a, c, t, g, unknown, or other
  misc_feature (409)..(409): n is a, c, t, g, unknown, or other
  misc_feature (561)..(561): n is a, c, t, g, unknown, or other
tggagctcaccgcggtggcggccgctctagaactagtggatcccccgggctgcaggaattcgtctcacccctagaaaaacaccgaatcgaaggccaacacggcaactctcgcacagcgaagaggcaaggagagagagagcagccaggcgtcgaaggctcgtagccctagaagctccaatggcggactccgaagacgcgccgccagccgtgcaccgccgcccaccgcgccccgcccgcggtgctgctgcagcccagggcttcgcggccgcgttgcgccgccggctgagatccggcgctgcggtggcggcacgcgccagctttgccgcagactccggggacgagtctggccccggcgagccctcttcgtctcgccgccgcgacaacagcgggggcgcctcgtccgccnccngcggccggggcggggcaggggacttctccgcgttcaccttcggcgccgcggcgcctggccaccggaaagccaaggagagccctctgaagctcgacgccatcttcaagcagagtcatgcaggcctttttcaactatggtatggttgttctggnttgcggggaaataccgggctcattattgaaaaccttgatggagtttggccttataaataaaaactggccttttgggttaaaggctacatccattggcaaaaatgggccctggctaaatggggttgccttaagcccaccccattatttccccccttgggggcatttg

SEQ ID NO: 71286 - protein, 147 aa, Zea mays
  misc_feature: Ceres CLONE 1552590
  misc_feature (77)..(77): Xaa is any aa, unknown, or other
  misc_feature (78)..(78): Xaa is any aa, unknown, or other
MADSEDAPPAVHRRPPRPARGAAAAQGFAAALRRRLRSGAAVAARASFAADSGDESGPGEPSSSRRRDNSGGASSAXXGRGGAGDFSAFTFGAAAPGHRKAKESPLKLDAIFKQSHAGLFQLWYGCSGLRGNTGLIIENLDGVWPYK

SEQ ID NO: 71287 - DNA, 664 bp, Zea mays
  misc_feature: Ceres CLONE 1552597
  misc_feature: Encodes the peptide sequence at SEQ ID NO. 71288
gctggagctccccgcggtggcggccgctctagaactagtggatcccccgggctgcaggaattcgtctcacccctagaaaaatcacgggagacagacatcgggtgctaacgtccggtgtcaagagggaaacaacccagaccgccagctaaggtccccaaatatggctaagtgggaaacgaagtgggaaggctaaaacagtaaaggtgacggaaatagtgaggagcggagaacaccggaatgatccatcctcttgtgctttccctgcccttccccgctataatatcgcgccctcgtcgccatcgtcaccacaccaccactccctcactgccctctcactcccgatccctgcaccactaccgcctcctccgcttcacccctctcgtcgcctcttgcggcgaccggcggcggatcgtccgcggcgcaagcgcaaccatggggctcttcaccgtgacgaagaaggccaccacccccttcgaaggccagaagcccggtacctccggcctccgcaagaaggttactgtattccagcagcctcattatctgcagaactttgtccagtcaacattcaatgcccttcctgcagacaaagtaaaaggtgcaacccattgttgtctctggtgatggccgctatttctcaaaagatgctggtcagatcataccaaaa

SEQ ID NO: 71288 - protein, 62 aa, Zea mays
  misc_feature: Ceres CLONE 1552597
  misc_feature: SWISSPROT Homolog: EC 5.4.2.2 Phosphoglucomutase
MGLFTVTKKATTPFEGQKPGTSGLRKKVTVFQQPHYLQNFVQSTFNALPADKVKGATHCCLW

SEQ ID NO: 71289 - DNA, 581 bp, Zea mays
  misc_feature: Ceres CLONE 1552598
  misc_feature (138)..(138): n is a, c, t, g, unknown, or other
  misc_feature (161)..(161): n is a, c, t, g, unknown, or other
  misc_feature (329)..(329): n is a, c, t, g, unknown, or other
ggagctccccgcggtggcggccgctctagaactagtggatcccccgggctgcaggaattcgtctcacccctagaaaaagagcaccgagctcaaacacacatcaagaaagcaagaaagaaaagactgtagctagctagnccaccgcgcgcgcgcacgaagtnagtctagctagaatacactcgcgttcaaacaaacacacagcgtcgtgctgcgtgatctctgaccgcgtcgacaactaccgcagcaccaagcagctgatggcgggcaccgtatcttcctgcctgaggctcgtccccacgtggcacaccggggcggcggttccccagcantgtggcactgaagaaaacctttaagggccgttgttgtttttcccccttttttgggttcccctcgggaaaaaaagcaaaagggaagccccccctgggcaattagggaaggggacctcagttttctttagggcccgggccaaaaaaggggaaatcctccccccggggggggggggggtcccccggggcccaaacctggggggggggtttgtgggaaccccttagggggggggtgttccccccgaaaaaattccc

SEQ ID NO: 71290 - DNA, 643 bp, Zea mays
  misc_feature: Ceres CLONE 1552600
  misc_feature (516)..(516): n is a, c, t, g, unknown, or other
acccgcggtggcggccgctctagaactagtggatcccccgggctgcaggaattcgtctcacccctagaaaaaacatgtattcggaccgactacccacccgtctattctggtcacttcttttggggttctccgttcccctccccattcccctgcccccgcctcttcgagctagggttagggtttgctttgcgttcccttggaaattgatcgaatcgggcacccctaaccggtgtcctcaccgatccatccgttcatccttcgattcgatcaaatttccacctctcgacatcagcaatctcgctgcctctctctctctctcttttgagagagggggaagtaataaaagggaaaaagctagcaaggggatttccttgatcccatcatcgtgctacagatcctttagttctagcaaggaggaggaaaaagagagagcaagcccatggatcccagccagatgatgttcccccatctggggggcgccgcctcccgccgcctttgagccggcccttcgatganccacgccgccgcccccaacgcgcaggcgcaggcccttcctcccccctcccaatcccaaacgcgggctgaaagcgcaaaattcccggccgcggccgcttacaagccacgggccttcggggaacttcaa

SEQ ID NO: 71291 - DNA, 845 bp, Zea mays
  misc_feature: Ceres CLONE 1552603-R
  misc_feature: Encodes the peptide sequence at SEQ ID NO. 71292
taacaattgggtactcgagcgtctcgttttttattttttttttctagatagatctcattatctcaagggtacatacagtacaattcgatacaacatcagtgccatgaggcggtagttaactaataaaaactcgccgtcacgcaatcacaccagcttactttactacactacatcaaccgagctcccgaggaaggagccggggctcaactcaaacaaggagcaaatggcagctaccaagctagtagccgaggtcagtagcggttaactaactcaacaccaagcagtcaccacgccggccaggtagccagcgagctccgactccggcccaccaccgtaccgcccgacgacgatcactggctgctggtgccgagctgctgcaacacggcggccatggcgggccgctgcgcgggcgcctcggcggtgcacaacagcgcgacgccggcgagcttggcggcctctgcgcgcgagaaccgcccgcgcaggcgcgggtccacgaggtcgttccagccgcccgccgccgtcctgctggaggggggggcgttaataggagtgagaaaccttacgggtatagtgggcacacatattcgtgatgagcaaacaaaaattaggcaactcgtaaaatctttaactcctccacataagggagagaaaattgtaataaatcaatgtaaaaaaggcatgagtagtaaaaggagaaatggcgctatagttaaacagaatataaagaagatacagggagggtagcattaaggagagtgtggggcggtgagggagctcgctatcttagttaggatccgttggactaatattaaaccgacatctacatctgcccagaatgggattaa

SEQ ID NO: 71292 - protein, 117 aa, Zea mays
  misc_feature: Ceres CLONE 1552603-R
MAGRCAGASAVHNSATPASLAASARENRPRRRGSTRSFQPPAAVLLEGGALIGVRNLTGIVGTHIRDEQTKIRQLVKSLTPPHKGEKIVINQCKKGMSSKRRNGAIVKQNIKKIQGG

SEQ ID NO: 71293 - DNA, 597 bp, Zea mays
  misc_feature: Ceres CLONE 1552603
  misc_feature: Encodes the peptide sequence at SEQ ID NO. 71294
  misc_feature (413)..(413): n is a, c, t, g, unknown, or other
  misc_feature (423)..(423): n is a, c, t, g, unknown, or other
ctccccgcggtggcggccgctctagaatagtggatcccccgggctgcaggaattcgtctcacccctagaaaaaaaacggcaccgccaagaactcgctccagccaccctcccaccagtgcccctccgcgcgccatgccgtcccgtagctccctcctcccgctcctgctcctctgcgccgccgccgccgccgccgccgcgtcctcgcgcaacgccgagctggacgcgctgatggagctgaaggcggcgctggacccggcggggcgcgctctggcctcgtgggcgcgcggcggcgacccctgcggccgcggcgactacttcgagggcgtcgcctgcgacgcccgcggcagggtcgccaccatctcgctccaggggaaggggctcgccggcgccgtccctcccgcgggtcgcatgcntccgggcccntcacgggcctctacctgcactacaacgccctgcgcggggagataccgagcgagctcggcgcccctcccggtctcgccgagctctacctcggcgtcaacaacctctcgggcccatccccgtcgagctggggcggctcggtaccctcaaaggctgcagctcgggttacaccaagtt

SEQ ID NO: 71294 - protein, 155 aa, Zea mays
  misc_feature: Ceres CLONE 1552603
  misc_feature (25)..(68): Pfam Name: LRRNT_2 Pfam Description: Leucine rich repeat N-terminal domain
  misc_feature (94)..(94): Xaa is any aa, unknown, or other
MPSRSSLLPLLLLCAAAAAAAASSRNAELDALMELKAALDPAGRALASWARGGDPCGRGDYFEGVACDARGRVATISLQGKGLAGAVPPAGRMXPGPSRASTCTTTPCAGRYRASSAPLPVSPSSTSASTTSRAHPRRAGAARYPQRLQLGLHQV

SEQ ID NO: 71295 - DNA, 651 bp, Zea mays
  misc_feature: Ceres CLONE 1552606
tccccgcggtggcggccgctctagaactagtggatcccccgggctgcaggaattcgtctcacccctagaaaaaatcctccttcgcttgctcgctagtcgctagccgctccccccaacaaacaaccctaatccgtgaccgtggactcgccgcaagctccatcgcgcgaatagattggggggattcaatagaggctacgcggggattggtcgcgctcgagatctcagcaccctcgcgcctgaaatctttctattgttgtcgtggttcaggtgatgagatcttggggagcgcgactcgctcggtcctgagatgctggcgggctacggcggcggtggccgcagcgtccatctctcctccccaaggacctcctcctcggccgctgcggccggagcttcctcttcggcaacacgtggtttctcctctccacctacccggcgcgcctcctgcacaccacggaacgccgcgctccctccgctttcgtcgccgccatcaacggggttccctgcgtgcggtcgcactgcacggggcaggccctgctgcaaagaggcagcattgtcatggctgccctgcgctatgttccttaggccaacttgacctggttgcttgccaagcgccaacagcccgaataaggacccctctggggggaagccccg

SEQ ID NO: 71296 - DNA, 637 bp, Zea mays
  misc_feature: Ceres CLONE 1552608
  misc_feature: Encodes the peptide sequence at SEQ ID NO. 71297
ctggagctccccgcggtggcggccgctctagaactagtggatcccccgggctgcaggaattcgtctcacccctagaaaaagctagggtttcccccctctcatttcccctcctcctcccgctccccctggctccccaagcctcgacgcccggctagggttttgcctccttcccgccgccgctgtttcagcgagcgagaccgaggggtagagaaagagcggtgcttagccacccatgtcgctgcgtccgagcgagcgggtcgaggtacggcggaaccgctacaaggtggcggttgacgcggaggaggggcggcggcggcgcgaggacaatatggtggagatccgcaagagccgccgtgaggagagcctcctcaagaggcgccgtgaggggctccaagcccaggtccctgcccctccctccgggggtcgagaagaagcttgaaagcctcccagctatgggtagtggggtttattcggatgataataactttcagctgagggcacacacagttccgcaaattgctctctatagagaggagtcccccccatcgagaggttatcaaaacaggtgtagttcccaagatttgtggcaggcttctcaccaaaaaaggattttccccccagctgccggtttggagcc

SEQ ID NO: 71297 - protein, 68 aa, Zea mays
  misc_feature: Ceres CLONE 1552608
  misc_feature (4)..(68): Pfam Name: IBB Pfam Description: Importin beta binding domain
MSLRPSERVEVRRNRYKVAVDAEEGRRRREDNMVEIRKSRREESLLKRRREGLQAQVPAPPSGGREEA

SEQ ID NO: 71298 - DNA, 652 bp, Zea mays
  misc_feature: Ceres CLONE 1552613
ctccccgcggtggcggccgctctagaactagtggatcccccgggctgcaggaattcgtctcacccctagaaaaaccctagaaaaaacctcgtgtgtctgtttctccggcctgggctctgggctcgggcgtagtccagttgccaccaaccgagccagagagagaacaaagaacgggtgaaagaaatctcggaaaggttccagatttcctcgaggtggaggcctccttttcctcggccgaatcgctcgttcgctttctctctctctttcctcccatcgagcatgcattcttttctgctgctgcgaccgtaggatcggcgtccagcagcctcgccgcgtcggtatggttttcccttggcccacacatcctagctcttccgcattcttgaatttcgtggtcgaggattagggggtttctcgtgcgctggtccaatttcgcgctaatcgtcctgttcctgcctcggatttactcgccttctcgtggtccccatctgttcttgggcgtcgcacgcttgccgtgcggcgggcagggctgcagcagcagccggcagcgcgtgcatcttgcgaccccctttccaagaacagctgcaagctttgcccttttccgcctgccgtacccgaaatcccgaagaaactcccccaaaaaaaagcggcc

SEQ ID NO: 71299 - DNA, 2094 bp, Zea mays
  misc_feature: Ceres CLONE 1552616
  misc_feature: Encodes the peptide sequence at SEQ ID NO. 71300
aagcagatccaccggcacgagaccgaccccgtttcctcgctccttcgtctctcgctgacactgtttgacccctgtcctccaggctcggctccagctaaggtcgagcggcgaggcgacagccctagtgtagcgcggcgcggtaccatagatggggagacgaatggaggccccctcctcgccggcgtccctcgtcgtcgtcctcctcctcggctcgctgctcctgcaggcacgcgccgatgacccctacaggttctacacctggaacgtcacctttggcgacatctacccgctcggcgtcaagcaggaggggatactgatcaacggccagttcccggggccgcagatcgacgccgtcaccaacgacaacatcatcgtcaacgtcttcaacaacctgccggtccccttcctcctctcctggcagggaattcagcagcggaggagctcatggcaggacggcgtgtacggcaccaactgcccgatccctccgggcggcaatttcacttacaacatgcagttcaaggaccagatcgggagctactactacttcccttcccttctgtttcacaaggcagctggcggttacggtgccatcagggttctcagccggccgaggatccctgtcccgtttgacccgcctgccggggatttcaccatattggcgggtgactggttcaagctcaaccacaccgacctgaaaggcattctggacagtggcaatgacctgccgtttcctgacggccttcttatcaatggccaaggttggaatggcaacagattcacggtggaccaagggaaaacgtatcggttccgggtgtcgaacgtgggaatcgcgacctcggtgaacataaggatccaaggccattccatgctgctggtcgaggtggaggggtctcacaccatgcagagcacttacacgtccatcgacgtccatctaggccaatcatactcgttccttgttactgctgatcagccacctgcagactactccatagttgtctccacacgctttaccacccctgtcctcaccaccgctgccatcctccactacagcagctcaaatggtgctgcaagtgtgccgcctcccccggcgcctaccgttgagatcgatttctctctcaaccaggctagatccatccggtggaacctgacagcgagtggaccaaggccaaaccctcagggttcctaccactacggtctcgtcaacaccacaagaaccatcaggctcgccaactcgcgggcaaccatcaacggcaagctgagatacgcagtgaacggcatctccttcgtcccggccgacactcctctcaaggttgctgatttctacagcatcccgggagttttcacgctgggcagcatgcccgacaacccgacgggcggcggcgcttacctccagacgtctgtgatggcggccaacatgcgggactatgttgaggtcgtctttgaaaacgcggagaacttggtgcagtcgtggcacatcgacggctacgcgttctgggtcgtcgggatggatggaggacagtggacaccggctagtcgtcagggctacaacctcagggacgccattgctcggtacacattgcaggtgtaccctcagtcatggacggctatctacatgccgctggacaacgtggggatgtggaacgtgaggtccgagagctgggccaggcagtacctcggccagcagttctacctccgcgtctactcgccggcgaactcgtggcgggacgagaacccgatccccaagaacgcgctgctctgcggccgggcctctggacgccggaccaggcctctctgaagctgaatccctgagcccaagaagaccatgtttgttcggccacgaaggggtggccggaacttgcggggatcaattgaagttgagggaagagatcattggagtgttcagattgctgaactgagttccattttgtggcgctgatgatcgttcagctcatatattatttagcaattgtagctaaaacattaattcccggtcgatttgttgtatgtgaagcttcctcgcttcctcgctcacatcattgatgatgataatattcatagtaaccagattttcctttttaaaaaaaaaaaaaaaaa

SEQ ID NO: 71300 - protein, 548 aa, Zea mays
  misc_feature: Ceres CLONE 1552616
  misc_feature (165)..(303): Pfam Name: Cu-oxidase Pfam Description: Multicopper oxidase
  misc_feature (39)..(155): Pfam Name: Cu-oxidase_3 Pfam Description: Multicopper oxidase
  misc_feature (383)..(523): Pfam Name: Cu-oxidase_2 Pfam Description: Multicopper oxidase
  misc_feature: SWISSPROT Homolog: EC 1.10.3.2 Laccase
MGRRMEAPSSPASLVVVLLLGSLLLQARADDPYRFYTWNVTFGDIYPLGVKQEGILINGQFPGPQIDAVTNDNIIVNVFNNLPVPFLLSWQGIQQRRSSWQDGVYGTNCPIPPGGNFTYNMQFKDQIGSYYYFPSLLFHKAAGGYGAIRVLSRPRIPVPFDPPAGDFTILAGDWFKLNHTDLKGILDSGNDLPFPDGLLINGQGWNGNRFTVDQGKTYRFRVSNVGIATSVNIRIQGHSMLLVEVEGSHTMQSTYTSIDVHLGQSYSFLVTADQPPADYSIVVSTRFTTPVLTTAAILHYSSSNGAASVPPPPAPTVEIDFSLNQARSIRWNLTASGPRPNPQGSYHYGLVNTTRTIRLANSRATINGKLRYAVNGISFVPADTPLKVADFYSIPGVFTLGSMPDNPTGGGAYLQTSVMAANMRDYVEVVFENAENLVQSWHIDGYAFWVVGMDGGQWTPASRQGYNLRDAIARYTLQVYPQSWTAIYMPLDNVGMWNVRSESWARQYLGQQFYLRVYSPANSWRDENPIPKNALLCGRASGRRTRPL

SEQ ID NO: 71301 - DNA, 669 bp, Zea mays
  misc_feature: Ceres CLONE 1552618
  misc_feature: Encodes the peptide sequence at SEQ ID NO. 71302
ggagctccccgcggtggcggccgctctagaactagtggatcccccgggctgcaggaattcgtctcacccctagaaaaaatctccatcccgcatcgcgcatcgcatccaccgccgagcttgctttctttctttcttttttctgggagaagaggaagaagaggggaggcgcgacaaaaagggcgccgcgccccgccccgccccgcatcgcccccgacgccggcatctctccctcgctctccttctcccgatctgatccgaagcgcggcggcgtcgacgacgacgacctaagggcacgatgcattcgaccaacctgctgctggaggagcccatccggatggcctccatcctggagccatccaagaccagcttcttcccggcgatgaccaagatcgtcggcacgctcggccccaagtcgcgctccgtcgacaccatctcctcctgcctcaaggccggcatgtccgtcgcgcggttcgatttctcgtggggagacgccgcctaccaccaggagacgctcgagaacctcaagctcgccatcaagtccaccaagaagctgtgcgctgttatgcttgacacggttggaccggagctgcaggtggtcaacaagagtgaaacccccatctccctcgaggagaacgggactgtcgtgctcacgccgcatcagggccaaga

SEQ ID NO: 71302 - protein, 124 aa, Zea mays
  misc_feature: Ceres CLONE 1552618
  misc_feature: SWISSPROT Homolog: EC 2.7.1.40 Pyruvate kinase
MHSTNLLLEEPIRMASILEPSKTSFFPAMTKIVGTLGPKSRSVDTISSCLKAGMSVARFDFSWGDAAYHQETLENLKLAIKSTKKLCAVMLDTVGPELQVVNKSETPISLEENGTVVLTPHQGQ

SEQ ID NO: 71303 - DNA, 684 bp, Zea mays
  misc_feature: Ceres CLONE 1552621
  misc_feature: Encodes the peptide sequence at SEQ ID NO. 71304
ctccccgcggtggcggccgctctagaactagtggatcccccgggctgcaggaattcgtctcacccctagaaaaaagaccacacaccacagcactaaagtctattcatctctggctccccaaattcagctggagagcactttttcccatcatggataagaactacggtgaactctacaacatcctcggatggggtgaggagtacttcgcggtgaacacggaggggcacctcagcgtgaagcctttctgccgctggacggagcccgggcaggaaatctacgtgcactctgtcatcatggaagctctagcgacccaacccaaccgaaagccccccgaaaataccaaagtcccccaagattccctccccttccccccaaggggtcgcagagaaaccgtattcttttatttattcctttaatccccacttttatttttcgcccctacggcacattagtgatgttaggacccccctccccccccccttctttgggtgggttgtgccccccccctcaagaggtataacacctctgaaaaataacgactctcctttcccctcggacaccccggctttattatttttagtcgctctccaaatacccggcctaagcgggggggagcgttgatattatgtccttcctactgggggggggcgcgggacacgcccttccctctccccgacctccgta

SEQ ID NO: 71304 - protein, 88 aa, Zea mays
  misc_feature: Ceres CLONE 1552621
  misc_feature: SWISSPROT Homolog: EC 4.1.1.19 Arginine decarboxylase
MDKNYGELYNILGWGEEYFAVNTEGHLSVKPFCRWTEPGQEIYVHSVIMEALATQPNRKPPENTKVPQDSLPFPPRGRRETVFFYLFL

SEQ ID NO: 71305 - DNA, 591 bp, Zea mays
  misc_feature: Ceres CLONE 1552626
  misc_feature: Encodes the peptide sequence at SEQ ID NO. 71306
  misc_feature (336)..(336): n is a, c, t, g, unknown, or other
  misc_feature (389)..(389): n is a, c, t, g, unknown, or other
ctccccgcggtggcggccgctctagaactagtggatcccccgggctgcaggaattcgtctcacccctagaaaaaactcaccgggccagagccagagaagcggcaaagcagagagtcggcgaggacgagactacgagtggaggaggagcgcgtgtgctttggtttggagcgagcgatggtgttcgcgtccgggtccgccgccggcgggccgcaggtgctgacggcgcggttcgtgcggcaggtggtgcagggccggtggttcatggtgttcgcgtgcctgctcatcttgtcggcgtcgggcgcccactacatcttcagcatctactccgaagtgctncagtcgacgctggggtacgaccagcgcacgctcaacacgctctgcttctacanggacctgggcgcccacgtggacgttggcgtcatttcggggctcatcacgaggtcccgccgcgtgggtggtgctcgccatggccgccgcatgaacctgggcgggctacctcatgatcttccttgccctcgaacggcgcccgggagggccccccttttggctctgggcctctaaatctgggtggggcccaattcccgtcctttc

SEQ ID NO: 71306 - protein, 128 aa, Zea mays
  misc_feature: Ceres CLONE 1552626
  misc_feature (72)..(72): Xaa is any aa, unknown, or other
MVFASGSAAGGPQVLTARFVRQVVQGRWFMVFACLLILSASGAHYIFSIYSEVLQSTLGYDQRTLNTLCFYXDLGAHVDVGVISGLITRSRRVGGARHGRRMNLGGLPHDLPCPRTAPGRAPLLALGL

SEQ ID NO: 71307 - DNA, 651 bp, Zea mays
  misc_feature: Ceres CLONE 1552627
  misc_feature: Encodes the peptide sequence at SEQ ID NO. 71308
ggagctccccgcggtggcggccgctctagaactagtggatcccccgggctgcaggaattcgtctcacccctagaaaaacccctcacctctcactaccaccaccactgccccggatccataccagctgcagcagcagcgcgcgcgagctagcttcggtcggtcgatagatcgatcgatcgctcggccatcatggcgcgggaggagcaggcgctgctgtcgacggagatcgtgaaccgcggcgtggagccgtcgggcccggacgccggctcgccggccttctcggtgcgcgtgcgccgccgcctgccggacttcctgcagtcggtgaacctcaagtacgtgcgcctcgggtaccactacctcatcagccacggcgtgtacctggccaccatccccgtcatcgtgctggtgtgcggcgccgagctgggcagcctcagccgcgacgagctgtggcgcaggtggtgggggggaggcacctacgacctcgccaccgtgctcgccttcctcggcgtcctcgcctttcacatctccgtctacctatgtccaggcccagggccgtggtacctatcgacctcccatggtacaagcggccgacgaactccaggggtccagggcggagtcctccacctggcgcgcagtcccggaagttcaaaa

SEQ ID NO: 71308 - protein, 154 aa, Zea mays
  misc_feature: Ceres CLONE 1552627
  misc_feature: SWISSPROT Homolog: EC 2.3.1.119 Icosanoyl-CoA synthase
MAREEQALLSTEIVNRGVEPSGPDAGSPAFSVRVRRRLPDFLQSVNLKYVRLGYHYLISHGVYLATIPVIVLVCGAELGSLSRDELWRRWWGGGTYDLATVLAFLGVLAFHISVYLCPGPGPWYLSTSHGTSGRRTPGVQGGVLHLARSPGSSK

SEQ ID NO: 71309 - DNA, 607 bp, Zea mays
  misc_feature: Ceres CLONE 1552628
  misc_feature (164)..(164): n is a, c, t, g, unknown, or other
  misc_feature (173)..(173): n is a, c, t, g, unknown, or other
  misc_feature (178)..(178): n is a, c, t, g, unknown, or other
  misc_feature (179)..(179): n is a, c, t, g, unknown, or other
  misc_feature (186)..(186): n is a, c, t, g, unknown, or other
  misc_feature (254)..(254): n is a, c, t, g, unknown, or other
  misc_feature (321)..(321): n is a, c, t, g, unknown, or other
ctggagctccccgcggtggcggccgctctagaactagtggatcccccgggctgcaggaattcgtctcacccctagaaaaagtgtcgtccccccggccccgacccccctccgtttgccaacgactccgggctccactgtcgctctcgctcccttcccctccacgncatggtggncgatnncgctcgnctcgcgctgctgctctccgcgtgcctctgctccgcgtgggcgcgccacgcctcgaggcgaaccatcgncttgcgttcgaacgcgccgggggcgaccaaaacgaagaccaccccctcgggaccccggtgggccctntttatttccggggtcaaaaggttattacaacatacggcccccaaggggaaattttgccctgggtcccccaatattgaaaaaggggggacctttggaccaaaaaaaccctggtcttcctgtagcgaaaaaaacccgcgaaaaccccgaaaaatccaaggcccggggggtcccttaattaatccccccgggggggggccccttttcctgggggggggcaaaagaataaacccgggggggaagagtaaccccccccaaaatttttctccggggttgggcttggtaaaaa

SEQ ID NO: 71310 - DNA, 519 bp, Zea mays
  misc_feature: Ceres CLONE 1552635
  misc_feature (335)..(335): n is a, c, t, g, unknown, or other
  misc_feature (341)..(341): n is a, c, t, g, unknown, or other
  misc_feature (354)..(354): n is a, c, t, g, unknown, or other
  misc_feature (394)..(394): n is a, c, t, g, unknown, or other
  misc_feature (396)..(396): n is a, c, t, g, unknown, or other
  misc_feature (397)..(397): n is a, c, t, g, unknown, or other
ggagctccccgcggtggcggccgctctagaactagtggatcccccgggctgcaggaattcgtctcacccctagaaaaaaagggaaagcattctccaatatccacctcctcctcgcccctctctctctctctctaaaagaatgaaaagataaggggaaaatcctcaagtgctcgttacataaaccctaacctcgttggattcgcagcaaaagcccaccaattggaagccctccgatgttccagctgcatgctggagctgagccgtgctcggtttgacgaaattttgcatcccttctgtgcttggacacccgattgagctgttctccgaggggcgtngcagcngtttcgcggccangtccctcactgtactatccggcgccggatccggttttgtncnngtgagaggtcgggctttttggtgggggtctgttccagccttggaacctccaattttccccgccctaaattggaacccccaaatggcggggggcggggaatttagggtaatccccgcccattt

SEQ ID NO: 71311 - DNA, 669 bp, Zea mays
  misc_feature: Ceres CLONE 1552636
  misc_feature: Encodes the peptide sequence at SEQ ID NO. 71312
ggagctccccgcggtggcggccgctctagaactagtggatcccccgggctgcaggaattcgtctcacccctagaaaaagcattgcattgtgcattgcattgcataaacctctcgtgggaagtgcaaacaccaaatccgcaatctatctatctatcagccattcaggcctgcaggctgcagctctctccactgcacactagagcgagctgccacagacaaggacacaatgcctcccatacccaagagaggcgagcatctcctggtcctcctaattgtcgcatgcgctgccaccgccgccaccgccgccggcaccgtccccttctacccgtccgcggagtccgccgccgccgcgcactgcgacggcacgctgtacccggagctctgcctgtcgacactcgcggacatcccggacctacacaagaagccgctcacggacgtcatctgcgcggccgtgaaccgcaccgaggacgtggtggtcgccacatccaacaactgctcgtactacctgcaggacacgtccctgtcggcgcgggaccccctggccctcaacgaatgcctggagctgctgtcgccacaatgaaaaactccgcgcaaaatctgccaactggtgttcccccccggtagggggtacgcccccgaaggcatttccaaaggccccgggtcccaaaa

SEQ ID NO: 71312 - protein, 117 aa, Zea mays
  misc_feature: Ceres CLONE 1552636
  misc_feature: SWISSPROT Homolog: EC 3.1.1.11 Pectinesterase
MPPIPKRGEHLLVLLIVACAATAATAAGTVPFYPSAESAAAAHCDGTLYPELCLSTLADIPDLHKKPLTDVICAAVNRTEDVVVATSNNCSYYLQDTSLSARDPLALNECLELLSPQ

SEQ ID NO: 71313 - DNA, 2608 bp, Zea mays
  misc_feature: Ceres CLONE 1552641
  misc_feature: Encodes the peptide sequence at SEQ ID NO. 71314
aaaaaaaaagagcaggaagcggaaagccttccgcgcttttcaaagatcgtaggccgcacgcctgcagcagccgccgactcagggcgagcgttgagaggaggacgaagaagagactgaagaagagcagaccgaagtgaggccgaaggaagggatcgggccttgcgggattcggcagtccatcacgaggtaaatgcggcgctaggagctgcagcgatggcgtcgctggtacccggggtcctcctcaagctcctgcagcacatgaacagcgacgtcaaggtcgcgggcgagcaccggtcgtcgctgctccaggtcgtcagcatcgtgcccgcgctcgccgggagcgacctgttcaccaaccaggggttctacctcaaggtgtccgactcgtcgcacgccacctacgtgtcgctgccggacgagcagcacgacctcatcctgagcgacgtcatccagctggggcagttcgtccatgtcgatcgtctcgaggcggccaccccggtgccgatcctcaggggggtcaggccggtcccaggccgccatgcctgcgtcggcaacccggaggatcttgtggtgaccagctcctccacttttcttcttggcagcggcaaggccgcccaagcctcctccaccaatggtagttccaaggacgccggtgccctgtcgctagagaaagagcagggcaggttagagaagatcaatgcttctgccaagagcaacggcacagagagcaagaagccccagctcaccaagtcgaactccaacctctcgaaacaggcgctcaatggcctcctctcggacaagaaggacgtggttagctcgaaggcaaaatcaaccagcgctaggtcgacgccgtcttccccgaccagcgcccattctctgcctgcgtcgttcgataaattctcgagtgacatgaaacagagagtgagaaccaaaggagcagagaaatcgccgccgtcaaggctgtccttgctagaaaaggctgcgtctgtgttgaaggccactacggcagggaggaagtcctccctgggtaattccattagtaacaccttgttgagcttcgaatctgggcccaaggccttgagaagaagctgggaagggaaagcagatgcgaaggacaaaggcaattcggattcaaagcctgccaaagctgaaaagaagtctgaaaatcgaagctcttcgactcccagacgaaaatcattagcagaagagaaaccatcgaataaggatgacagtaagattctgactccacccaggaagagctcagcgagtgctcctgcagacgattccgacaaagttgtgaacaacaagctttcttctcctataaggaggacatcaggggttttaaataacccgaatgtcactaatctagtgaaggttgctgcaagtagcaggaaactgacagatgctagcgcttcgtggacaacgcttcctccatcactcgctaaactagggaaggagcttctgaagtacagggatgcagcacaaatggctgctgttgaagccatgcaagaagcttctgcggcagagagcattgttcgatgtttaagctcgtacgcggaggtgagctcgtcggcggaggagcagaacccacagcaggctgtcgagcagttcctcgctctgcatggagcaatctctcgagccaccatcgtcaccgagtctctaaccaaggccacgaccacggtctccaccgcgacttcaccagatcaatcagcagccggcgatgcgtcaacagccgacgaggaaaccatggctgtcgcggcggagcgccgccgccgggcagcctcctgggtcggcgccggcctcgccaccgatctctccgccttctccctctacaacctgaaacccgccccagccagtgtcatctccccgctggccgtcgtgctcgtggacgagtcagccaagccggcggcggcgaaggcagtgccgcccgcgaagtcgcggctgtccccggcgaaggggaggttgaaagctggttccgcggccgccgccgccgccgccgctgcggcggcggcagcagtgccgccgcctgaatgggagcggggaggcggcgcggaggagcggggcgagcttgcgcggcggctcggggacgaggcacgggcgtggttcctggcgttcgtggagcggttcctggacgcggacgttgcggcggccgcgccgtgggaccgcgaccgcgccgcgaggatgctcccgcagcttaagcgcgtcaacgactggctgagcgagatcgggaagtcggcagagatggcgccgcatccgccaccggaagcggacggcgaagcggcggcacccactgccaacggcggcgcggccagcggcgtgccggaggagacgatagagaggctcaggaagaagatctacgagtacctcctcaccaacgtggactctgctgccgccgtgctcggcggctgcgagatggcgccggcaccggtggcgaacgggaagaaggggtgacgatagtgggccgcgaaggaaggcccaattgggccgttaacttggctgagccaaaacatgggccggtctggatttaaatgtaaaaatgggctggattgagattgcagtggttgttttggtacttttctctggtgttacagaaaaaaaaaaaaaaaaa

SEQ ID NO: 71314 - protein, 745 aa, Zea mays
  misc_feature: Ceres CLONE 1552641
  misc_feature (1)..(731): Pfam Name: DUF936 Pfam Description: Plant protein of unknown function (DUF936)
MASLVPGVLLKLLQHMNSDVKVAGEHRSSLLQVVSIVPALAGSDLFTNQGFYLKVSDSSHATYVSLPDEQHDLILSDVIQLGQFVHVDRLEAATPVPILRGVRPVPGRHACVGNPEDLVVTSSSTFLLGSGKAAQASSTNGSSKDAGALSLEKEQGRLEKINASAKSNGTESKKPQLTKSNSNLSKQALNGLLSDKKDVVSSKAKSTSARSTPSSPTSAHSLPASFDKFSSDMKQRVRTKGAEKSPPSRLSLLEKAASVLKATTAGRKSSLGNSISNTLLSFESGPKALRRSWEGKADAKDKGNSDSKPAKAEKKSENRSSSTPRRKSLAEEKPSNKDDSKILTPPRKSSASAPADDSDKVVNNKLSSPIRRTSGVLNNPNVTNLVKVAASSRKLTDASASWTTLPPSLAKLGKELLKYRDAAQMAAVEAMQEASAAESIVRCLSSYAEVSSSAEEQNPQQAVEQFLALHGAISRATIVTESLTKATTTVSTATSPDQSAAGDASTADEETMAVAAERRRRAASWVGAGLATDLSAFSLYNLKPAPASVISPLAVVLVDESAKPAAAKAVPPAKSRLSPAKGRLKAGSAAAAAAAAAAAAAVPPPEWERGGGAEERGELARRLGDEARAWFLAFVERFLDADVAAAAPWDRDRAARMLPQLKRVNDWLSEIGKSAEMAPHPPPEADGEAAAPTANGGAASGVPEETIERLRKKIYEYLLTNVDSAAAVLGGCEMAPAPVANGKKG

SEQ ID NO: 71315 - DNA, 711 bp, Zea mays
  misc_feature: Ceres CLONE 1552645
  misc_feature: Encodes the peptide sequence at SEQ ID NO. 71316
  misc_feature (273)..(273): n is a, c, t, g, unknown, or other
  misc_feature (313)..(313): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (408)..(408): n is a, c, t, g, unknown, or other
  misc_feature (411)..(411): n is a, c, t, g, unknown, or other
  misc_feature (413)..(413): n is a, c, t, g, unknown, or other
  misc_feature (491)..(491): n is a, c, t, g, unknown, or other
  misc_feature (530)..(530): n is a, c, t, g, unknown, or other
  misc_feature (531)..(531): n is a, c, t, g, unknown, or other
  misc_feature (555)..(555): n is a, c, t, g, unknown, or other
  misc_feature (556)..(556): n is a, c, t, g, unknown, or other
  misc_feature (565)..(565): n is a, c, t, g, unknown, or other
  misc_feature (614)..(614): n is a, c, t, g, unknown, or other
  misc_feature (657)..(657): n is a, c, t, g, unknown, or other
ctgctggagctccccgcggtggcggccgctctagaactagtggatcccccgggctgcaggaattcgtctcacccctagaaaaattcgacgagatctcggaggctgcctcgaggtgaccctgttctgattctcgtggtttcaggggaggatctaggtccagggagattaatctccaggttggacctcacatttttatggcctttgactgcaacaaggaaagaggagtttcttcgcctgacagttgctcccgcatttgcaccgagggcactctcntccaggcaaatcccttatctcactactggaagcctaaacntttggagaactttcacaagttgggagaacccgaagtcccgttatgaatcttctccccaccccctcggaggggaggggggggggttaaannnantnttnancccacctccctccctgggtgggcttcaagagccttccctggtctggcgcgctcctttgttctccaaagtcccttcccntttccaatggaaaaaacccttggaattgttatccccggnncccccccccccgtggacgctttannaccggatantttggggggggagaaaaatttttctctcgaaaaagggggggcctttccnaaaatcttcccaccccccggaaaaggggccccctgttctcccngggttcccccctcgaagggaggaattttttaaaaaacctttttttccgggggag

SEQ ID NO: 71316 - protein, 37 aa, Zea mays
  misc_feature: Ceres CLONE 1552645
AGAPRGGGRSRTSGSPGLQEFVSPLEKFDEISEAASR

SEQ ID NO: 71317 - DNA, 646 bp, Zea mays
  misc_feature: Ceres CLONE 1552647
  misc_feature: Encodes the peptide sequence at SEQ ID NO. 71318
  misc_feature (368)..(368): n is a, c, t, g, unknown, or other
  misc_feature (372)..(372): n is a, c, t, g, unknown, or other
  misc_feature (384)..(384): n is a, c, t, g, unknown, or other
  misc_feature (491)..(491): n is a, c, t, g, unknown, or other
ctccccgcggtggcggccgctctagaactagtggatcccccgggctgcaggaattcgtctcacccctagaaaaaatctttgtccacaccgcagccgccgcccgctcgctcgcctccgctccggcagcgagctctatctcccgcgacgagcagcagctgccaccgacgcacgcagaccggggaataaatattggtattggtagtgtgatatctataagaagtcaagatggtgaagttcacagctgaagagctccgtgctatcatggacaaagagaaaacattcgtaacatgtctgtcattgctcatgtggaccatggcaagtctacgcttacagattcccttgtggcagctgctgggatttatgcccangaangtgctggtgatngtcgcatgactgatactcgtgcagatgaagcagagcgtggcattaccatcaaatctactgggatatctctttactatgagatgactgacgagtcactgaagaacacnagggtgagagagaatgtaaccaatacttgatcaccttattgactccgcttgaaccgttgatttttctttggaaatcaagagtggtcttcaataccgaagggcccttggttggggtaactgaattgaaaagggtctggtgccaaccgaaaattggc

SEQ ID NO: 71318 - protein, 77 aa, Zea mays
  misc_feature: Ceres CLONE 1552647
  misc_feature (27)..(27): Xaa is any aa, unknown, or other
  misc_feature (29)..(29): Xaa is any aa, unknown, or other
  misc_feature (33)..(33): Xaa is any aa, unknown, or other
MSVIAHVDHGKSTLTDSLVAAAGIYAXEXAGDXRMTDTRADEAERGITIKSTGISLYYEMTDESLKNTRVRENVTNT

SEQ ID NO: 71319 - DNA, 628 bp, Zea mays
  misc_feature: Ceres CLONE 1552649
  misc_feature: Translation starting site: 137
  misc_feature: SWISSPROT Homolog: EC 1.8.1.9 Thioredoxin-disulfide reductase
  misc_feature (358)..(358): n is a, c, t, g, unknown, or other
gcggtggcggccgctctagaactagtggatcccccgggctgcaggaattcgtctcacccctagaaaaaatcctcccctccgcccaccaacgcagcagcagccagcagccccgccacttcccccctcgccgcttgcgatggcggtcacgcgcgtcgccgtggccgccgccctctcggcggccccgctctcctcccgccgccaccgggttgccctcccctccgcctgccgccttctccccgcctcggccacctgctgcaacagccgcgcgccgatgtctctgcaggccgccgccgccgcacctgccgccggcgcggtcgacgaggagactcctgcctcctcccctccgtcagatgctagncagggggtggagaacctggtgatcatcggctctggaccagcccggtacaccgctgccatctacgccgcccgggcgaacctgaagcctgtcggtgttgaagggtgcagaatgggggggtgtcccccggcgggcagctgatgaccaccaccgaggtggaggatttccctggcctcccgggacggtataccgggcctgatctcatggacagatgcgcaagcaagcggaacgctggggcgcaaagctttaccaaaaggatgttgagtttgtaaa

SEQ ID NO: 71320 - DNA, 465 bp, Zea mays
  misc_feature: Ceres CLONE 1552653
tggagctccccgcggtggcggccgctctagactagtggatcccccgggctgcaggaattcgtctcacccctagaaaaaaagagtgaaggaggagcctgcccgcgcctgcgcctggttgtaattgtagctcacgctcacccttcagttgaccaccgctgcggcagcaatgggcgggcgagtcgccgggcagcaccgccccgcggcttcccccgctggtcccccgctgctggctgtccccctccctgggcgggcccggccgcccgtaaggggccggccccttaattcttccgaaaaggggggggcccgggccccgggggcccggtttccttccccggggttaaattcccccccccttccgggggggcccccccccgggcccaaaagggccccaaatgggaaaaaaaaaaaccccaagggggttttttcctcccccccgggggaaacacccccccccggggggggggg

SEQ ID NO: 71321 - DNA, 657 bp, Zea mays
  misc_feature: Ceres CLONE 1552654
  misc_feature: Encodes the peptide sequence at SEQ ID NO. 71322
  misc_feature (584)..(584): n is a, c, t, g, unknown, or other
  misc_feature (611)..(611): n is a, c, t, g, unknown, or other
  misc_feature (635)..(635): n is a, c, t, g, unknown, or other
  misc_feature (649)..(649): n is a, c, t, g, unknown, or other
gctctagaactagtggatcccccgggctgcaggaattcgtctcacccctagaaaaaaccaagagatccacgaatatacccatcccattccccacaaggctccgtcccttcggcggcggcgatgtctctcccccctggcccggcggacagtggcgccggcaccggagacgactggttcctcgactgcggcatcctcgacgacctgcccgccgcggcctgcggggccttcccgtgggacgcgtccccgtcgtcttccaaccccaggtccgcccagatcgaccgaccgattcctcccttccccacgccacctcctagttccggaaggcacggatgctttgtttggcgtacggtcccgtgaccccggcgttccgtatctttgcgatgagtatattgtggaatcgtgacgggcggatgaattgttttggggatttgggctgtgtagtagtctactagatgcatgcgcgtggaggcgtctgatccgtagaggtggtttctttacacagcggatcttccagtctgttgctcgtgctataaacctgccgaggctgcttttgtacaggttaaattagattagagttcccaaancaaaaaaaaaaggtttcctaaaaaaancaggctgctgagtttgcgcgctgncagataacttgccnttggtagg

SEQ ID NO: 71322 - protein, 78 aa, Zea mays
  misc_feature: Ceres CLONE 1552654
MSLPPGPADSGAGTGDDWFLDCGILDDLPAAACGAFPWDASPSSSNPRSAQIDRPIPPFPTPPPSSGRHGCFVWRTVP

SEQ ID NO: 71323 - DNA, 664 bp, Zea mays
  misc_feature: Ceres CLONE 1552655
  misc_feature: Encodes the peptide sequence at SEQ ID NO. 71324
  misc_feature (592)..(592): n is a, c, t, g, unknown, or other
tccccgcggtggcggccgctctagaactagtggatcccccgggctgcaggaattcgtctcacccctagaaaaagccccgtcccaaatcccctgtcccgctagcggctagtccgaccaggcgatccccccccaaaccctcccccaaaaccccagagcggagaagagcgcaagatgttcggcttcgggcaccacggccagaacccgccggctcacggcggcgtgcaccagcccaccttcaagatcttctgcaagtccgacgaggggtactgcctcaccgtccgcgacggcaacgtggtgctggcccccgccaacccgcgcgacgagcaccagcactggtacaaggacatgcgcttcagcacccaggttaaggacgaggagggcaaccctgcgttcgccctggtcaacaaggccactgggctcgccatcaagcactccctcggccagtcccacccggtgaagctggtgccgttcaacccggagtaccaggacgagtcggtgctgtggacggagagcggcgacgtgggcaagggcttccgctgcatccgcatggtgaacaacatccgcctcaacttcgacgccttccacggcgacnagggccacggcggcgtgcacgacggcaccaccgtggtgctgtgggagtgggccagggcgacaacagagctgt

SEQ ID NO: 71324 - protein, 164 aa, Zea mays
  misc_feature: Ceres CLONE 1552655
  misc_feature (141)..(141): Xaa is any aa, unknown, or other
MFGFGHHGQNPPAHGGVHQPTFKIFCKSDEGYCLTVRDGNVVLAPANPRDEHQHWYKDMRFSTQVKDEEGNPAFALVNKATGLAIKHSLGQSHPVKLVPFNPEYQDESVLWTESGDVGKGFRCIRMVNNIRLNFDAFHGDXGHGGVHDGTTVVLWEWARATTEL

SEQ ID NO: 71325 - DNA, 657 bp, Zea mays
  misc_feature: Ceres CLONE 1552656
  misc_feature: Encodes the peptide sequence at SEQ ID NO. 71326
agctccccgcggtggcggccgctctagaactagtggatcccccgggctgcaggaattcgtctcacccctagaaaaaactccaaccgccgagccagaagcacccggagcagcgcacagcaacagagcacacgccgcacaccgccgcctccgcagcagcagcaatggcgcgcgccggcgctctctgcctggtgctgctctgcctcgtggccgcgcactcagccgcggcgcagaagtccacgacagccccggccgccgcgccggccgccgccaccaccccgccggcgaccccgaccaagaagacgcccgcgcccgccgccgcgccgcccaccaccccggccaccctggccccggccgccgcgccgcccaccacgccggccacccccgcgcccgtcgctgcggcgcccactaccccggccaccctggcacccgccgcggcgccgcccaagtccgcccccaaggcgtcccatcccgccccgtcgcccaaggccaaggccaccccgccggtggccgagctgccgcccgccgcctcgcctcccgcccccgcccccgcctccccgcccaccaagcccgccgaggtccccgcgcccgcgccgtccaagaagaagaagaagccctcctcgtcgtccaagaacaagaagaagaagtccaaggccccgg

SEQ ID NO: 71326 - protein, 165 aa, Zea mays
  misc_feature: Ceres CLONE 1552656
MARAGALCLVLLCLVAAHSAAAQKSTTAPAAAPAAATTPPATPTKKTPAPAAAPPTTPATLAPAAAPPTTPATPAPVAAAPTTPATLAPAAAPPKSAPKASHPAPSPKAKATPPVAELPPAASPPAPAPASPPTKPAEVPAPAPSKKKKKPSSSSKNKKKKSKAP

SEQ ID NO: 71327 - DNA, 680 bp, Zea mays
  misc_feature: Ceres CLONE 1552658
  misc_feature: Encodes the peptide sequence at SEQ ID NO. 71328
ctggagctccccgcggtggcggccgctctagaactagtggatcccccgggctgcaggaattcgtctcacccctagaaaaacatgactcgtctgccagggagatcgagcccgacatgctggggcagcagcggcgctcgttcggcctagccagaggcatgaaggacgaggtgctgatgcgcatgatggatggatcaggatcacatagcagcgcagccgatgccatccatgacgacgccccgaatggcatacagctcgatttcggcgttctgggcagccacggcccgccggcgcagggcggccaaggctccttgtctctgagcctcaacacgcacatcatggcgcctgccttgccgtactggcctgtcgtcaaggcagacatgctgtcgccgcactcctacgaccatggctgcggcggcggcagcggcggccttggctcggagccgtcgcgggcgatccggaactcgaggtatctgaaggcggcacaggagctgcttgacgaggtcgtcaacgtctggaacagcatcaagcagaaggcccagaaagagcaggtggaggcagggaagacggaaggaaagggagaaacgagggaggagggcccaagagtgcaggtccgcaggagtctgggcccaacgctgcaccgggagctttctactgccgaggagcaggagcttcagaacaag

SEQ ID NO: 71328 - protein, 226 aa, Zea mays
  misc_feature: Ceres CLONE 1552658
  misc_feature (149)..(226): Pfam Name: POX Pfam Description: Associated with HOX
GAPRGGGRSRTSGSPGLQEFVSPLEKHDSSAREIEPDMLGQQRRSFGLARGMKDEVLMRMMDGSGSHSSAADAIHDDAPNGIQLDFGVLGSHGPPAQGGQGSLSLSLNTHIMAPALPYWPVVKADMLSPHSYDHGCGGGSGGLGSEPSRAIRNSRYLKAAQELLDEVVNVWNSIKQKAQKEQVEAGKTEGKGETREEGPRVQVRRSLGPTLHRELSTAEEQELQNK

SEQ ID NO: 71329 - DNA, 679 bp, Zea mays
  misc_feature: Ceres CLONE 1552660
  misc_feature: Encodes the peptide sequence at SEQ ID NO. 71330
  misc_feature (679)..(679): n is a, c, t, g, unknown, or other
ggagctccccgcggtggcggccgctctagaactagtggatcccccgggctgcaggaattcgtctcacccctagaaaaaacgagcgagagagcgggagacgagtcgcggcgcctctgctgtgctgtcttcttctccccctctgctctgcttcggctcctcacgcggcctcgccgagacccgcagaacagggggttcagacttcttggtgagagcgatatgagtgtcccaggtcaatgctcatcccagccacaatttatcaccagcgttgggaggagtaaccgctccaatggccccggcactcctcttatcgaaagcatagatgttgatcaaattgttattccagagaaaaacagttggaagaacttattctcatacatagggcctggatttctcgtctcaattgcatatattgatcctggaaactttgagacggatctacaggctggagcacagtacaaatatgagcttctttggatcatacttgttgcatcctgtgctgctcttattattcaatcacttgcagccaggctaggggttgtgacagggaaacatcttgcagagcattgcagggctgagtatcccaaggtcacaaattttgtcttatggattcttgcagaacttgctgttgttgcatgtgacattcctgaagatcccagtattgggtgtggtgttctaatan

SEQ ID NO: 71330 - protein, 154 aa, Zea mays
  misc_feature: Ceres CLONE 1552660
MSVPGQCSSQPQFITSVGRSNRSNGPGTPLIESIDVDQIVIPEKNSWKNLFSYIGPGFLVSIAYIDPGNFETDLQAGAQYKYELLWIILVASCAALIIQSLAARLGVVTGKHLAEHCRAEYPKVTNFVLWILAELAVVACDIPEDPSIGCGVLI

SEQ ID NO: 71331 - DNA, 840 bp, Zea mays
  misc_feature: Ceres CLONE 1552661-R
ccgattgggtacctcgagcgtctcgtttttttttttttttttctcaatctttactagattctgtgttgagtgcaacaaattaaaatcgatgcaatacatcctctcgaagaaataaaaccaagaagttacaagtctatagattctgtgtcaccgtgaacgattaccagatggtgttttgagtctgtcattcccatgtggtgggctatcatctctctcccttggcaaccgaagtgacttaaaaaagctaatagccatctcgaggatacagctacctcctgtgtaatatgcgtagtgacataaaacaaaagctactcagcctccttagcatctgaaatttcgatgtcagatgctttgctttcaggaagagactctctgatcgtccacctcagtggcacaatcaagcagctcgtctgatccagcaatctcctggctggggtttctctttatccccttttggggggatttttgagcccccatggccgcaaagaaaatcctcctcaagccaattcttttacccatctaggcggaaaaaacccatgaaccccacaaatttgggtcttttcccttttcccagaaaaacaatgggcaaatgggcccaaaggggaatctggttaacccttttgggattcgcataattcccgggaaaggccccctttcccctgtaataaaacttaccaaaaaccagggcaacaccctggggaaaacaaaaaaagcctgaaaaaccctttcccccccaccccaaaaaaatattttgttcgcttccccccccgaaaaatattccgggggaaaaaaattttttaaaataggcccccccctttgaactcggggcgaaaaaaaaac

SEQ ID NO: 71332 - DNA, 668 bp, Zea mays
  misc_feature: Ceres CLONE 1552661
  misc_feature: Translation starting site: 259
  misc_feature: SWISSPROT Homolog: EC 2.1.1.29 tRNA (cytosine-5-)-methyltransferase
tccccgcggtggcggccgctctagaactagtggatcccccgggctgcaggaattcgtctcacccctagaaaaacctccccggcgccccttcccctgcccaccacctcccctcgctggtgtcggccctggccccagcgaccacctcctcggctactgcttctgcggggttgatctcccccctcccggggagaaaattttcatgaattcttgaagcgagagaacgaagttggcaacataactaggcaagaggctgttagtatggtcccaccactgtttctgaatgtgcaacctgatcatcatattcttgatatgtgtgccgctccaggatctaaaactttccagttacttgagatgattcaccagtcaacgaagcctggactgcttccaaatgccctggtggtagctaatgatgttgatgtgcaaagatgcaatcttcttattcaccaaaccaagagaatgtgcacagctaacctgattgtgacaaatcacgaagcacaaaactttcctgtggcgatgggactgtccgtaaggctcctgatatgtggaggaagtggaatgctggtatggggaacggacttcatcacctgcaagtggaaattgctatgcgtggtatgagcttgctcaagtgggtggggaaggatggtttattcgacatgttcaatgaaccc

SEQ ID NO: 71333 - DNA, 687 bp, Zea mays
  misc_feature: Ceres CLONE 1552663
  misc_feature: Encodes the peptide sequence at SEQ ID NO. 71334
  misc_feature (403)..(403): n is a, c, t, g, unknown, or other
  misc_feature (471)..(471): n is a, c, t, g, unknown, or other
ctccccgcggtggcggccgctctagaactagtggatcccccgggctgcaggaattcgtctcacccctagaaaaaatcaggcccacgctttgttaacaaagaattccctcatagccgccgccgccgccgccgccgccgccgccgctcatctcgccgagaggtgacgggaccgaggaactcgccgagttctaagatagagaatcgcttttcacagcctggggtctgctgcgtagggtggtggttgaaggggagaagtttaagatctgttccacagatcacgcgtgcgcgctcgcgaatcgggggttccacacatagcttcgtcgttttgaatttgatgtactaatggagtctaagggtgggcagaagtctagcagtagtcgttccatgatgtatgaagctccccntggctacagcattgaggacgttcgacctgccggaggcgcgaagaagttccagtctgctgcttactccnactgcgcaaagaagcatcctgatatcccttttggcttcctcgttctaggagttaagggattccttttcggacctttggattcttaccaatcccctgggcctgggtgttttccggaaaaatcaaccagttcccaagttttgggccccgtgggggcccccccccccccatcccccggggtggggtccgaaccccccggcccaaggggtgtttcttttg

SEQ ID NO: 71334 - protein, 115 aa, Zea mays
  misc_feature: Ceres CLONE 1552663
  misc_feature (1)..(50): Pfam Name: AdoMetDC_leader Pfam Description: S-adenosyl-l-methionine decarboxylase leader peptide
  misc_feature (21)..(21): Xaa is any aa, unknown, or other
  misc_feature (44)..(44): Xaa is any aa, unknown, or other
MESKGGQKSSSSRSMMYEAPXGYSIEDVRPAGGAKKFQSAAYSXCAKKHPDIPFGFLVLGVKGFLFGPLDSYQSPGPGCFPEKSTSSQVLGPVGAPPPPSPGVGSEPPGPRGVSF

SEQ ID NO: 71335 - DNA, 653 bp, Zea mays
  misc_feature: Ceres CLONE 1552666
  misc_feature: Encodes the peptide sequence at SEQ ID NO. 71336
  misc_feature (615)..(615): n is a, c, t, g, unknown, or other
  misc_feature (638)..(638): n is a, c, t, g, unknown, or other
ctccccgcggtggcggccgctctagaactagtggatcccccgggctgcaggaattcgtctcacccctagaaaaagaagcgcagagcgcagccattgatgagagccacgagggcgggccccacaggagcagttccacgcagacgcgcacgccatttgtttttctttttgtgtttttgtccagcagcctacgtagaggacggcaggcacgcaccggcaccaccatataacaggaggcgcgtctctgcaagtctgcactcggacggacgagcgaggcagacccgcaggtcgcagccacaacccaagcgcagcgctctgcctgcctccgctccggctcagctcccgccctgcctccgccttccattccaccgcgcggcgctgccgagtgccgacgtcgtccccgccgaagtttctggtttctgggttggatctctcggagtcggagcgagcgaggatgggcggcggcaacggtgaaaccacccagctgggggagccactgctggcgaagaaggcgaaggcgtatcgccctaggtgccccggctgccgggtggaccgcctcaacgcggagcggggagggtgtctttcctctcaagggactcttcctcatctggctcgtcnacatcacctgcaccctgccgatncagtctctgttcccc

SEQ ID NO: 71336 - protein, 67 aa, Zea mays
  misc_feature: Ceres CLONE 1552666
  misc_feature (55)..(55): Xaa is any aa, unknown, or other
  misc_feature (63)..(63): Xaa is any aa, unknown, or other
MGGGNGETTQLGEPLLAKKAKAYRPRCPGCRVDRLNAERGGCLSSQGTLPHLARXHHLHPADXVSVP

SEQ ID NO: 71337 - DNA, 654 bp, Zea mays
  misc_feature: Ceres CLONE 1552668
  misc_feature (367)..(367): n is a, c, t, g, unknown, or other
  misc_feature (654)..(654): n is a, c, t, g, unknown, or other
ctccccgcggtggcggccgctctagaactagtggatcccccgggctgcaggaattcgtctcacccctagaaaaaggcatcgcaaccgcagcccgggatgcgctccaccccgaccgccaagcgcctgtcgccgcccgcgatgcgctcgaccccaacaaattctctcacaagatctggcgaaacccatcacctccgctctcctcctctaccctcgggatcctggtggccaacgtcgtcctcgttggcgagatgacctccaagctccaccagacctcgcgctccaccgacgactggaggcctctgccccttcgggatctccttattcacaaggcgtcgaggccgccgtcgaccacgtcatgccgctacgnctaggaggaggcgtcgaccaacatcggcttcgcagtggcctaggcgtgccgtgctgatgtgctccgccgtttcgcccgcctccctccccaaagctgcttctaggccgtcgcgatggaggcaatcagcaacaccaggttaaccctcgagatcctggtggccgacagcgtggtcctcgtcggcgagatggtgacctccaagctcttccaaatctggcactccgctgacgtccagaggcctcgccccttttggatctccttaatcacaaggtggggacagcacacggctn

SEQ ID NO: 71338 - DNA, 624 bp, Zea mays
  misc_feature: Ceres CLONE 1552677
  misc_feature: Encodes the peptide sequence at SEQ ID NO. 71339
  misc_feature (624)..(624): n is a, c, t, g, unknown, or other
gcggtggcggccgctctagaactagtggatcccccgggctgcaggaattcgtctcacccctagaaaaaattgggaacctggagaaatcaggtcccgtcagtctcagttagagatggttgttaagctatatgagcaaatgtttggcccaaacggtccacaaacagaggaggagctaggtgaaattcctgatgcccaaacaagatacaatgagttcaaagcatcgcagaaggctgactcttccagccagccttcctatgatatcattgacaatgggcaggagttcgacattttcagtgttgtaactgatcgtgcatcatttgaaaagtttcaagcaaaaaaacctccccttgcttactgggttgaaatgaggaaaggtcgaatagcatggcttgagaaatatgttccaacaatttctcataaagacaagtacagggtttattttaatactcctgatggtgctttagaacgtattcctgcttgggctgcatatgttcttccagatgctgaggggaagcaatcctatgcagtacattgggaaccacctcctgaagaatttacaaatggagatttggacgtccaaaggtgaagggttcacttagaatatatgaatgtcatgttggaatn

SEQ ID NO: 71339 - protein, 157 aa, Zea mays
  misc_feature: Ceres CLONE 1552677
  misc_feature: SWISSPROT Homolog: EC 2.4.1.18 1,4-alpha-glucan branching enzyme
MVVKLYEQMFGPNGPQTEEELGEIPDAQTRYNEFKASQKADSSSQPSYDIIDNGQEFDIFSVVTDRASFEKFQAKKPPLAYWVEMRKGRIAWLEKYVPTISHKDKYRVYFNTPDGALERIPAWAAYVLPDAEGKQSYAVHWEPPPEEFTNGDLDVQR

SEQ ID NO: 71340 - DNA, 668 bp, Zea mays
  misc_feature: Ceres CLONE 1552681
  misc_feature: Encodes the peptide sequence at SEQ ID NO. 71341
  misc_feature (620)..(620): n is a, c, t, g, unknown, or other
ctggagctccccgcggtggcggccgctctagaactagtggatcccccgggctgcaggaattcgtctcacccctagaaaaaattgccgacgtagccgtcgtcttcgccagagcagcgccagcggttgttttgttcctcctcgtcggacccagcgttctagtcgagcatggcttcgattccgcctccgtcttcctccgtcgctgccctcacccgccaaccggcccagttcttgaaagggtgcagtgtatccaaggagacaaaggcatcggtctgcagtttcttggctacaaattcaaacagcactagggtgaaatcagtgggcttgagagtagcatcatccttcaaaaatgatggtggttatccagctgacggtttctctgggaatggcaacacgctattgccaaaaagcacatccgttcgtggcgaggaccatccggttgctgatcctgtactcccaatggattcaatgatgacgccagaaatcctctctgctaatttggcacttgttatggacaagttctcagatgatgacacagatactgaacttgatttggatagcccgacagagggctttcgcgtcgattgcagatgccattgaggacgtacgggcaggaaaacttngtgatttgttgtggatgacgaatcaggggaaattggaagagatctgaa

SEQ ID NO: 71341 - protein, 143 aa, Zea mays
  misc_feature: Ceres CLONE 1552681
MASIPPPSSSVAALTRQPAQFLKGCSVSKETKASVCSFLATNSNSTRVKSVGLRVASSFKNDGGYPADGFSGNGNTLLPKSTSVRGEDHPVADPVLPMDSMMTPEILSANLALVMDKFSDDDTDTELDLDSPTEGFRVDCRCH

SEQ ID NO: 71342 - DNA, 695 bp, Zea mays
  misc_feature: Ceres CLONE 1552682
  misc_feature: Encodes the peptide sequence at SEQ ID NO. 71343
  misc_feature (16)..(16): n is a, c, t, g, unknown, or other
  misc_feature (295)..(295): n is a, c, t, g, unknown, or other
cagtagtggagttcancgcggtggcgggcgctctagaatagtggatcccccgggctgcaggaattcgtctcacccctagaaaaaccatccatcacagcttcgagactcgtcctccatgggttctggcggcgtcagatggaaggctctgccgctgtgcctagctctcgtggctctgcaagcatgcctccctgctcgcggggcagctcccaagacttacatcgttcagatggccgcgtctgagatgccgagctcgttcgatttccaccacgaatggtacgcatccactgtgaaatcngtgaggtctgtgcaactggaaagaaaccctgaccaccattaccccgcgaggatcgtttaaaattcctacccccccctccggggggggggggggaaaacttgacaaaaaccaaaccccaaccgatgggccaaaacaaaaccctttgttgcccttgccccccggaaaaattcctttaattttacccccccccgggagacccgggattttcggggggtattacccccggaatttccccgcccccctttttggtccccccccggccctggcaaaccccaaaagtttttcttttggggggggttttaaaaaccgggttttgggccccaaaaaccccccccctttttgccgaaaaggggccccccgcgccctttccccgggcaaagagtgagaaggggccccgtcg

SEQ ID NO: 71343 - protein, 79 aa, Zea mays
  misc_feature: Ceres CLONE 1552682
MGSGGVRWKALPLCLALVALQACLPARGAAPKTYIVQMAASEMPSSFDFHHEWYASTVKSVRSVQLERNPDHHYPARIV

SEQ ID NO: 71344 - DNA, 663 bp, Zea mays
  misc_feature: Ceres CLONE 1552686
  misc_feature: Encodes the peptide sequence at SEQ ID NO. 71345
  misc_feature (581)..(581): n is a, c, t, g, unknown, or other
agctcaccgcggtggcggccgctctagaactagtggatcccccgggctgcaggaattcgtctcacccctagaaaaactcggtggctgcctggctggacgcctggacacctccaatccccagaccccatgcttcaccgcttcagccccgccggcgccgagcggccgactcgccgacggccgactccaatccccaggcttcagccccgccgagcggccgactcgtcgacggccaactcgcacgtgcttccgccggcagcctggcacagcaagcaggaagcagcaagcaagaatcagcggtcggtcgggcgtacgacagcaagcaggaagcagcacaggcgtctccatcctacaggaacatgaccgggatagtgattcctaattcatgaatgaagatggcgagctgtgaagaaatcttacaaatgtgtgtttgatgtcatgaagacattgaagaatgaagaccttatattgtgtccatatgtgtgtgtcggtgtgtgagtgtgactataagtctattactctattaattggtattgggtatggactggaatttatgtgggcagagtgaggtgtaggtttacttngttggatactgggatttgggaatggtggtatgggccccatggcccaatgggggaccttaaaaaaaaaaaaaaaaaagccaaa

SEQ ID NO: 71345 - protein, 77 aa, Zea mays
  misc_feature: Ceres CLONE 1552686
MLHRFSPAGAERPTRRRPTPIPRLQPRRAADSSTANSHVLPPAAWHSKQEAASKNQRSVGRTTASRKQHRRLHPTGT

SEQ ID NO: 71346 - DNA, 641 bp, Zea mays
  misc_feature: Ceres CLONE 1552687
  misc_feature: Encodes the peptide sequence at SEQ ID NO. 71347
gcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaggcagcaagcgatgaaaggagggacgcaagcagttagcctgatggtgcaccttgctgtgccatggctctgccttgcttcttgggcagctctgctaccagcgctagcatctggaaatgtgggtgcagcagctccgatactgagagcaattacataaattgaacttcagcacgcttcggcgacccccgacagtacagagctcatcgcttctgtcgtgctggctggtgagcaagcgggggcacagcagcgggatcccgtgctggtgacgaagacgaccgctcgcgctcgatcgtttctaacatcactctggtgacaaggcaggcgctccctaagctgaagatggatgtttccagagccacttccgggctaagtagcaggcacgcctttgcccccctaaaaataagggccccattttccccgggaatttgttaaaaggggggcccgggggaaaaaatttgggtttctttttttacaggaaccgggtcacttaga

SEQ ID NO: 71347 - protein, 47 aa, Zea mays
  misc_feature: Ceres CLONE 1552687
MKGGTQAVSLMVHLAVPWLCLASWAALLPALASGNVGAAAPILRAIT

SEQ ID NO: 71348 - DNA, 668 bp, Zea mays
  misc_feature: Ceres CLONE 1552690
  misc_feature: Encodes the peptide sequence at SEQ ID NO. 71349
  misc_feature (624)..(624): n is a, c, t, g, unknown, or other
ctccccgcggtggcggccgctctagaactagtggatcccccgggctgcaggaattcgtctcacccctagaaaaaatcctacccatcccattcccactccgccactcggccactcgacaccaccctccgcgctccgcatccgctcctccctctgctgccgtgccggtgccgctagccatccccacttctcacccgccccctctcctctactgccgccagccgcaacaaaatatggatagagcggccgcgacagccgcagacattatcgtcatgatcccatcgctctcgccttcgcctttgtagcactacctcctcgtccatccgcccccctatttcgtcccactcgggttgctagatcggactggatctctctgcccgtttcttggagcagagatggccgaaatgaccgtgactgtcgcggccgccaaaagcaccctccggacgtgccccggcgcccgccgtgctgcggttcttggtcggtggatgcctcttgcaccagcggcgcccgccaacttgaaattgttctctccagctgtgagggttccaagggctacttcccctgcggcggttgagcaggatggggagcacactgatatagtccctatcccgaaagttatatagaccnagactcagatccggatgcaacccatgtagaaataacctgggggg

SEQ ID NO: 71349 - protein, 75 aa, Zea mays
  misc_feature: Ceres CLONE 1552690
MAEMTVTVAAAKSTLRTCPGARRAAVLGRWMPLAPAAPANLKLFSPAVRVPRATSPAAVEQDGEHTDIVPIPKVI

SEQ ID NO: 71350 - DNA, 662 bp, Zea mays
  misc_feature: Ceres CLONE 1552695
  misc_feature: Encodes the peptide sequence at SEQ ID NO. 71351
  misc_feature (512)..(512): n is a, c, t, g, unknown, or other
ctccccgcggtggcggccgctctagaactagtggatcccccgggctgcaggaattcgtctcacccctagaaaagtctctctcctactgtttacacactgcagtggcctcgccggcgtcctccccctcctctctctcgctcctctgtcctctccacttgataaagaacacaattaggaaaaaataggcaaaaaaacatgtaccttttttctatctatattatctgaataaatcaagaagaggaagaggggagagggagcagggagggggaggagtagcaaatccagactccatagaatcagctcgcaagaaggggaaagggaggaggagcttcgctggtgaattgattgctcgctgctccagtcccgcattcgtgccgttttcggcaagtaggtggcgtggcaagcatggtgcctggctatgactgcgccgcctccgtgctgctgtgcgcggaggacaacgctgctggtctcgggctggacgacgagtcctcttgggcgccgcagctacgccngcacgcgacaccgtcgtcgccgccgcccgcggccgcgggggtgccgtcaacggtttctttgacgagttccccttgctccccgaagaactgctttgcggccctcggggaaaaaggaggggaacacttgcccgcggaaggggacctccaaag

SEQ ID NO: 71351 - protein, 85 aa, Zea mays
  misc_feature: Ceres CLONE 1552695
  misc_feature (36)..(36): Xaa is any aa, unknown, or other
MVPGYDCAASVLLCAEDNAAGLGLDDESSWAPQLRXHATPSSPPPAAAGVPSTVSLTSSPCSPKNCFAALGEKGGEHLPAEGDLQ

SEQ ID NO: 71352 - DNA, 710 bp, Zea mays
  misc_feature: Ceres CLONE 1552696
  misc_feature: Encodes the peptide sequence at SEQ ID NO. 71353
ggagctccccgcggtggcggccgctctagaactagtggatcccccgggctgcaggaattcgtctcacccctagaaaaaaagcaaataagacgacttgtttcattgattcttgaagagatcgagcttcttttgcaccacaaggtcgaggatgtcttgcaactgcggatcaagctgcggctgcggctcaagctgcaagtgcggcaagaagtaccctgacctggaggagacgagcaccgccgcgcaggccaccgtcgtcctcggcgtggccccggagaagaaggccgcgcccgagttcgtcgaagccgcggcggattccggcgaagccgcccacccctgcggctgcggtagcagctgcaagtgcgacccctgcaactgctgatcacatccgatcgacaaccatggatatgattattatctatccagcccgtgggtgggggttgaaacaaaaataagcgaggcccaagctggctgccatacctagggaatggggtggcgggggtgaaaaaaaaaaaagaaaacaaagtccctcaattttgccaaccccccccccccgcaaggtttggcggcgccgcccttgggcccccatggacccgggggtccccccccccctgttcgccgggcaaaaccactgaatatccacagagtgtagcgggttgggtcactgttgctcggccccccaacccccggggggggccgccccccccgccgcg

SEQ ID NO: 71353 - protein, 76 aa, Zea mays
  misc_feature: Ceres CLONE 1552696
  misc_feature (1)..(76): Pfam Name: Metallothio_2 Pfam Description: Metallothionein
MSCNCGSSCGCGSSCKCGKKYPDLEETSTAAQATVVLGVAPEKKAAPEFVEAAADSGEAAHPCGCGSSCKCDPCNC

SEQ ID NO: 71354 - DNA, 683 bp, Zea mays
  misc_feature: Ceres CLONE 1552700
  misc_feature: Encodes the peptide sequence at SEQ ID NO. 71355
tggagctccccgcggtggcggccgctctagaactagtggatcccccgggctgcaggaattcgtctcacccctagaaaaatcctgcctgtctgtcgcctcgtgacgtctgtccaagaacactcgctccccacctgttcgctgcttcttcttcttgccaatctgctccttcttctagctagatcttggatggagctggggatgacgatggaggtagcgaagatcatcgaggtatgtagagtacgcggctgctagttagttcaccaggccagcaagcgagctccagcttcgtccgatcgatagatgcgagctgtagcagcgtggcagccattcatcagttgtcagatcttagattccccccatccccgctactagttggtggttagcaaatcccaccaagcaggaagcagccgcgagcgagccatggccatggatcccgttctgaaggtggccctgggctcggcggcgttcgccctgttcttggtgctgggcgtggtccccggcggtgcgtttcctgcccatcgggcgcacggggggctccctgctggggcccatgcttatggggctgctgggcttaaataaccccaaaaaaccctaacccgccggggacctgcccttccggggcctgggttcggccacttgggggtggggggttcccggagcccccccaattttccggcccctgg

SEQ ID NO: 71355 - protein, 52 aa, Zea mays
  misc_feature: Ceres CLONE 1552700
MAMDPVLKVALGSAAFALFLVLGVVPGGAFPAHRAHGGLPAGAHAYGAAGLK

SEQ ID NO: 71356 - DNA, 688 bp, Zea mays
  misc_feature: Ceres CLONE 1552709
  misc_feature: Encodes the peptide sequence at SEQ ID NO. 71357
  misc_feature (398)..(398): n is a, c, t, g, unknown, or other
  misc_feature (453)..(453): n is a, c, t, g, unknown, or other
ctggagctccccgcggtggcggccgctctagaactagtggatcccccgggctgcaggaattcgtctcacccctagaaaaagaagaatatgctgccttctataagagcttgacaaatgactgggaggagcatctggctgtgaagcacttctctgtggagggtcaactggagttcaaggctgttctctttgttcctaagagggccccctttgatctctttgacaccaagaagaagcaaaacaacatcaagctctatgtgcgcagggtgttcatcatggacaactgcgaagagctgatccctgagtggctgagcttcgttaagggtattgttgactctgaggaccttccctcaatatctctcgtgagactcttcagcagaacaagatcctgaaagtgatcnagaagaaccttgtgaaagagtgtgttgagctcttctttgagattgctgagaaccnggaggactacaaccagttttacaaggcttcctccagaaccctcaagcttggcttccatgaagaccccccaaaaagggaccaaaatcccccaaacttcggaaataccaatccccccaagaaatggggatgaacttgaccaccctccaaggacttcttgtccccggattaaaggggggcccaaaatgccctccccctttattcccggggtaaagacaaaaagggggtggaaaaaacc

SEQ ID NO: 71357 - protein, 128 aa, Zea mays
  misc_feature: Ceres CLONE 1552709
GAPRGGGRSRTSGSPGLQEFVSPLEKEEYAAFYKSLTNDWEEHLAVKHFSVEGQLEFKAVLFVPKRAPFDLFDTKKKQNNIKLYVRRVFIMDNCEELIPEWLSFVKGIVDSEDLPSISLVRLFSRTRS

SEQ ID NO: 71358 - DNA, 662 bp, Zea mays
  misc_feature: Ceres CLONE 1552711
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (543)..(543): n is a, c, t, g, unknown, or other
  misc_feature (544)..(544): n is a, c, t, g, unknown, or other
  misc_feature (555)..(555): n is a, c, t, g, unknown, or other
  misc_feature (613)..(613): n is a, c, t, g, unknown, or other
aaaagctggagctccccgcggtggcggccgctctagaactagtggatcccccgggctgcaggaattcgtctcacccctagaaaattcccccgcgcggcggccgcgggagtgttcgtgttcctcacttctcccgcttgcgtccccgacactccctcagatccgcggccgtttcccgatccgaggggcattccagccctaaatagcggccggtgagcaggtctccttccgccggcgcggacccacctgggaaggggagttttattcccggggaagcccgttttttcccccctccgcgcccccccttttttttcccgccccccccccccaaaaaaacccccaaaattcctttttttgaggggcccccccctcagttttttttggggggaaaaataatttcccccccgggggggggggggggggggggggnnnnnnccccccccccccccccctcgttgttggtgttgggaattaaaaaaaaaagggggggggggggggaggagaaaaaaaannntttttcattttttttttttcctctnnntcccnnaaatccggagngaagggggggggggggggggggggagaaaaaaaaaaaaaaaaatatttttttttaagncggggggggggcgggccccggtcttttttttttgttgggggatccaaca

SEQ ID NO: 71359 - DNA, 728 bp, Zea mays
  misc_feature: Ceres CLONE 1552714
  misc_feature: Encodes the peptide sequence at SEQ ID NO. 71360
  misc_feature (434)..(434): n is a, c, t, g, unknown, or other
  misc_feature (490)..(490): n is a, c, t, g, unknown, or other
  misc_feature (626)..(626): n is a, c, t, g, unknown, or other
caaagctggagctccccgcggtggcggccgctctagaactagtggatcccccgggctgcaggaattcgtctcacccctagaaaaaaggaaaacacacgcacaaaactgccgtttccgaatggccacggccgtgctccgccgcccattcctcgccgcgctcctccccgccgccggaggggcgtccgggacctcctcttggttccgtccccggagacgtaggtcctctccttccgtgcgcgcggtgtcttccgactcccccaagcccgtcgcctccacctcctcccccaccggcggtgacagccccgacgaggaaccaccggtcctaccgctcctccaggagcttgcggattgcttgattcttccacccaagctcctcgctcagctcccgagcgaccttcgtctcgaccctcatgacgctgcgtttgatctctccnacggccagttctcgacgagtgtggccaagaagtgggtgatctgctcctgaccctgncaaagcatgggagttagctgatacgtccacttccaatagcatggcccagcagctgccgttgatggagccctacttgacgccgaagcgccaatccccgtttggcaagcggctggggtcacctggaaagaggtttctntcatggggcacgtccaccccgggaaaacttaaaaatttctgaaaccatgtgtcaaagggtgacctgttttcaaaccccccgggggtcactccgagtttcggg

SEQ ID NO: 71360 - protein, 121 aa, Zea mays
  misc_feature: Ceres CLONE 1552714
  misc_feature (106)..(106): Xaa is any aa, unknown, or other
MATAVLRRPFLAALLPAAGGASGTSSWFRPRRRRSSPSVRAVSSDSPKPVASTSSPTGGDSPDEEPPVLPLLQELADCLILPPKLLAQLPSDLRLDPHDAAFDLSXGQFSTSVAKKWVICS

SEQ ID NO: 71361 - DNA, 646 bp, Zea mays
  misc_feature: Ceres CLONE 1552715
  misc_feature: Encodes the peptide sequence at SEQ ID NO. 71362
cttgaactagtggatcccccgggctgcaggaattcgtctcacccctagaaaaagccgcgcagcgatgcggagcagaagcaatggaggtgctcagctccagccgcttcgctagggcactcttactcccgacaattctctacccggtctccaggcacctcagcacgcccccgtgccgccgccacgccgtccataccctagcctcaggctcagcccccgttcccgccgccgatgccgccgcgccttcgccgtcgctcgcccggctcctcgccgccgcgttgcggggcgggccgcccgggtcgggagctccccgacctcgcggccgcgaccacgggcggcgccgcgaatagggaggtgggcatgagcaccacggggggcaccggtgaccaagggcccgggaaaaccccgtacctgctgggcgctggggggcccaaaccgaacctttcttgtccgggggatgattggcgtggggcccgcggcttcagggcccccaaagggccttttttcaccttcccgttcgtaaaaggggcccctggggaacccggcggaaagtcttttttggctccggggggggatttccgggtccctaaaacaaaccgggggtttttgaaaacccgggttttatgtgtgtttttcgggggtggcctcg

SEQ ID NO: 71362 - protein, 139 aa, Zea mays
  misc_feature: Ceres CLONE 1552715
MPPRLRRRSPGSSPPRCGAGRPGRELPDLAAATTGGAANREVGMSTTGGTGDQGPGKTPYLLGAGGPKPNLSCPGDDWRGARGFRAPKGPFFTFPFVKGAPGEPGGKSFLAPGGDFRVPKTNRGFLKTRVLCVFFGGGL

SEQ ID NO: 71363 - DNA, 684 bp, Zea mays
  misc_feature: Ceres CLONE 1552716
  misc_feature (389)..(389): n is a, c, t, g, unknown, or other
  misc_feature (390)..(390): n is a, c, t, g, unknown, or other
  misc_feature (668)..(668): n is a, c, t, g, unknown, or other
ggagctccccgcggtggcggccgctctagaactagtggatcccccgggctgcaggaattcgtctcacccctagaaaaatcacacacacacactacactcgcaattcatccgcagtcacaagctcggctgctgctcccgctaacggttgaggcgttgctggtgcacacaggaagggaagggaagggagagctgcacacagctttgctctggctcttggctcccctgtccagctgtcctgtccgtccatcatggaagaaacgcccagcccgcagctctagccgccgtcaatctcgtctcgtatcggagtcggaggaagtaagaggcgggatggcatgaagccacttaccaagaatgatacgccccgccaccccgggggggggggggagaannaaccccaccaacccacccccaggggaggaggaaaagaatggccacctgccggaccccggagggaaaatgccctccttgccgccccaccccaaagttcaacaaccccacttgttaaaaccacccttccaaaaaccccatggcggaaaggaaaccccccccgccttgcaatccaaaattaagtgcccccctcccccccccagggaaaatttaaaaaaccccaaaactttttcccctaatacacccgatgcgatttgccctccccatttgtttcaaccaanaaaaccctcccccagg

SEQ ID NO: 71364 - DNA, 759 bp, Zea mays
  misc_feature: Ceres CLONE 1552717
  misc_feature (200)..(200): n is a, c, t, g, unknown, or other
  misc_feature (346)..(346): n is a, c, t, g, unknown, or other
  misc_feature (695)..(695): n is a, c, t, g, unknown, or other
  misc_feature (718)..(718): n is a, c, t, g, unknown, or other
  misc_feature (723)..(723): n is a, c, t, g, unknown, or other
ctccccgcggtggcggccgctctagaactagtggatcccccgggctgcaggaattcgtctcacccctagaaaaccctccctcgttacgcctgcttgggctggcgggtttctcggacacgccgccatcgccactcgcaggttcgccaccatcacctcgcgctgctcagaagaggaagcctgcttctcccccgacagcgacnacctccgccaccatcttccgcgctaacgacgtcgccatcacctcgcgtcgagccagacgctcaggtcttcttctttctccccgccggggaggaggacccaccagcagggccttctggagttcgtctgtggggatgtgtctataagntgattttttttccccccccccccccggggaaaagaaaggggggcattctttcctcttttttctccaattttggggggtgggcgtgcgtaacgagttccctcccggggggacggggggggggggggtggggctgcccccgttccgtcgcccggggggtgtaagtgctgggaggtggcgaggggtcgcggtgcgcggtttggggtgctgagcgatggttccgagtagcggccgcgcggggtccccgcggccgtcccgctgcggcgggtgccccgaagtcagcggggggtggccgccgtctgcgtcggtgtcccgccccaacatccccacccgcctaattcatcctatattnaccaggaagcgggccccgtcgancattntctatgcgcctccttttgagaggtgcgtcaatggag

SEQ ID NO: 71365 - DNA, 668 bp, Zea mays
  misc_feature: Ceres CLONE 1552720
  misc_feature: Encodes the peptide sequence at SEQ ID NO. 71366
  misc_feature (324)..(324): n is a, c, t, g, unknown, or other
  misc_feature (327)..(327): n is a, c, t, g, unknown, or other
  misc_feature (328)..(328): n is a, c, t, g, unknown, or other
  misc_feature (329)..(329): n is a, c, t, g, unknown, or other
  misc_feature (330)..(330): n is a, c, t, g, unknown, or other
  misc_feature (331)..(331): n is a, c, t, g, unknown, or other
  misc_feature (332)..(332): n is a, c, t, g, unknown, or other
  misc_feature (333)..(333): n is a, c, t, g, unknown, or other
  misc_feature (334)..(334): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (339)..(339): n is a, c, t, g, unknown, or other
  misc_feature (340)..(340): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (347)..(347): n is a, c, t, g, unknown, or other
  misc_feature (348)..(348): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (352)..(352): n is a, c, t, g, unknown, or other
  misc_feature (353)..(353): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (357)..(357): n is a, c, t, g, unknown, or other
  misc_feature (358)..(358): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (363)..(363): n is a, c, t, g, unknown, or other
  misc_feature (364)..(364): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (397)..(397): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (403)..(403): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (413)..(413): n is a, c, t, g, unknown, or other
  misc_feature (414)..(414): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (422)..(422): n is a, c, t, g, unknown, or other
  misc_feature (423)..(423): n is a, c, t, g, unknown, or other
  misc_feature (424)..(424): n is a, c, t, g, unknown, or other
  misc_feature (425)..(425): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (433)..(433): n is a, c, t, g, unknown, or other
  misc_feature (434)..(434): n is a, c, t, g, unknown, or other
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (438)..(438): n is a, c, t, g, unknown, or other
  misc_feature (439)..(439): n is a, c, t, g, unknown, or other
  misc_feature (440)..(440): n is a, c, t, g, unknown, or other
  misc_feature (441)..(441): n is a, c, t, g, unknown, or other
  misc_feature (442)..(442): n is a, c, t, g, unknown, or other
  misc_feature (443)..(443): n is a, c, t, g, unknown, or other
  misc_feature (444)..(444): n is a, c, t, g, unknown, or other
  misc_feature (445)..(445): n is a, c, t, g, unknown, or other
  misc_feature (447)..(447): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
ggagctccccgcggtggcggccgctctagaactagtggatcccccgggctgcaggaattcgtctcacccctagaaaatattatctatctagcttgtggtggtggttgaacaataataagcgaggccgagctggctgccatacataggtattgtgtggtgtgtgagagagagagagaaacagagttcttcagtttgctatctctctctctgcatgtttggcgtcagtctttgtgctcatgtacgtgtgtctacatgcatgttggttgatccgattgcgtctgctgtaaccatatattaattggtccacgatgatatgatttgatnctnnnnnnnnnnnnnnnnnnnnnnnnnnnnnnnnnnnnnnnnnnnnnngggggggnngnnnnnnnnntnnnnnnnnnnntnnnnnnnnnnnnnnnnnnnnnnnnnnnnnnnnnnnnnnnnntncnnnnnnggttggccccccggggggccgcctctttttttttccccccccccctggcccccccacttttttcttttcgcggggcttttgtttttttgtggcccccccccccttccccctttccccttcccctttggggggggccccccaaggggggggtttttgggggggtttttgtcccccccccttttccttcccccggcgccgtccccgggtggggccc

SEQ ID NO: 71366 - protein, 35 aa, Zea mays
  misc_feature: Ceres CLONE 1552720
GAPRGGGRSRTSGSPGLQEFVSPLENIIYLACGGG

SEQ ID NO: 71367 - DNA, 701 bp, Zea mays
  misc_feature: Ceres CLONE 1552724
  misc_feature: Encodes the peptide sequence at SEQ ID NO. 71368
  misc_feature (356)..(356): n is a, c, t, g, unknown, or other
  misc_feature (359)..(359): n is a, c, t, g, unknown, or other
tacccgcggtggcggccgctctagaactagtggatcccccgggctgcaggaattcgtctcacccctagaaaaagactccccctcccttccatctcttcccttgcatttagcctcccgcggttcaggaggcgcgggccattcccaaccatcgttgcagtggtggcaggtattggcctgtcgagacccatgggcattcaggtcgcggcggtggtgaccccgccgccgtgctcttccccctcctcctctccggcgtcgccttcgtcctcggccattgccacgtcgccgcggcacgccgttcttggcgccaggctggcgaggagccagtcgtcgctggcttgctggaacgcccgtcttgnccngcggcgcggcgggcagcacgcaatcaggcgcgctctcagcgcgagcatcaacagcgtccggagccgcggccggggagaaaaagaagttcctgaggaagatcccggaacctcgcggcggtgtaaccacccggggccccgggcggtttctggttgggccggcgaacctttgaaccgaaacgcaaacaaccttcggggtttcccccttttccttgcgggatcgcccaacgggggaaaacccccccccccccccttggagaaaggggcgggggaaaacaaaccgtttttataaaattccccccgcggaaattccccacgcccgcccgaggggggggccccccccct

SEQ ID NO: 71368 - protein, 153 aa, Zea mays
  misc_feature: Ceres CLONE 1552724
  misc_feature (57)..(57): Xaa is any aa, unknown, or other
  misc_feature (58)..(58): Xaa is any aa, unknown, or other
MGIQVAAVVTPPPCSSPSSSPASPSSSAIATSPRHAVLGARLARSQSSLACWNARLXXRRGGQHAIRRALSASINSVRSRGRGEKEVPEEDPGTSRRCNHPGPRAVSGWAGEPLNRNANNLRGFPLFLAGSPNGGKPPPPPLEKGAGENKPFL

SEQ ID NO: 71369 - DNA, 650 bp, Zea mays
  misc_feature: Ceres CLONE 1552728
  misc_feature: Encodes the peptide sequence at SEQ ID NO. 71370
  misc_feature (229)..(229): n is a, c, t, g, unknown, or other
  misc_feature (244)..(244): n is a, c, t, g, unknown, or other
  misc_feature (287)..(287): n is a, c, t, g, unknown, or other
  misc_feature (515)..(515): n is a, c, t, g, unknown, or other
  misc_feature (516)..(516): n is a, c, t, g, unknown, or other
gctggagctccccgcggtggcggccgctctagaactagtggatcccccgggctgcaggaattcgtctcacccctagaaaaaattccagtccgatttggacattgtcttcgtctccttcatcccctgcccacctgttctgctctgccgccgccgccgctgccgctcccgctgccgcaggaaccctagaccacgctgagcaacccccggcctacacggcgtagctttgcangaaatggaatacggngccgtcctcgccgccgcgccgctcgtcgcacggccgaactggntccctcctctcgccgccgccactggcgccgtctatttcagattcaaaaatcgccttttattcgaatctcgtcattcccaactaaaaggctgggacctggtaaggggcatgccaaaacttttagccaaggcaactttccccgccaacacttctgaaaacaagtttgattttggaaactggggaagaaaccctgggggtttttggggaaattgtgggccaaacccggganntaaaatagggaaaatttgcgcaaaaagggcggggaacaaaaagcggaaaattttttctttaagagaggggaaaaaaagggggcgcctttttggaacacccaaaaagggcggggaagaccccccccttctgggga

SEQ ID NO: 71370 - protein, 139 aa, Zea mays
  misc_feature: Ceres CLONE 1552728
  misc_feature (19)..(19): Xaa is any aa, unknown, or other
  misc_feature (95)..(95): Xaa is any aa, unknown, or other
MEYGAVLAAAPLVARPNWXPPLAAATGAVYFRFKNRLLFESRHSQLKGWDLVRGMPKLLAKATFPANTSENKFDFGNWGRNPGGFWGNCGPNPGXKIGKICAKRAGNKKRKIFSLREGKKRGRLFGTPKKGGEDPPLLG

SEQ ID NO: 71371 - DNA, 722 bp, Zea mays
  misc_feature: Ceres CLONE 1552731
  misc_feature (490)..(490): n is a, c, t, g, unknown, or other
  misc_feature (525)..(525): n is a, c, t, g, unknown, or other
  misc_feature (526)..(526): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (554)..(554): n is a, c, t, g, unknown, or other
  misc_feature (563)..(563): n is a, c, t, g, unknown, or other
  misc_feature (571)..(571): n is a, c, t, g, unknown, or other
  misc_feature (577)..(577): n is a, c, t, g, unknown, or other
  misc_feature (596)..(596): n is a, c, t, g, unknown, or other
  misc_feature (648)..(648): n is a, c, t, g, unknown, or other
  misc_feature (683)..(683): n is a, c, t, g, unknown, or other
  misc_feature (690)..(690): n is a, c, t, g, unknown, or other
aaagctggagctccccgcggtggcggccgctctagaactagtggatcccccgggctgcaggaattcgtctcacccctagaaaaagcgaaccagctgccgaggaaccctagcggagcactgtgcaggcgaccgcggcgcgctatcacttacggggggatacggcggcatcgtccccctcggcccctcctccatccctggtgcggcggcgccagcctgcaggtgttgaatgctgatttgttgtggctgattaatatgggttgatcgtcgattaatcgtgattagatccgctgatcgccccctcttgcgatcagaaaccataaagcgatctgaaaacattggggcgcccaacctctcacagaggaatatcccgcgagccgtgaccacctatacctaatatcacgccccaaagcttttcacggagctgtctccgtccacgagtgttccagctggaataccaatttccttccggcatggcgaactctggcgattnaaaaggcaagcggggtgtgttggactaccgctccnnccnnnccggattcggtggctggccgcanaagaagggnagcgccangccttntcaccaacagaacgacccnccttttgcatgcgctgcggcgagaacgcattcacgagcttttttgctgacgngatcccgcactttccccgggagggtggttctgatnggccttncgagttgccccacattgtgggcagagaacaaa

SEQ ID NO: 71372 - DNA, 698 bp, Zea mays
  misc_feature: Ceres CLONE 1552732
  misc_feature: Encodes the peptide sequence at SEQ ID NO. 71373
  misc_feature (624)..(624): n is a, c, t, g, unknown, or other
  misc_feature (658)..(658): n is a, c, t, g, unknown, or other
aaagctggagctccccgcggtggcggccgctctagaactagtggatcccccgggctgcaggaattcgtctcacccctagaaaaagcctgttcattcatcatcgccctgctggtggttttccattcatcatcgatcttcctgcgtctctgaactttttctgctgtgtctgttggccgggagcagaggttgctacacgtatatattctgaagaagagatcgagatgaccagcgtgtggaagaccaaggttctgcctggcctcaacaagatctttgacaaggatggcaagaaggctgcagctgcaggcttcttgaagtccttcaacaaggaggagattgacaaggagattgaggacaagaagacagagctggagcccaaggtcgtggaggcctacgaagcatctcctcctgaggtcaaggctctgttcaaggataagaagccagtcaaggtcagcaagaagaactcggctgcagtcaccaagttcctcgatgagctggctaagattgacttccctggagccaaggtggtgagcgaagcggtggccaagtccggcacctcgcccctgcttccggcgatcaccttcatcttggacaaggtcgcaccgtttatccccaaggaggagcccnaagcggagccggcggcggaagcacctctgaaaancccccccggggaaggaaaaaaggaagacgctaagcagctg

SEQ ID NO: 71373 - protein, 159 aa, Zea mays
  misc_feature: Ceres CLONE 1552732
  misc_feature (2)..(158): Pfam Name: DREPP Pfam Description: DREPP plasma membrane polypeptide
  misc_feature (135)..(135): Xaa is any aa, unknown, or other
  misc_feature (146)..(146): Xaa is any aa, unknown, or other
MTSVWKTKVLPGLNKIFDKDGKKAAAAGFLKSFNKEEIDKEIEDKKTELEPKVVEAYEASPPEVKALFKDKKPVKVSKKNSAAVTKFLDELAKIDFPGAKVVSEAVAKSGTSPLLPAITFILDKVAPFIPKEEPXAEPAAEAPLKXPPGEGKKEDAKQL

SEQ ID NO: 71374 - DNA, 657 bp, Zea mays
  misc_feature: Ceres CLONE 1552737
  misc_feature: Encodes the peptide sequence at SEQ ID NO. 71375
ctccccgcggtggcggccgctctagaactagtggatcccccgggctgcaggaattcgtctcacccctagaaaaaatagctcgatgctaccgctccgcacgcccgccgcgaatgccgccgcgcgaaccgcccgcgcgctgcttgccagccgcaccgcacgcacgccgcgaatgctgctgcgcaaacccgccgcgcgaaccacccgcacgccgcctgccagccgccataccctcgccctcacctccccgtaccccgccccacacgccaccaccatcggtcgggaagcaagctcaaaccctaaccgccggcgatgccagcacgatggcccgctatgaccgcgccataactgtcttctcccccgacggacacctcttccaggtggagcacgctctcgaggccgtccgcaagggcaacaccgccgtcggcgttcggggcacggacaccattgtcctcaacgttgagaagaagttcacacccaagctctaggattccagggcgtggggaagacgatgctggtcatgcgggtgtttgaaaccttcagaggctcccacccgaacctcaacattcgcggattctatacccatactgcgttgcatcgccttctcgaactccggttcgtttgactgtgtgatgaccatgcattttaccaatttttgtg

SEQ ID NO: 71375 - protein, 54 aa, Zea mays
  misc_feature: Ceres CLONE 1552737
  misc_feature: SWISSPROT Homolog: EC 3.4.25.1 Proteasome endopeptidase complex
MARYDRAITVFSPDGHLFQVEHALEAVRKGNTAVGVRGTDTIVLNVEKKFTPKL

SEQ ID NO: 71376 - DNA, 731 bp, Zea mays
  misc_feature: Ceres CLONE 1552738
  misc_feature: Encodes the peptide sequence at SEQ ID NO. 71377
  misc_feature (586)..(586): n is a, c, t, g, unknown, or other
aaagctggagctccccgcggtggcggccgctctagaactagtggatcccccgggctgcaggaattcgtctcacccctagaaaaattctttaataggtacaataacactcttcttaggagccactttagctcttgctcagagagatattaaaagaagcttagcctattctacaatgtctcaattgggttatatgatgttagctctaggtataggttcttatcaagctgctttattccatttgatcactcatgcttattcgaaagctttattgttcttaggatccggatccgttattcattcaatggaacctcttgttggatattcaccagataaaagtcagaatatggttcttatgggtggtttaagaaaatacgttccaattacaagaactacttttttatgtggtacactttctctttgtggtattccacctcttttgctgctctgggtcaaagatgaaatccttagtaatagttgggttgtattcaccccttttttggaaatataagcctcttttactgcaggaattaactgcatttttaaaggtttcgggatatatttacttaccttttgagggggaattgcnggttcatttcaaaaattaccggtatccttaaaaaggttccttggattccaaatcccttttggggaaaaaattatccccaaaggactcaagggggtttttgttttaaaaaaaaaaaaaggggggtttttttttttcacaaaaaaac

SEQ ID NO: 71377 - protein, 111 aa, Zea mays
  misc_feature: Ceres CLONE 1552738
  misc_feature: SWISSPROT Homolog: EC 1.6.99.5 NADH dehydrogenase (quinone)
MSQLGYMMLALGIGSYQAALFHLITHAYSKALLFLGSGSVIHSMEPLVGYSPDKSQNMVLMGGLRKYVPITRTTFLCGTLSLCGIPPLLLLWVKDEILSNSWVVFTPFLEI

SEQ ID NO: 71378 - DNA, 799 bp, Zea mays
  misc_feature: Ceres CLONE 1552743-R
  misc_feature: Pfam Name: DUF266 Pfam Description: Arabidopsis protein of unknown function, DUF266
gggcaaaggcaatgtagcagcattcaattgatgacacaataacaatctatcgtagtatgccactttattatgaaaatgttaagcatacagattactgaacaacctactactcttgcattccgtactatgtacactccatttggagacacttctcttaacacaacacctaaatagaagaagattaaattctttcagagaggctgcagcaagtgcatacttccatccctcatccatttcagtgtacaaactccgaccgtcaaatggtggctgcttcagactagtcacgtaggatgactgagtctgcaatctccatcaaaggctcaaggcactcaggagaaaacttgcgggcgaacatgtaagagtgtgtcatgttcgacttcctcagctccctgatcaagctcgcagatacctctccaggcccatacaagtgtgggtggcctgcaaccgaatccgtccaatttacccttgttagggtatacttagtacacccctcagaatcctgcatatccagtagtgtggggaagtaatgctcctcggggtagcatgaatccctgcgctcgatcagacagggcaacttgaacttcttccaaagcctcatatccctcacgaccatgatggcatgccttctcgtgagcacaaagaactgtgagccagcccggaactgatcatatggaacctcaggcagcatggcatcatcacctcgagcatagtacctgtcatgcagcagcttggtgtcgttgtccatgttgtccattatctctatgaaactgcggtggcggctatgaaggccagcattgta

SEQ ID NO: 71379 - DNA, 712 bp, Zea mays
  misc_feature: Ceres CLONE 1552743
  misc_feature: Encodes the peptide sequence at SEQ ID NO. 71380
  misc_feature (516)..(516): n is a, c, t, g, unknown, or other
ccccgcggtggcggccgctctagaactagtggatcccccgggctgcaggaattcgtctcacccctagaaaaaaagagcccgcaggcgcggcagcagccgctggccggagatgacgtcgccgtacgcctcgccgttcctgctctccctgctgctgctcatctccatcccggtcgtcttcctcctcgcgccgcgcctgctcccgcccaagacgctcccggccatcccggacgccgacgagtccgacgaccttgccctcttccgccgagccatcctctcctcctcgtcagccactcccacgcccacctccgcgggctcctactttttctggcgccgcccggcgcccaagatcgccttcctcttcctcaccaactcggacctcgtcttctccccgctctgggagaagttcttccgcgggcacacccacctcttcaacctctacgtccacgccgacccctactccgtcctcgagatgccgcccacgccatccttccgcggccgcttcgtccccgccaaggncacgcagcgcgcctcccctaccctcatatccgccgcgcgccgcctcctagccaccgcgctccttgacgaccccaacaaccagttcttcgcgctcctgtcgcagtcctgcatcccgctccacccgttcccaaccctctacaatgcactcctctctgacaatgctggccctcatagccggcaccgcagtttcatagaa

SEQ ID NO: 71380 - protein, 201 aa, Zea mays
  misc_feature: Ceres CLONE 1552743
  misc_feature (41)..(201): Pfam Name: DUF266 Pfam Description: Arabidopsis protein of unknown function, DUF266
  misc_feature (136)..(136): Xaa is any aa, unknown, or other
MTSPYASPFLLSLLLLISIPVVFLLAPRLLPPKTLPAIPDADESDDLALFRRAILSSSSATPTPTSAGSYFFWRRPAPKIAFLFLTNSDLVFSPLWEKFFRGHTHLFNLYVHADPYSVLEMPPTPSFRGRFVPAKXTQRASPTLISAARRLLATALLDDPNNQFFALLSQSCIPLHPFPTLYNALLSDNAGPHSRHRSFIE

SEQ ID NO: 71381 - DNA, 665 bp, Zea mays
  misc_feature: Ceres CLONE 1552744
  misc_feature (370)..(370): n is a, c, t, g, unknown, or other
  misc_feature (615)..(615): n is a, c, t, g, unknown, or other
  misc_feature (616)..(616): n is a, c, t, g, unknown, or other
  misc_feature (637)..(637): n is a, c, t, g, unknown, or other
gctctagaactagtggatcccccgggctgcaggaattcgtctcacccctagaaaaaaaacgccccacagcgcaagcgagcagatcctcctccctctctgcatcctggcctcctctctggctcccacgccgatctcgagcacctggggagaccgcgagacgtggcgctgatttttctcatcgcagcagccctcagtcccccacctctttttccttgcccttcaataaatcgggtatttacctacccctttatttaactttaatttggccttttaaccggttaggtccctttgaaattttccgggggggggaaataaaaaattgggttttttgggccccgggtgtttttgtttgttttttccccccccccangaggggggggggacccttccgcccttctctcggggagaagaggaccccccccgcggggggcccccccccccccccccccctttttttgggggggaggggggccgcgggcccctttcgtcgcgcgccgcgggagagggggggggggcggtgcggcccgcgggggggggggggggcggcggggcccgaggaacacgctcttttttttccgccgggggcgcgcctgaagggtggggtggggggggggnnccccccccccgctcagagganaacggggggaggatgattatttcgtctc

SEQ ID NO: 71382 - DNA, 726 bp, Zea mays
  misc_feature: Ceres CLONE 1552745
  misc_feature: Encodes the peptide sequence at SEQ ID NO. 71383
  misc_feature (286)..(286): n is a, c, t, g, unknown, or other
  misc_feature (315)..(315): n is a, c, t, g, unknown, or other
  misc_feature (319)..(319): n is a, c, t, g, unknown, or other
  misc_feature (356)..(356): n is a, c, t, g, unknown, or other
  misc_feature (397)..(397): n is a, c, t, g, unknown, or other
  misc_feature (399)..(399): n is a, c, t, g, unknown, or other
  misc_feature (400)..(400): n is a, c, t, g, unknown, or other
  misc_feature (401)..(401): n is a, c, t, g, unknown, or other
  misc_feature (402)..(402): n is a, c, t, g, unknown, or other
  misc_feature (406)..(406): n is a, c, t, g, unknown, or other
  misc_feature (407)..(407): n is a, c, t, g, unknown, or other
  misc_feature (412)..(412): n is a, c, t, g, unknown, or other
  misc_feature (430)..(430): n is a, c, t, g, unknown, or other
acagctggagctccccgcggtggcggccgctctagaactagtggatcccccgggctgcaggaattcgtctcacccctagaaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatgggctccgtcatccttgggtacgatattggggtgatgagcggancggccatgtacatcaagaaggacctcaanatcncggacgtgcttctggagatcctgatagggatcctcancctctatttccccctcccccccgggggggaggggggggaantnnnnaaannttttnccccccccttaactgtcnaccttccacaccctctttttcttcgggggggggggtgggtttgggtttttcccccccccacaacccccccgggccaggggggggcgcctttcttgggccccaattggccgcgggctacccggggcgctaaacccccccccctgtacaccgcgcccgaaaaatcttccgcgcggggccccccggggcctccccctcatcctcccctcgagacgggtgctcgaacatgggggcgggccttgtgcggggaccacccgggtcacaaaatacccctattgtgccgcccccggcttttcgcg

SEQ ID NO: 71383 - protein, 193 aa, Zea mays
  misc_feature: Ceres CLONE 1552745
  misc_feature (47)..(47): Xaa is any aa, unknown, or other
  misc_feature (56)..(56): Xaa is any aa, unknown, or other
  misc_feature (58)..(58): Xaa is any aa, unknown, or other
  misc_feature (70)..(70): Xaa is any aa, unknown, or other
  misc_feature (84)..(84): Xaa is any aa, unknown, or other
  misc_feature (85)..(85): Xaa is any aa, unknown, or other
  misc_feature (87)..(87): Xaa is any aa, unknown, or other
  misc_feature (89)..(89): Xaa is any aa, unknown, or other
  misc_feature (95)..(95): Xaa is any aa, unknown, or other
MASADLAEAIEPSRKKKSNVKYASICAILASMGSVILGYDIGVMSGXAMYIKKDLXIXDVLLEILIGILXLYFPLPPGGEGGEXXKXFXPPLTVXLPHPLFLRGGGWVWVFPPPTTPPGQGGAPFLGPNWPRATRGAKPPPLYTAPEKSSARGPPGPPPHPPLETGARTWGRALCGDHPGHKIPLLCRPRLFA

SEQ ID NO: 71384 - DNA, 724 bp, Zea mays
  misc_feature: Ceres CLONE 1552748
  misc_feature (724)..(724): n is a, c, t, g, unknown, or other
ctggagctccccgcggtggcggccgctctagaactagtggatcccccgggctgcaggaattcgtctcacccctagaaaaagtgcttatcttagaggaggttctggattctcctaacactccggtgagggctacaggtatccgaggctgtcccgcgtcgggctccccagcaagaccgactagagatggatgaccgggatggtgactaagctggctgcgccccgggctgcggctgccaccgctacgaccggtgtctctacaaggcgttgaaatcgtattgcgaggctctccagtccgggatcatcctctcatccgcagaggcagacgaccatcgcctccgtgcttgctatgcttctccacggaggaggagatgctgaacgcactcaaaggcatgaactgcaagaacttggacagccgcaacatctctgtcaacgatgtcacaacccctgccgacctgtcaccgagttgctgcgcctactgtgctggccgttcatgcagtcactaccaacccgacagttttcctgatggccatctcatcctacagcgtagatgatgatcacaccatgccctcatttcctacgtaatgacgcggagagctcttactgggaactcgtgatgaggataccgaaactccgacggtacctgttgaaactgactagtgtgacccgcacggggcagatgtccaggtctccacggaggtgtctactatagtgagaaggttatctn

SEQ ID NO: 71385 - DNA, 732 bp, Zea mays
  misc_feature: Ceres CLONE 1552750
  misc_feature (60)..(60): n is a, c, t, g, unknown, or other
  misc_feature (162)..(162): n is a, c, t, g, unknown, or other
  misc_feature (294)..(294): n is a, c, t, g, unknown, or other
  misc_feature (295)..(295): n is a, c, t, g, unknown, or other
  misc_feature (338)..(338): n is a, c, t, g, unknown, or other
  misc_feature (373)..(373): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (396)..(396): n is a, c, t, g, unknown, or other
  misc_feature (443)..(443): n is a, c, t, g, unknown, or other
tggcggccgctctagaactagtggatcccccgggctgcaggaattcgtctcacccctagnaagctggctctctccctgcccctgcccctgccctcgtcacgcactggtcctccagctccagtccacgctgctgttggcacctgctcgggccatcagatttcngggagttcaccaaataaccatcccccccgatcgaggcaggcttagctaggccttcgtactgtttcgtccggaagaagcagctatagctatagctgcaggaatttttccacatcggagcagccgaggccctcnngccacggtttttttcctccccaacgagtttgtcggaaggaaancctttttttttcccccccccccggggaaaaagaanaagggggnnnnnnnnnnnannnnttcccctccttttccccccccaccctaaaaaaaccccgacccccccnccccggggggggggcgcgatcttccttccccccatcccctccacttcatcgctgaataccctccccccgccctgccgcccgtacggtggtctaaaattttccccgccccgtccccccccgacgacgaggcataccgcgccccacgcggaggaccgtccccgcttccaccctattcccgccttttactctcccccgcccatcatcattaggtccccagactgcatcggacgccgggtctgtccccccgctcccggctcgcccccgcttctttgcctttctacccctcccg

SEQ ID NO: 71386 - DNA, 667 bp, Zea mays
  misc_feature: Ceres CLONE 1552751
  misc_feature: Encodes the peptide sequence at SEQ ID NO. 71387
  misc_feature (602)..(602): n is a, c, t, g, unknown, or other
ctccccgcggtggcggccgctctagaactagtggatcccccgggctgcaggaattcgtctcacccctagaaaaaaggcaagacggatcgagactacgacgccgatcctagctagctctcccgtttctgctcgcaagtcacacacagctccggtagatccgcccctcgcctctgggctccaggaagagattagcttcagacggcagggatcgatactagcaagcaagcatggcgcacgacttgtgcgaggacttggagctcgtcgccgacgacggcggcttcgatgactactactgggacgacgacttccatttccacgacgacgacggcttctccgcctcccctacgacccccgccagcgttggtgcgccccgccagcagcagcagcagcagcagatgggtgatatttcagcctcggactacaaagaaggcgaagacatgcaggggataccctgggaaaggctcaactacaccagggaccagtatcgtcggatgaggctcaaagagtacaagagctaccagaacctcacgaggtcgcacagcggcctacaacaacaggttattatatatatatatatatatatatatatatatatatatttntatctatatatatatatatatgtatatatatatagatatatatatatatatgtagacattgagag

SEQ ID NO: 71387 - protein, 146 aa, Zea mays
  misc_feature: Ceres CLONE 1552751
  misc_feature (125)..(125): Xaa is any aa, unknown, or other
MAHDLCEDLELVADDGGFDDYYWDDDFHFHDDDGFSASPTTPASVGAPRQQQQQQQMGDISASDYKEGEDMQGIPWERLNYTRDQYRRMRLKEYKSYQNLTRSHSGLQQQVIIYIYIYIYIYIYXYLYIYIYVYIYRYIYIYVDIE

SEQ ID NO: 71388 - DNA, 718 bp, Zea mays
  misc_feature: Ceres CLONE 1552753
  misc_feature (397)..(397): n is a, c, t, g, unknown, or other
  misc_feature (403)..(403): n is a, c, t, g, unknown, or other
gagctccccgcggtggcggccgctctagaactagtggatcccccgggctgcaggaattcgtctcacccctagaaaaaaatcaacccattttccctccgcccagatcgctgtgaagttgaccccgcttccctcccagctcagcgacctccttgccgattacgagtgccgtgtgtgccccgctccaccacaaatcgatcggaaacgcacgcccctttctcttcgccttttcgcgtcgtccagatctcagtcgttcttcgctccatgagctaggaatccgaggggtccctctaggctaagcgaaatttgcccggcggctgctaagaaggggttgatatcccgggatgatgatggggttttttcccccccccccccggggggaggaggggggggacccccntaattnctccaaccccccccccccccccactcccccaagacttcccaatagccacggggcgggggggtgcccttggcagggaacgaccccaaggaaaacctcggggggtaaaaaactttcccgcagaggggtataccctcccccacgcgtatagtccgcgctttaaaggggcataacccagcgcgtgaggcagaagattgacgacccccgtccttgacgctcgcctccgagagccgctcaatagagagcccacgcaaacccccccccacgagaggcgtccgcgtccgccacgaatacccctgcgtcccccccaacccgcac

SEQ ID NO: 71389 - DNA, 668 bp, Zea mays
  misc_feature: Ceres CLONE 1552754
  misc_feature: Encodes the peptide sequence at SEQ ID NO. 71390
ctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgcccgagatcagctgcagcgccaccgaggaagtcagcggcgccgtgtcgtccgtcaccctggagaagatgctcacggtgacggcgtcggttgaagcgtcgccggccatcgggcagatgtactttcagcgcggcgtcgacgacatcgggcgacctcctcgggaagacgctgctgctcaagctcgtcagctccaaactcgacccaaaatcgggcgttgaaaaaaaccgggtgaccggctaccc

SEQ ID NO: 71390 - protein, 125 aa, Zea mays
  misc_feature: Ceres CLONE 1552754
  misc_feature: SWISSPROT Homolog: EC 1.13.11.12 Lipoxygenase
MMNLNLKQPLVLPAHHSNVVGSRLSSSSPSAAAASRRTGGGVSSRSGSRRHVRLPEISCSATEEVSGAVSSVTLEKMLTVTASVEASPAIGQMYFQRGVDDIGRPPREDAAAQARQLQTRPKIGR

SEQ ID NO: 71391 - DNA, 698 bp, Zea mays
  misc_feature: Ceres CLONE 1552759
  misc_feature: Encodes the peptide sequence at SEQ ID NO. 71392
  misc_feature (401)..(401): n is a, c, t, g, unknown, or other
  misc_feature (449)..(449): n is a, c, t, g, unknown, or other
  misc_feature (487)..(487): n is a, c, t, g, unknown, or other
  misc_feature (494)..(494): n is a, c, t, g, unknown, or other
aaagctggagctccccgcggtggcggccgctctagaactagtggatcccccgggctgcaggaattcgtctcacccctagaaaaactctctgtctctctagggtttttgattttagccgccgccgctgctcatctcacatccctcgagaagacgcctgctcctcgccgatcgatacgatggccgtcttctccgacctccacaccgccgacggcctcaagtccctcgaggctcacctcgccggcaaaacctatgtgtctggtgactccattactaaggatgacattaaggtcttcgccgcggtgccgtcgaagcctggcgctgagtttcctaatgccgcccgctggtacgagaccgtctctgcggctgtagcctcaagattccctggtaaggctgttggtgtnaatctgcctgcgggatcagctccctgcgcagctgctccctgcgatgangctgaggatgatgatgaccttgatctttttggtgatgnaactgangaggacaagaaggcagctgatgagcgtgctgccgctgccaaggcctcttctaaaagaagaaagtggtaaatcctccgtccttatgatgtaaaacctgggacgatggaactgatttaaaaaactggaggaggctgtcccccatgcccaaatgaagggctgaatttgggaaacatcaaattttggccgttggaacgggttcaaaaa

SEQ ID NO: 71392 - protein, 128 aa, Zea mays
  misc_feature: Ceres CLONE 1552759
  misc_feature (91)..(91): Xaa is any aa, unknown, or other
  misc_feature (104)..(104): Xaa is any aa, unknown, or other
  misc_feature (106)..(106): Xaa is any aa, unknown, or other
MAVFSDLHTADGLKSLEAHLAGKTYVSGDSITKDDIKVFAAVPSKPGAEFPNAARWYETVSAAVASRFPGKAVGVNLPAGSAPCAAAPCDXAEDDDDLDLFGDXTXEDKKAADERAAAAKASSKRRKW

SEQ ID NO: 71393 - DNA, 717 bp, Zea mays
  misc_feature: Ceres CLONE 1552761
  misc_feature (335)..(335): n is a, c, t, g, unknown, or other
ctccccgcggtggcggccgctctagaactagtggatcccccgggctgcaggaattcgtctcacccctagaaaaagagaatacttgagaaagagcgtataccagtctagcaccgaactaccaaaaccgaccgagccgcgaacttcacccctgccttctctcccttctccgtccaggccctggtgcccgagcgttctcgtgcggcaagtgggcgccgccgccggactacgccaggtgcccagttcctcgtcgggtccttcgtcgacgacgagcacccaccagttatgccctttctcttccccttctgctgtgcgaaacccagcaccatcccgacccntacttgagctatctggctattttgcatccggatctgatctaattaccaagcgtggtacctacctacctactaccttcgattttttttttgggaaaaattttgggaaacttccgggtcctttaccggggtcccccccttttgaaaaaaccgggtttttaaaccctacctttccaaaaaaaattgggcccccggaaaaaaagggggggagcgaaaaaacccccctttaggcggggggccgcgagagtgtttcataggcccccccctgtgtgggggtgtcccctggggggcaaaaaagggtttttaggggccaccccgggcgttttttttttttccccaccacgggggggggggcttttttttttgggggggaccccccttgggg

SEQ ID NO: 71394 - DNA, 743 bp, Zea mays
  misc_feature: Ceres CLONE 1552763
  misc_feature: Encodes the peptide sequence at SEQ ID NO. 71395
  misc_feature (387)..(387): n is a, c, t, g, unknown, or other
  misc_feature (407)..(407): n is a, c, t, g, unknown, or other
aaagctggagctccccgcggtggcggccgctctagaactagtggatcccccgggctgcaggaattcgtctcacccctagaaaaaaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattacgggcatccnaggcctgaatcagtactggnagcacatcaggtgcccccaccacaacgggcagagcaacttgaagaaccccctggaagaggccgggcgcctgctccggccttcagcaagaaagactacttcaagactgccctctccctcccgtacccgatcacccccctcgtttcccctcaaacccaagggtttcggccggaacttcgggttccaggcctcaaagggattcccaagggctttcaaaaggggttcaacccccccccggaaaccattggaaacagggccccttccaaaaaaaagggggttcccccctccattttggggggggggaaagggggtgttttattggggcccccccccaaaaa

SEQ ID NO: 71395 - protein, 214 aa, Zea mays
  misc_feature: Ceres CLONE 1552763
  misc_feature: SWISSPROT Homolog: EC 3.1.27.1 Ribonuclease T(2)
  misc_feature (96)..(96): Xaa is any aa, unknown, or other
  misc_feature (103)..(103): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIXGLNQYWXHIRCPHHNGQSNLKNPLEEAGRLLRPSARKTTSRLPSPSRTRSPPSFPLKPKGFGRNFGFQASKGFPRAFKRGSTPPRKPLETGPLPKKRGFPPPFWGGGKGVFYWGPPPK

SEQ ID NO: 71396 - DNA, 711 bp, Zea mays
  misc_feature: Ceres CLONE 1552766
  misc_feature (1)..(1): n is a, c, t, g, unknown, or other
  misc_feature (9)..(9): n is a, c, t, g, unknown, or other
  misc_feature (91)..(91): n is a, c, t, g, unknown, or other
  misc_feature (266)..(266): n is a, c, t, g, unknown, or other
  misc_feature (329)..(329): n is a, c, t, g, unknown, or other
  misc_feature (411)..(411): n is a, c, t, g, unknown, or other
  misc_feature (413)..(413): n is a, c, t, g, unknown, or other
  misc_feature (416)..(416): n is a, c, t, g, unknown, or other
  misc_feature (417)..(417): n is a, c, t, g, unknown, or other
  misc_feature (418)..(418): n is a, c, t, g, unknown, or other
  misc_feature (419)..(419): n is a, c, t, g, unknown, or other
  misc_feature (420)..(420): n is a, c, t, g, unknown, or other
  misc_feature (421)..(421): n is a, c, t, g, unknown, or other
  misc_feature (426)..(426): n is a, c, t, g, unknown, or other
  misc_feature (432)..(432): n is a, c, t, g, unknown, or other
naattattntaagacaatggagctccccgcggtggcggccgctctagaatagtggatcccccgggctgcaggaattcgtctcacccctagngagaggccatgaggacctcaacggctacctgtgctatcctccctccgcctacctgctcctcccgtagtttaccgctccgcagcttcatcggtctccggtggtccgccccccgtttccaggttagggagcgagctggtgcgtccgtagcggttgtcaatggcaagccgggatgcancttcaaactcggattacctactttaaatgtttttccccctcgccaaagggctgttgtcattanaaattgacttgctccaaaatgctgacccttccccaaaattttttttttttcccccccccccgtgggacagaagggggggttnanttnnnnnncccanccaatnaaaacaaaaaacaaaaacaaggaaaccctttgcgggggggggctcccccgaaaaccgggatgttcgtcgctaaaattcatcccgctgttttccaagggtgcaatggcagaattttccccaacacaaccctggaggagggcccccgcacacctccccctcttcccggcgcgagaatacttggcggtggcaccctggtgggaccgtggggaccttccttcgctacgatgcgcccacaatggtccgtccgcgccgggttgaagtttgctttgccccccctat

SEQ ID NO: 71397 - DNA, 735 bp, Zea mays
  misc_feature: Ceres CLONE 1552769
  misc_feature: Encodes the peptide sequence at SEQ ID NO. 71398
  misc_feature (510)..(510): n is a, c, t, g, unknown, or other
caaagctggagctcaccgcggtggcggccgctctagaactagtggatcccccgggctgcaggaattcgtctcacccctagaaaaaaccgccaccccgacctccctgcaataataattacggagtataataataataaaaaaactccgaatccgccgcgcgcgccccgtcctcgtcgccggcggaggcgtccgccaccgcccacagcagactatcgccggagaaggaacgccgcggggagcttttccactgccatctcccgtctgacccctccgagatcggaagcggcggccatggccatcccgctcgtgctcgtcgtgctcccgctcggcctcctcttcctcctgtccggcctcatcgtcaacaccatccaggcgatcctatttgtgacaataaggcccttttccaagagcttgtatcgccggatcaacaggtttctggccgagctgctgtggctccagctttgtctggtgggtgactgggtgggcagcgttaagggtacactacctgcngatgaagaaactaccgatcatgggtaaagagcatgccctcggcatatcaaaccatcaaggggatttgattgccttatggaatgaaaatggcccaagcctcacggtgcccttggaataaacccccttgccttgaaaaaacatccaaatcctttccatccttggctgggcaaaggggtttgcaaaaaaccccttttttgaaaaaaatgggcccaagaaaaaaaaaca

SEQ ID NO: 71398 - protein, 81 aa, Zea mays
  misc_feature: Ceres CLONE 1552769
  misc_feature: SWISSPROT Homolog: EC 2.3.1.51 1-acylglycerol-3-phosphate O-acyltransferase
MAIPLVLVVLPLGLLFLLSGLIVNTIQAILFVTIRPFSKSLYRRINRFLAELLWLQLCLVGDWVGSVKGTLPADEETTDHG

SEQ ID NO: 71399 - DNA, 644 bp, Zea mays
  misc_feature: Ceres CLONE 1552771
  misc_feature: Encodes the peptide sequence at SEQ ID NO. 71400
  misc_feature (455)..(455): n is a, c, t, g, unknown, or other
  misc_feature (458)..(458): n is a, c, t, g, unknown, or other
  misc_feature (468)..(468): n is a, c, t, g, unknown, or other
  misc_feature (481)..(481): n is a, c, t, g, unknown, or other
  misc_feature (490)..(490): n is a, c, t, g, unknown, or other
tacccgcggtggcggccgctctagaactagtggatcccccgggctgcaggaattcgtctcacccctagaaaaaacgccaccgccacctccacctcctcgaagccgccgcgaccgatcgagcgaagcgtcccttcccgcgccgacgccgaaaccctagctcctcttacgccatggccaccgtgtcgctcactccgcaggcggtcttctccaccgagtccggcggcgccctggcttctgccaccatcctccgcttcccgccaaacttcgtacgccagctcagcaccaaggcacgacgcaactgcagcaacatcggcgtcgcgcagatcgtcgccgccgcgtggtccgactgcctcgctgtccccaacctttaggggggggggggggatgatctgcgcgacgccgatgttgctgcagttgcgtcgtgccttggtgctgagcgggggttcggaagtttntcngcaacctacnacaaacttcctantacaacccngggaaaaaactttcaaaaaaagaattcccccttatggttttcaggacggagggtggtggtcaacatcccccttggtgggttaccaatttggcgagaatttagtacttttttaagagagcggaggccctcccaacttcgaaaaacggagggaagt

SEQ ID NO: 71400 - protein, 66 aa, Zea mays
  misc_feature: Ceres CLONE 1552771
  misc_feature: SWISSPROT Homolog: EC 2.5.1.48 Cystathionine gamma-synthase
MATVSLTPQAVFSTESGGALASATILRFPPNFVRQLSTKARRNCSNIGVAQIVAAAWSDCLAVPNL

SEQ ID NO: 71401 - DNA, 905 bp, Zea mays
  misc_feature: Ceres CLONE 1552774-R
gggtgtgttagtgaataaactgggtacgtacgaggatatactttatgaaaaacaccgacacttcaacagttataaattcatatacacaacaccagtaccagagaatatcctatggcctttgaaattttaatctaagcgaagtacgacgaggaggaagatgtatcacggagaacctgcatgttcaaagcagaactccagttcgtcttcagtgaatgcgtccttctggatgctccatgtgtcagcatgggtgcgcttaaattctgcaacagctttcgtgactgttgatcttatagggggaggctcccggatgaagcgagcaagtagcgagacattagaaggaagccagctaggcatgtcgtatggaacagaaaggaccgaagctgtcaaagcaaggactgcatcatccatggtaccaacagaaaacttcaaatttcttctccgtgcaacaaaaatatgctgggcttgtgcatatgaccgttcacggaaatcctttgatagatcttcatctatacccttcattaaagcttgcaagaacacctggaagcattgctccctaaacctcaactttggtttgtcccccaagttaatttttcctattggtttgcccatatttgttgaatttctcttgaccccagaaaagtatgaaatggtggcccccggtaaggtaaagggtccctgagtattccgaataaccggtgggagaatcttggcaaccgccagggttagggaaccccctggacataagaggtaagaaattgcactttttttaacccggttctccaataaaacacggggcgaattgaaacaaaccccccccatttctcagtacacccattaaaaagcgcgaatttttatccaagtgatatgttaaatatgtctttttatcttcagagggttaccaccgg

SEQ ID NO: 71402 - DNA, 867 bp, Zea mays
  misc_feature: Ceres CLONE 1552774-R2
ggacctcgagcgtctcgtttttttttttttttttgtacgaaggcatctggttgatgaaataaaactaggtacgtacaaggatatacatttatgaaaaacaccgacacttcaacagttataaattcatatacacaacaccagtaccagagaatatcctatggcctttgaaattttaatctaagcgaagtacgacgaggaggaagatgtatcacggagaacctgcatgttcaaagcagaactccagttcgtcttcagtgaatgcgtccttctggatgctccatgtgtcagcatgggtgcgcttaaattctgcaacagctttcgtgactgttgatcttatagggggaggctcccggatgaagcgagcaagtagccagacattagaaggaagccagctaggcatcccaccatggaacagaaaggaccgaagctgtcaaagcaaggactgcaccatggatggtaccaacagaaaacttcaaatttcttctccgtgcaacaaaaatatgctgggcttgtgcatatgaccgttcacggaaatcctttgatagatcttcatctataccccttcatttaagcttgcaagaacacccagcagcatgcttccctaacctcaactttggttgtccacaagtaattttttctattgtttgccagattttggaatttccctggagcccaaaagtatgaatggggtgcctgtcgggtaaaaggccctgagaaaaccataaccagggcgagaactgggtccgcccgtttagggatcacctgtacctatagggaaggaaaataaccgcaattagcaagttttcaagaaaaaagggcccaaggttgaaaactcttccaatttcaggtaaactccgaaaagcgtga

SEQ ID NO: 71403 - DNA, 659 bp, Zea mays
  misc_feature: Ceres CLONE 1552777
  misc_feature: Encodes the peptide sequence at SEQ ID NO. 71404
  misc_feature (428)..(428): n is a, c, t, g, unknown, or other
  misc_feature (439)..(439): n is a, c, t, g, unknown, or other
ctccccgcggtggcggccgctctagaactagtggatcccccgggctgcaggaattcgtctcacccctagaaaaaaccaatcgcatcgcagcagcacgagcagcacgtcgtgccgctccaaccatctcgcttccgtgcttagcttcccgccgcgccatggcgtcgaccaaggctcccggccccggcgagaagcaccactccatcgacgcgcagctccgtcagctggtcccaggcaaggtctccgaggacgacaagctcatcgagtacgatgcgctgctcgtcgaccgcttcctcaacatccttcaggacctccacgggcctagccttcgcgaatttgtccaggagtgctacgaggtatcggccgactacgagggcaaaggagacacgacgaagctgggcgagctcggcgccaagctcacggggctgggnccctgcgacgncatcctcgtggcgagctccatcctgcacatgctcaacctcgcaacctggccgaagaggtgcagatcgcgcaccgccgccgcacagcaatccaaaaaaaggtgggctccccaaacaaagctccgcacccaccgaagtcgacttcgaggagacgctcaagcgccctggggtcgagggcggcaggccccccaaggagggtgttcaagccctcaaaaaccgaac

SEQ ID NO: 71404 - protein, 168 aa, Zea mays
  misc_feature: Ceres CLONE 1552777
  misc_feature: SWISSPROT Homolog: EC 4.1.1.31 Phosphoenolpyruvate carboxylase
  misc_feature (95)..(95): Xaa is any aa, unknown, or other
MASTKAPGPGEKHHSIDAQLRQLVPGKVSEDDKLIEYDALLVDRFLNILQDLHGPSLREFVQECYEVSADYEGKGDTTKLGELGAKLTGLGPCDXILVASSILHMLNLATWPKRCRSRTAAAQQSKKRWAPQTKLRTHRSRLRGDAQAPWGRGRQAPQGGCSSPQKPN

SEQ ID NO: 71405 - DNA, 859 bp, Zea mays
  misc_feature: Ceres CLONE 1552778
  misc_feature: Encodes the peptide sequence at SEQ ID NO. 71406
  misc_feature (250)..(250): n is a, c, t, g, unknown, or other
  misc_feature (270)..(270): n is a, c, t, g, unknown, or other
  misc_feature (271)..(271): n is a, c, t, g, unknown, or other
  misc_feature (304)..(304): n is a, c, t, g, unknown, or other
  misc_feature (347)..(347): n is a, c, t, g, unknown, or other
  misc_feature (360)..(360): n is a, c, t, g, unknown, or other
  misc_feature (370)..(370): n is a, c, t, g, unknown, or other
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (426)..(426): n is a, c, t, g, unknown, or other
  misc_feature (446)..(446): n is a, c, t, g, unknown, or other
  misc_feature (511)..(511): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (537)..(537): n is a, c, t, g, unknown, or other
  misc_feature (539)..(539): n is a, c, t, g, unknown, or other
  misc_feature (555)..(555): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (597)..(597): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (659)..(659): n is a, c, t, g, unknown, or other
  misc_feature (660)..(660): n is a, c, t, g, unknown, or other
  misc_feature (687)..(687): n is a, c, t, g, unknown, or other
  misc_feature (688)..(688): n is a, c, t, g, unknown, or other
  misc_feature (689)..(689): n is a, c, t, g, unknown, or other
  misc_feature (702)..(702): n is a, c, t, g, unknown, or other
  misc_feature (703)..(703): n is a, c, t, g, unknown, or other
  misc_feature (704)..(704): n is a, c, t, g, unknown, or other
  misc_feature (705)..(705): n is a, c, t, g, unknown, or other
  misc_feature (706)..(706): n is a, c, t, g, unknown, or other
  misc_feature (714)..(714): n is a, c, t, g, unknown, or other
  misc_feature (715)..(715): n is a, c, t, g, unknown, or other
  misc_feature (724)..(724): n is a, c, t, g, unknown, or other
  misc_feature (747)..(747): n is a, c, t, g, unknown, or other
  misc_feature (748)..(748): n is a, c, t, g, unknown, or other
  misc_feature (749)..(749): n is a, c, t, g, unknown, or other
  misc_feature (750)..(750): n is a, c, t, g, unknown, or other
  misc_feature (751)..(751): n is a, c, t, g, unknown, or other
  misc_feature (779)..(779): n is a, c, t, g, unknown, or other
  misc_feature (780)..(780): n is a, c, t, g, unknown, or other
  misc_feature (781)..(781): n is a, c, t, g, unknown, or other
  misc_feature (782)..(782): n is a, c, t, g, unknown, or other
  misc_feature (783)..(783): n is a, c, t, g, unknown, or other
  misc_feature (784)..(784): n is a, c, t, g, unknown, or other
  misc_feature (799)..(799): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (838)..(838): n is a, c, t, g, unknown, or other
  misc_feature (840)..(840): n is a, c, t, g, unknown, or other
  misc_feature (841)..(841): n is a, c, t, g, unknown, or other
  misc_feature (857)..(857): n is a, c, t, g, unknown, or other
aaagctggagctccccgcggtggcggccgctctagaatagtggatcccccgggctgcaggaattcgtctcacccctagaaaaaactaaccaaggagctacctagcaacgcgcagtaagcagcgtgggcaaagctacgagcgcccggctaggttcgccatgaacatgggtggggtgtccccgtccacagtccggtgcaagcactgcaccacccagatcaccgtgtgccacggcgagtgcgccatccagtgncgccaatgctccgccctcanncttatcctttgctagcttccccaccgccggggngaccgccccccccccatggttttttcccccggcccccagcaangaacagaaccctnttttaccgcnnnncccccccaccgggggggggggggccacaaaacaccccaccccccccccacctntttaccccaacccgggtgtnaaaacaaaaccaaatggccactaccaggaagagaccgcaccaccgccccccacaccccgacattntatnnnnnagacgcacacccgccccnanaccaccccccacaccnaccccctcccnnngccacctcatccccataacccgcccccgntcatccaaagcacaccaatnnnccccccacnnnncccccacctcaccgccacacacacccgnntcacacaccaacaaccacaagaaaacnnntatcaccaccccnnnnntgcccggnngaccactgncacccgcacccccatccgtgcgnnnnngtacccacccatcgggtcgccccacctnnnnnnaccgcccaccaccanctatccgaaannnntccccgcccccaccccacacccacntnnaaaccccacccacccncg

SEQ ID NO: 71406 - protein, 42 aa, Zea mays
  misc_feature: Ceres CLONE 1552778
  misc_feature (31)..(31): Xaa is any aa, unknown, or other
  misc_feature (38)..(38): Xaa is any aa, unknown, or other
MNMGGVSPSTVRCKHCTTQITVCHGECAIQXRQCSALXLILC

SEQ ID NO: 71407 - DNA, 689 bp, Zea mays
  misc_feature: Ceres CLONE 1552781
  misc_feature (227)..(227): n is a, c, t, g, unknown, or other
aagctggagctccccgcggtggcggccgctctagaactagtggatcccccgggctgcaggaattcgtctcacccctagaaaaactccaaagccaacaaacagagctccaactcagaaagcatccgtcccttggcagcagcaacaagctactagctatgtgtgtttagagcgagcgaggtgaaaaaaagacacatctaagatatactgcatcatctttcgttgataanccgcccagtaaagcatgggtactaatgatagagcggtcatttctctagtactcccgtgtgcatcgctagccgctcgtccctgggtgcccctgtaactgaagtttagcacaaacgctcctccatcccggttgaagttttgttccgcgaatcccctggccaagtcggaaaaataaaattctgcgcccccctgtgccccctggtggatctcccgaaagggatctacatcccctgttgggaccccccggggccgcctaaagaaggttttcccaatgggtgcaaacctttccgaattatttcccgccaccaactgggggtcataaaaaaataacccttggtttacccccccgttgaacacgctttttaaaaatttaaccccttgccccgcccccaatatttgcccacatttcccgcttgggggagatattgggtcttcccccaccccccggaaaggggggaaccccc

SEQ ID NO: 71408 - DNA, 700 bp, Zea mays
  misc_feature: Ceres CLONE 1552783
  misc_feature: Encodes the peptide sequence at SEQ ID NO. 71409
  misc_feature (444)..(444): n is a, c, t, g, unknown, or other
  misc_feature (466)..(466): n is a, c, t, g, unknown, or other
  misc_feature (539)..(539): n is a, c, t, g, unknown, or other
  misc_feature (545)..(545): n is a, c, t, g, unknown, or other
  misc_feature (546)..(546): n is a, c, t, g, unknown, or other
  misc_feature (574)..(574): n is a, c, t, g, unknown, or other
  misc_feature (587)..(587): n is a, c, t, g, unknown, or other
agctccccgcggtggcggccgctctagaactagtggatcccccgggctgcaggaattcgtctcacccctagaaaaaaaatcccaatcgaatcgactcccccctgttcgtcggattctcttcctccgtccgcacccagctaacgccaccgaaaacagaaaatttacccgccgcccaaaaaaaaaaacagaaaggctaacctccttttttctctctctatctttctctccatctgtggacttctccggttttgtttgacgagatgcctgcgctcgccgtcgacgccgcgacacccgtggcgcacgccttcgcgtcctgcgacgcggcgcgcttccccgccccgcccgtggtgggccccgccgccgcggccgaggccgccccctggtcggccgacctctccgcggcgctctacaacgtggacggctggggcgcgccctacttcttcngtcacgacgacggcaacgtggncgtgcgcccgcacggcgccgcgactctcccgggggcagagatcgacctggccaaggtcgtgggcaaggccgcnggcccnncgccccggaagcggggtccggcttgccnttgccccttgctngtgcgtttcccggaagtcctgggccaacgggtttaaaaggcttaaaccccccctttgggtaaacccgttcccttcacccgggtaaaggttaaagggaaacaggggggggtacc

SEQ ID NO: 71409 - protein, 120 aa, Zea mays
  misc_feature: Ceres CLONE 1552783
  misc_feature: SWISSPROT Homolog: EC 4.1.1.19 Arginine decarboxylase
  misc_feature (62)..(62): Xaa is any aa, unknown, or other
  misc_feature (69)..(69): Xaa is any aa, unknown, or other
  misc_feature (96)..(96): Xaa is any aa, unknown, or other
  misc_feature (105)..(105): Xaa is any aa, unknown, or other
MPALAVDAATPVAHAFASCDAARFPAPPVVGPAAAAEAAPWSADLSAALYNVDGWGAPYFFXHDDGNVXVRPHGAATLPGAEIDLAKVVGKAAGPXPRKRGPACXCPLLVRFPEVLGQRV

SEQ ID NO: 71410 - DNA, 702 bp, Zea mays
  misc_feature: Ceres CLONE 1552791
  misc_feature: Encodes the peptide sequence at SEQ ID NO. 71411
  misc_feature (294)..(294): n is a, c, t, g, unknown, or other
  misc_feature (389)..(389): n is a, c, t, g, unknown, or other
  misc_feature (702)..(702): n is a, c, t, g, unknown, or other
ctggagctccccgcggtggcggccgctctagaactagtggatcccccgggctgcaggaattcgtctcacccctagaaaaagcgacccctcgaccgtgcgaacgagcaaaggacaaatatcctcgctcgcagtcgcagctactacgccgccgcacctccgcccgccaccttcttcccggctccagcgatgtcgggggcgatcgggggcgccgaggtccacggcttccggggcgcagcggcgcagctcccgcggtcgcgggtgctcggggagccgatccggggtggcgccaccccngcgcgcccggcggggcggtgcgtccgcgggcagcatacgcgccgtctccgcgcctgcgaagaaaggatgctctgaaagtaagcgaaagcagggtngagatatcaagggaaaagacacctttttccgggtaccctttgaacgaggagtggtcctcagaggcccaaatatcaacagaagggcttgtcacctgatcaaggtccctggaacctacccgcaaactgaccgagaatgcccgtgggccaaaaaaataccccgtttaagcccccgaaaaaaaaaccccttgggggaaaaattccaaacccacttttttttaccttgggaaaaccccccccaaaagattttggggtttgaaaaaacccccccgaaaaaccaaggaaaaaatttcccgtgtcgccgggggtttttaan

SEQ ID NO: 71411 - protein, 60 aa, Zea mays
  misc_feature: Ceres CLONE 1552791
MSGAIGGAEVHGFRGAAAQLPRSRVLGEPIRGGATPARPAGRCVRGQHTRRLRACEERML

SEQ ID NO: 71412 - DNA, 665 bp, Zea mays
  misc_feature: Ceres CLONE 1552799
  misc_feature: Encodes the peptide sequence at SEQ ID NO. 71413
  misc_feature (512)..(512): n is a, c, t, g, unknown, or other
  misc_feature (544)..(544): n is a, c, t, g, unknown, or other
ctccccgcggtggcggccgctctagaactagtggatcccccgggctgcaggaattcgtctcacccctagaaaaaagaagcctccaccctcctgcgcctccaccctcctcgccgcctcactccctctgaggtcgcagatccgtccggttagacgaagccgcccgcacccatggcctccggtgagctcgcctgcacctacgccgccctcatcctcagcgacgacggcatcgccatcaccgccgagaagatcgccaccatcgtgaaggcggccaacatcaaggtcgagtcctactggccggcgctcttcgctaagctcctggagaagcgcagtgttgaggatctaatcctctccgttggatctggtggtggcgctgctccagttgctgctgccgccccagctgggagtgctgcagctgctgctgcccctgctgcagaggagaagaaggagagcccaaggaggagtctgatgacgacatgggcttcagccctgtcgactgagggagccctcgctanccagccattagcaaattcccttatgctgtccnagacttatcttacgctatgtctgtagccttttgttattacaagtactcaagttttgagtttttgaaatgggggctttgacaaggggatgaagaccctaaacatccgtatgaagtgaaactt

SEQ ID NO: 71413 - protein, 133 aa, Zea mays
  misc_feature: Ceres CLONE 1552799
  misc_feature (21)..(94): Pfam Name: Ribosomal_60s Pfam Description: 60s Acidic ribosomal protein
  misc_feature (115)..(115): Xaa is any aa, unknown, or other
  misc_feature (126)..(126): Xaa is any aa, unknown, or other
MASGELACTYAALILSDDGIAITAEKIATIVKAANIKVESYWPALFAKLLEKRSVEDLILSVGSGGGAAPVAAAAPAGSAAAAAAPAAEEKKESPRRSLMTTWASALSTEGALAXQPLANSLMLSXTYLTLCL

SEQ ID NO: 71414 - DNA, 661 bp, Zea mays
  misc_feature: Ceres CLONE 1552800
  misc_feature: Translation starting site: 156
  misc_feature: SWISSPROT Homolog: EC 1.10.3.3 L-ascorbate oxidase
  misc_feature (603)..(603): n is a, c, t, g, unknown, or other
ctccccgcggtggcggccgctctagaactagtggatcccccgggctgcaggaattcgtctcacccctagaaaaaactccactccactgtctgctggctgctgcttccttccagatctaggggatcaagcagccagccttccccgcgccgccagcaatggcggcacccccgcccgcgccgttcctcctcctgctgctcgccgtggcagcagcgtcgctcgccggcgccgacgacccctaccgctacttcacctggaccgtcacctacgggccaatcagcccgctcggcaccacgcagcagggcatcctgatcaacggccagttcccgggcccgcgcatcgactgcgtgacgaacgacaacctggtggtgaacgtcgtcaacagcctggacgagccgttcctgctcacctggaacggcgtcaagcagcgcaagaactcgtggcaggacggggtagcgggcaccaactgcggcatcccgccgggcgccaactacacgtaccgcttcaggccaaggaccagatcggcaccttcttctacttcccgtccctggccctgcaccgcgccgcgggcggctacggcgcgctcaacgtgtaccagcggcccgnccatccggggtgcctacccgccgccggccgggggactcacgctgctcgtcggcgactg

SEQ ID NO: 71415 - DNA, 691 bp, Zea mays
  misc_feature: Ceres CLONE 1552801
  misc_feature: Encodes the peptide sequence at SEQ ID NO. 71416
  misc_feature (250)..(250): n is a, c, t, g, unknown, or other
  misc_feature (286)..(286): n is a, c, t, g, unknown, or other
  misc_feature (297)..(297): n is a, c, t, g, unknown, or other
  misc_feature (327)..(327): n is a, c, t, g, unknown, or other
aaagctggagctccccgcggtggcggccgctctagaactagtggatcccccgggctgcaggaattcgtctcacccctagaaaaacgatgcgaccgccctcgctgctctccctcaccctcgacgccgcgctcctccgcatcgccaatatcgccgacctctcccacctcccagaccacctcctcatcgatctcttccgtagaaccctcagtgctgggtagctgacagagaaagtttctcagttgtttctagncaccgactgtgaggatatcatattggctggtcgggntgctcacattnagcagccactcgtaccagtccttccccacnaggtgctctgagagaattctagacctgctgccgctcacatcgtttttgataacctgagaagaatgcccttgggaaatccagataggggaaggttgaattggggattgcgggactccaggcccacctggccacctttcttttgaggatggcggacctttttcctccccggttcccattccttgtgcgtcaaaaatcccaacattgcgaaggagactttcaatcccgtggcgggtttaggcttccaggggttaaccccagggccgaaattaatgggggtgggtttgggggccccccctaccataaaatttttcgggggcccccagggcgcgtacctttgggggatcttggcccccccccagaaagt

SEQ ID NO: 71416 - protein, 43 aa, Zea mays
  misc_feature: Ceres CLONE 1552801
MRPPSLLSLTLDAALLRIANIADLSHLPDHLLIDLFRRTLSAG

SEQ ID NO: 71417 - DNA, 733 bp, Zea mays
  misc_feature: Ceres CLONE 1552802
  misc_feature: Encodes the peptide sequence at SEQ ID NO. 71418
  misc_feature (616)..(616): n is a, c, t, g, unknown, or other
  misc_feature (617)..(617): n is a, c, t, g, unknown, or other
  misc_feature (647)..(647): n is a, c, t, g, unknown, or other
aaagctggagctcaccgcggtggcggccgctctagaactagtggatcccccgggctgcaggaattcgtctcacccctagaaaagctcgtgccagcgcccagcaggccattctgctcgccttactccctcacagaacccagtaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccgccgttgcgctgccggagacgaagactggaggnnagatgggattgtgagcccagtgaaaaacanggccactgtggatcatgctggacttcagcactactggtgcacttgaggctgcatataccccagcaactgggcagccatctctctct

SEQ ID NO: 71418 - protein, 154 aa, Zea mays
  misc_feature: Ceres CLONE 1552802
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
  misc_feature (151)..(151): Xaa is any aa, unknown, or other
MAPRRLLVLAVLALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCSATLTGNHRMRAAAVALPETKTGGXMGL

SEQ ID NO: 71419 - DNA, 693 bp, Zea mays
  misc_feature: Ceres CLONE 1552804
  misc_feature (293)..(293): n is a, c, t, g, unknown, or other
atagctggagctccccgcggtggcggccgctctagaactagtggatcccccgggctgcaggaattcgtctcacccctagaaaaaatctcctgcccccttaaaaaaaagactcaccgtcgacacgccctcccgtcccgagagttctgaatcgaaaccgtctgccacgagagcagtgcgaggcgcccaccgcgatggctcgtacctagcaccatgccgtgatgaagactgctgataagcccagaagaagctccagttcgagcgctccaggtggtgcgagtaccctcgccaccccngtgaacccctgcctccggggatcaagtccctccctttggcctttttgggggcctgccttaacttgcttgcaaactgttttaatgaaatccaaagaagggcttccctggaccccggggaaaaacggcccccctggggggtccccccttttaaaaaaaaaaaacccgccccccccctgggggccaagggaaattttaaccttcggggaaaacccgaaaattcccaaaaatcccccgggaaaccgctttcccccctttggccttttttttccgggggggggaggggaggttaccaaattttttttaaaaaaggggggaaaaaaaggggcgtttttccccgaaaaaccccccctttgttggtgtgaaaaggggcaaaaaattcccccttgttagaaaggggttg

SEQ ID NO: 71420 - DNA, 752 bp, Zea mays
  misc_feature: Ceres CLONE 1552813
  misc_feature (1)..(1): n is a, c, t, g, unknown, or other
  misc_feature (324)..(324): n is a, c, t, g, unknown, or other
  misc_feature (391)..(391): n is a, c, t, g, unknown, or other
  misc_feature (402)..(402): n is a, c, t, g, unknown, or other
  misc_feature (420)..(420): n is a, c, t, g, unknown, or other
  misc_feature (458)..(458): n is a, c, t, g, unknown, or other
  misc_feature (488)..(488): n is a, c, t, g, unknown, or other
  misc_feature (489)..(489): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (521)..(521): n is a, c, t, g, unknown, or other
  misc_feature (528)..(528): n is a, c, t, g, unknown, or other
  misc_feature (529)..(529): n is a, c, t, g, unknown, or other
  misc_feature (540)..(540): n is a, c, t, g, unknown, or other
  misc_feature (575)..(575): n is a, c, t, g, unknown, or other
  misc_feature (596)..(596): n is a, c, t, g, unknown, or other
  misc_feature (617)..(617): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (690)..(690): n is a, c, t, g, unknown, or other
  misc_feature (691)..(691): n is a, c, t, g, unknown, or other
  misc_feature (713)..(713): n is a, c, t, g, unknown, or other
  misc_feature (714)..(714): n is a, c, t, g, unknown, or other
  misc_feature (715)..(715): n is a, c, t, g, unknown, or other
  misc_feature (735)..(735): n is a, c, t, g, unknown, or other
  misc_feature (736)..(736): n is a, c, t, g, unknown, or other
  misc_feature (750)..(750): n is a, c, t, g, unknown, or other
  misc_feature (751)..(751): n is a, c, t, g, unknown, or other
naaagctggagctccccgcggtggcggccgctctagaactagtggatcccccgggctgcaggaattcgtctcacccctagaaaaaagcagcataacaagaagacacaccaaaacctagctagcttgccgcacctgcttggggctgccaagtaaaagtagtaagctagagaagcaaagcaaagctccgatccaatccaatccaccgcgaggattatgtctctggtaaggctcctggacacgctggccctggactcgtgggtgcggaacccgttcaccatcttcggcacggcggtggccgccgacgcgtggctggccaacgacacntcggcgttcgccaacacgcacatcgagagccgggatacggccgccccccacgggtggggaggggggntcccgccgggngtcaagaaagaggaggtnacggtggagctgggacaaggcaacctgctggttcatcnccggcaaccgcaacgtgtgcccccaggaanngnnncgacgggtgccacctcatcaagggcggnccgcgcnntctttttcgcnggattccccctgacacgaagaaagcccccgaacantgcgccccgggccccccctgnacccccgcaagacaccccgcnatcccagcccnnnggacggggcccccccccccccccctcgtgcccaaaaaaacacccccgacccaaccccccnntcccacccaccctcttcacctnnnaacgcgcccccccccaaagnnttcgaaacgaaacnna

SEQ ID NO: 71421 - DNA, 657 bp, Zea mays
  misc_feature: Ceres CLONE 1552815
  misc_feature: Encodes the peptide sequence at SEQ ID NO. 71422
  misc_feature (657)..(657): n is a, c, t, g, unknown, or other
tacccgcggtggcggccgctctataactagtggatcccccgggctgcaggaattcgtctcacccctagaaaaagtcggagcgctccccgccgcctgcacatctccctggcagtggcggttgcctccaccctcagcgccgcccagatccctcgtcctcacctgttctctatcgtggaccctgatctgtccatgctcaagaatcaatccagagttaagttgtatggatcctactgatgttccagaagggattgatcccaagagtgcgtgcagagtggaggtcactgtcaattcctacttcactatgcaagatggtagaaaggaatataatcgaggcaagacagtaagctatgttgttgattcagaagaatactcagttattgatttagagaaagatattgcttcacaatttaaatgggggagcgaccaacagcctaatttctgggttctaacaaggggtaatatgacaagcaagttggcttcagatgcacaacttcttgacttgttaagggcatctagagtagtgaagttattaatgaataggggcaactgtgagcaccatgtaggacatgggcatattcctgctacatggaaacatacaaaaagagatacctggttgagtgaaacataaaaaaagaaatgcttgatgcaatggataan

SEQ ID NO: 71422 - protein, 135 aa, Zea mays
  misc_feature: Ceres CLONE 1552815
MDPTDVPEGIDPKSACRVEVTVNSYFTMQDGRKEYNRGKTVSYVVDSEEYSVIDLEKDIASQFKWGSDQQPNFWVLTRGNMTSKLASDAQLLDLLRASRVVKLLMNRGNCEHHVGHGHIPATWKHTKRDTWLSET

SEQ ID NO: 71423 - DNA, 712 bp, Zea mays
  misc_feature: Ceres CLONE 1552817
  misc_feature: Translation starting site: 259
aaagctggagctcaccgcggtggcggccgctttagaatagtggttcccccgggcttgaggaattcgtctcacccctagaaaaaacccccctcgcttaaaagctgtagctcacacgagccgtgcgactgcgagtgcgagggaggaagggagagaaaaaggggagcccgatccaatcccaatcccaatcccctcccgccgcgtcacatcgccgccgtcctcgtgccccgttacctctaaaaccctagcggggagccggggatgaagatccagtgcaacgcgtgcggggccgcggaggcgcgggtgctgtgctgcgcggacgaggccccgctctgcgtcgcctgcgacgaggaggtgcacgccgccaacaagctcgccgggagcgacagcgggtgccgctcctgacggacgcggccgtcgctgccgccgcggcggccccggccgtgcccaagtgcgacatctgtcaggaggcttctggatacttcttctgcctagaggacgtgcactactttgtagaaactgtgattgtgctatacacccggtgattcctttgtttcagtactcagagattctggctactggaggtcaggtgggtcttgatccggctgatccattccccctattgctgaaaacccgttaatggtgctggggaacaataaatcaccccggggaaatccgcccaagggaagccccacggttcattttccttggaagg

SEQ ID NO: 71424 - DNA, 679 bp, Zea mays
  misc_feature: Ceres CLONE 1552819
  misc_feature: Encodes the peptide sequence at SEQ ID NO. 71425
  misc_feature (406)..(406): n is a, c, t, g, unknown, or other
  misc_feature (438)..(438): n is a, c, t, g, unknown, or other
ggagctccccgcggtggcggccgctctagaactagtggatcccccgggctgcaggaattcgtctcacccctagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtcttttgcatcaggaaccctngagaaatcccgtgggggtgaggctgcgctgantacgtcctggagtcaccggcgtcttcactgacaggaacaagctgctgcacatctcaggggtggtgcccagaagggtggtatcctctgcccaagcaaaggacccaccatgtttggttgttggggccaatgaggacaagtccacctcggagtttaacattggtttccatggctagctgtacaaaaaaatggccttggcccctctgggtaagggatttaaggacacactccgcgttgtgtagag

SEQ ID NO: 71425 - protein, 90 aa, Zea mays
  misc_feature: Ceres CLONE 1552819
  misc_feature (4)..(91): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (85)..(85): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFCIRNPXEIPWG

SEQ ID NO: 71426 - DNA, 662 bp, Zea mays
  misc_feature: Ceres CLONE 1552820
  misc_feature: Translation starting site: 167
  misc_feature: SWISSPROT Homolog: EC 4.1.3.1 Isocitrate lyase
  misc_feature (275)..(275): n is a, c, t, g, unknown, or other
  misc_feature (323)..(323): n is a, c, t, g, unknown, or other
  misc_feature (357)..(357): n is a, c, t, g, unknown, or other
  misc_feature (387)..(387): n is a, c, t, g, unknown, or other
tccccgcggtggcggccgctctagaactagtggatcccccgggctgcaggaattcgtctcacccctagaaaaaacgcttcgcacttgcaatagttcgtcatctccaagtgcgtgcgccggccgccccctatcccgccggccctgtgtgtgttccccgctaccagccatggcgtcgccgttctccgtgccttcgctgatcatggaggaggaagggcggttcgaggcggaggtggcggaggtggagtcgtggtggggcacggagcggttccggctcnacaagcgcccctacaccgcccgcgacgtggtcctcctcggggcacgcntcggcagagctacgcgtcgggggagatggccaanaaactgtggcgcacgctcaaggcgcaccangccggcggcaccgcctcccgcaccttcggcgcgctcgaccccgtccagtcaccatgatggccaagccctggaaaacatctacgtctccgggtgggagtgctcgtccacggaaccctcaacaaagaggccgggccgaacttgccaattcccctaaaaaaccggcccaaaagggggaacccctttctttcggaaatttaccccaccccaagcaggggggggccccatttctttcccccccaaaggggcggggggccctaatttaatttctaaaccta

SEQ ID NO: 71427 - DNA, 570 bp, Zea mays
  misc_feature: Ceres CLONE 1552821
  misc_feature: SWISSPROT Homolog: EC 5.4.2.1 Phosphoglycerate mutase
ctccccgcggtggcggccgctctagaactagtggatcccccgggctgcaggaattcgtctcacccctagaaaaagccccattgctcgctcgctcgccaagagttcttcttgttaggcaaggcaaaagcagaagcaaaaaagaaaggaaaaagaaggtcttgttgccgatggggagctcagggttctcgtggactcttccggaccaccccaagctccccaagggggaaaccggtggctgtcgtcatgctgaacgatggggcaggcaacccgatcatacactgtatcatgtcgctagactctgtcatgactcgctaaagatgcgctctgagatatgagactagtgacgctatggacagctgtggtctccatcgatgagactgggcacagcgagtggtcacatgactggtgctgtcaattttccccagggtgctagctgtcgatcagctcctgctccgaaagattttgatggaaatgggtccactcatcaagaatcttttgaagggtcccctccccttattggttttaaaaaaagggggtccccctcccgtcttgttaaatgcatttcttcta

SEQ ID NO: 71428 - DNA, 676 bp, Zea mays
  misc_feature: Ceres CLONE 1552822
  misc_feature: Encodes the peptide sequence at SEQ ID NO. 71429
  misc_feature (509)..(509): n is a, c, t, g, unknown, or other
  misc_feature (510)..(510): n is a, c, t, g, unknown, or other
  misc_feature (529)..(529): n is a, c, t, g, unknown, or other
  misc_feature (539)..(539): n is a, c, t, g, unknown, or other
  misc_feature (542)..(542): n is a, c, t, g, unknown, or other
ccgcggtggcggccgctctagaactagtggatcccccgggctgcaggaattcgtctcacccctagaaaaaaccacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaagaggtcagcggcgcccgtgtcgtccgtcaccgtggagaggatgctcacggtgacnngcgtccggtggaggcgtcnccgggcatcnggncagatgtacttccagcgcgccgtcgacgacatcggcgacctcctcggcaagacgctgctgctcgagctcgtcagctccgagctcgacgaaaagtcgggcgtgagaaaacgcggggtgacggcgtacgcgcacaa

SEQ ID NO: 71429 - protein, 119 aa, Zea mays
  misc_feature: Ceres CLONE 1552822
  misc_feature (65)..(65): Xaa is any aa, unknown, or other
  misc_feature (71)..(71): Xaa is any aa, unknown, or other
MSSARACRRRRPRQPPPAGGPAAACPPGPAPGGTCGCRGSAAAPPKRSAAPVSSVTVERMLTVTXVRWRRXRASGQMYFQRAVDDIGDLLGKTLLLELVSSELDEKSGVRKRGVTAYAH

SEQ ID NO: 71430 - DNA, 660 bp, Zea mays
  misc_feature: Ceres CLONE 1552823
  misc_feature: Encodes the peptide sequence at SEQ ID NO. 71431
tggagctccccgcggtggcggccgctctagaactagtggatcccccgggctgcaggaattcgtctcacccctagaaaaaatggaagcgcagaccgactccgcccccggcggcggcgacgatcttgcgatcatgcgcgagcagtgccggacactggaggagtccatttccacccgccgtgaggcgcagctcgacctcatcggctccctgcagcacctcgtccccgacctggttccatccctcgaacaatcgctccgcctcatcgccgccttcaacggccgccccttcgtccccacgctgtaccccaacgccagcgtccacgtgcagaaccccaaccttaagccccagcaccgcccggtgtgcgggaaccagtggtggcatccacgccgttcgtaccatggttgccgtctgtctcctcgagctcgtcccctttgccgagatcgatgccgccgcgctcgcgcgccgcctgcagtccgaaacgtcgtctgccagcgaggccgagcgcgctgctctggccgacctcgccgcggagcttgggggctccgcccccgctgctgttgctcttgccctccgtcgcatcgcagaggacagcgccggcttgcagatcgaagaaggcttcatttggggcaagcaaatgactatggtctgggccctcgaccgag

SEQ ID NO: 71431 - protein, 88 aa, Zea mays
  misc_feature: Ceres CLONE 1552823
MVAVCLLELVPFAEIDAAALARRLQSETSSASEAERAALADLAAELGGSAPAAVALALRRIAEDSAGLQIEEGFIWGKQMTMVWALDR

SEQ ID NO: 71432 - DNA, 718 bp, Zea mays
  misc_feature: Ceres CLONE 1552824
  misc_feature: Encodes the peptide sequence at SEQ ID NO. 71433
  misc_feature (358)..(358): n is a, c, t, g, unknown, or other
tccccgcggtggcggccgctctagaactagtggatcccccgggctgcaggaattcgtctcacccctagaaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttaggagcttctgcttcttttatgtctgaacaatctttgctttatttgggattgttgggagaggtctctcgtgcaactaggaaaagggccaaggttccgtcccactgcatgcgtcaagagactgtctgggtttccttggtccgatttnccctttcccggtggtcaaagccgggcttggtttccttcgaaagaatcacttctactcttgagtgggggattttgtcgcatctggattcaacttccataaacctttttcccaggatggcgcctgcaaaaacatttggggctttaaaacaggggattgatggccttcctacggggtacaaggatgccccgaaatggttttcccaagaatggaggggccctggggtaatggtattcaaaaaacaattgtttgtgaaacattgtgtttaaataaatagaaagcgcctttgggagggcgcggcttttcctaacacaaccaaggtaatttttgggagtgtgggcgctttggggggcccaatctcca

SEQ ID NO: 71433 - protein, 130 aa, Zea mays
  misc_feature: Ceres CLONE 1552824
  misc_feature (43)..(43): Xaa is any aa, unknown, or other
MSEQSLLYLGLLGEVSRATRKRAKVPSHCMRQETVWVSLVRFXLSRWSKPGLVSFERITSTLEWGILSHLDSTSINLFPRMAPAKTFGALKQGIDGLPTGYKDAPKWFSQEWRGPGVMVFKKQLFVKHCV

SEQ ID NO: 71434 - DNA, 649 bp, Zea mays
  misc_feature: Ceres CLONE 1552825
  misc_feature: Encodes the peptide sequence at SEQ ID NO. 71435
ggagctccccgcggtggcggccgctctagaactagtggatcccccgggctgcaggaattcgtctcacccctagaaaaaagccttctcccatcctcgaagcacggaaggctcccagaaggagctctcacctcgcagccatctctggcacgtccgtccttcttctccctcggtccctccccttctccacagctatcggattggcgttggagtggagatcgacccgggctcggaattcccttcgttggaagattggggtttcagctcaaactcccatgctcgacgctgaggacgaccctggcgggagatgacgaggatcttcgtgcagcgcgggaccgccggctcctcgtccagctccggccgctcggacacgcagccagtgcagccggcagcagctgcccgggaaggaggagttgccgctgcaacctcaacacagctgccggagctattggccatagatgatacaactgataaattaaatgagggcagcgagaatatcagcaataagcctttgaggacggatgacaccatttcagagagctcaagctccgcagaggagagggctgccagggagagcctcttaagatgactctaatgtatcaaccccacttttctagtagaggaacctggagggatccagatccctgatcaa

SEQ ID NO: 71435 - protein, 93 aa, Zea mays
  misc_feature: Ceres CLONE 1552825
MTRIFVQRGTAGSSSSSGRSDTQPVQPAAAAREGGVAAATSTQLPELLAIDDTTDKLNEGSENISNKPLRTDDTISESSSSAEERAARESLLR

SEQ ID NO: 71436 - DNA, 706 bp, Zea mays
  misc_feature: Ceres CLONE 1552828
  misc_feature (38)..(38): n is a, c, t, g, unknown, or other
  misc_feature (62)..(62): n is a, c, t, g, unknown, or other
  misc_feature (224)..(224): n is a, c, t, g, unknown, or other
  misc_feature (229)..(229): n is a, c, t, g, unknown, or other
  misc_feature (250)..(250): n is a, c, t, g, unknown, or other
  misc_feature (313)..(313): n is a, c, t, g, unknown, or other
  misc_feature (328)..(328): n is a, c, t, g, unknown, or other
agctcaccgcggtggcggccgctctagactagtggatnccccggggctgcaggattcgtctncacccctagaaagcggaggcctcgctctggttggaaggtttggagaaactccccggctcgaggagatcgtgacattgagaggacgatgggagggcgcgcgctcctcctcctcctcctggtctcggcgttggtctttcagatccacgcctcccgaaccccggncttgncctgtttaccgaagccccttntttccattgaacgacttttgagggggagatggggtccctcctcccaagaaaaggggtatgatnttcagccccttcccncccctcggctgggtgtggccccctcccctttcccttcttctccctcttttggaggcgaccggcccctctgcccctccgctgtcttctgtttccccttcggcgtctcccctctcggccgcgtacctatcggctatcttgcgttcccctgcgcggccttccactcgcttcttgtgcgccgagcgcgccgcgcctgcccgcgctcctacgacctccgcccatctctctccgccctttccccctgctcctctgcgcgccgcttttgcgccccgtgccccctccccctctgtcgttccgctccgtcttatgtgctgttatctagcttctggtttcttgagcctgcccttttcttatctgtgtctcgcggtggcccgttcccgt

SEQ ID NO: 71437 - DNA, 1088 bp, Zea mays
  misc_feature: Ceres CLONE 1552829-R
  misc_feature (964)..(964): n is a, c, t, g, unknown, or other
aaggagcttcctgacgtcaccacacaggttccaaaaccatggaagtttttcatcatctgcttcacacacggcacaaatgtctaacctcgtgaacctaaaaccaagcaatttatacatgcgcaaaacatcagtcgcaatggacgtggacgggcaccggtcgccggagaacgggttcagaactcggcggtgttgccgcacgacgagacgccgagctcgcgctgccggcgccggaacgacatgagcccgtccgacacgatgctcccgccgtagacctcaccgtcgccgcactccgcgctgcttccggtcaggtcgttgtactccaccccgtccctcgcgagggttttttccgaatgggccggagggagcttccaagcaaattttcctcgtctggaaaccggcggccttgggtcggtcactctccgtgcccggaacggcctcggggtccgctctccggaaccaaagcttcctggggccgcggaggaacccgggagaggctggccttcgggcttcattcgccggtaatttggggcggaacaggggaccctaccttctcttcccagagttccccctcggtgggcccacaccgccccctccccactttgtgggtgtgagttccgctgcgcgaaaaacgctcccttaacatgagaggtatctcgccctggcaagaatattgtgaaagttaccactctatctgcggctctctctctatatgcttatgatcggatagtctacgggtcatgtgtgtagtgaaccctcggggggcgcaacatagagtataacctcccacgctttgcaacactgatgattaaccatcacggggaagcgcttctctactccctccctgcgaagagtggggtccccctgatgttctcttccgaggaagcctcctcccgatgtttcctcaccaagcaagagtaatacttttcttgctgtgtctgaacccacgggtggagaaaaatcattnccacaactatgggtacttcggcccgggtacttgtaccagactgtgagggtgaagtgtgtgggaatgagcgtctttcttgctgtgagtgactcccctatggaccttcgtcgaggtctctgtggtg

SEQ ID NO: 71438 - DNA, 852 bp, Zea mays
  misc_feature: Ceres CLONE 1552829-R2
gattgggtacctcaagcgtctcgtttttttttttttttttgaggtacgagcagggagcttcactgacagtcacacacacaggttccaaaaaccatggaagtttttcatcatctgcttcacacacggcacaaatgtctaacctcgtgaacctaaaaccaagcaatttatacatgcgcaaaacatcagtcgcaatggacgtggacgggcaccggtcgccggagaacgggttcagaactcggcggtgttgccgcacgacgagacgccgagctcgcgctgccggcgccggaacgacatgagcccgtccgacacgatgctcccgccgcagtcctcaccgtcgccgcactccgcgctgcttccggtcaggtcgttgtactcaccgccatcctcgtcgaggtcgctccgcatggcacggagggtcttccgagcaatctcgcgccggacgccgccgccctcgtcggccaccacgcgccggagcgcccggtccgcgccggacgcgagcgccaggccgcggaaccggaggctgcctcggctcatcgcgtacatcgccgacaggcaccactcctccaggtccgcggtgcccccgccgccgttggtggtgtcctgggaaaggcaagaggaggaatcccggagacgggatgccacgcccccccgcgtccattcagcgcgttgccggcccctcggcagcaagcaggcccccttttgctggcgcacccattgaagcgcccagcccctcccggaaagggggccccggggcttccggcgtgggccccccaatggcccaccggtcggaaagaaatcctccccttgtgggccccccccccgggggataaaacctccgcccggactcctttg

SEQ ID NO: 71439 - DNA, 671 bp, Zea mays
  misc_feature: Ceres CLONE 1552831
  misc_feature: Encodes the peptide sequence at SEQ ID NO. 71440
  misc_feature (342)..(342): n is a, c, t, g, unknown, or other
ctccccgcggtggcggccgctctagaactagtggatcccccgggctgcaggaattcgtctcacccctagaaaactctctgcctccctcgtgccctcgccctcctttttttttagtttacccgccgtcccgcgcgccgccgtttcggttgctcggctaggggggactgggggagtgccagcgagtccatggcagcggcgagggcgtgcttcgtcgcgctggcgctggtggcggcgttcttcgtggccggatcggcggcagcggcggcgggggaatgccggagccccctcgcagctgacgctcaggcagcggccccggcagctgctgccggaacggcaggtgcncaccccccctcaagaggctcaacaaggcgccgggtcgcccccttgagaggcccggagggagacctcatagactggcgtgcatttctccaaccggcccccctgggatccccctttcctcaaaaaccaccctggtccaaaggcggcctgcatacccccccgaaagggctgttccaacaccaattccaagggttgcttcccagcggaaccccccaaacaaaaattcccccgttggtgggcttaaaacggggggggcccccgggggcccaatacccttttggggggcccagggggggagacctttcttacgccccccctcccccagagggttt

SEQ ID NO: 71440 - protein, 161 aa, Zea mays
  misc_feature: Ceres CLONE 1552831
MAAARACFVALALVAAFFVAGSAAAAAGECRSPLAADAQAAAPAAAAGTAGAHPPSRGSTRRRVAPLRGPEGDLIDWRAFLQPAPLGSPFPQKPPWSKGGLHTPPKGLFQHQFQGLLPSGTPQTKIPPLVGLKRGGPPGAQYPFGGPRGGDLSYAPPPPEG

SEQ ID NO: 71441 - DNA, 741 bp, Zea mays
  misc_feature: Ceres CLONE 1552836
  misc_feature: Encodes the peptide sequence at SEQ ID NO. 71442
tccccgcggtggcggccgctctagaactagtggatcccccgggctgcaggaattcgtctcacccctagaaaaaaagcaaccacttctgctctgcatcccgtctgggcctctgcatttgcttggctgctgctcccttctcccaccgaccaactcgatcccgcgccatggatcgcggccgaccccgcgcggggccgccttgccgtgctctcctcccacctccgtggtgcaggggccgaggaggcggcggggctggagaggtcgccggtatccgcgccggtgcccgggccccgcgccggcgcgcttgccgtggtggacgggaggaccgggaagcggcacgaggtcaaggcctccgaaagacggcaccccttcgcgcgagcggactttcaagaaggggaccgaagcagtcgaaccgcggaattgaacggtcccccgggggggtccccgccctttgccgtggccggtgaatcccccccgggggttctttgggcgtttttctaaccctttccaagggaagggccgcttgggctattttggtcaaaattggccccccgggttggggcctgttgttttcccgcccccgggaaaaaatggctttggggcggaatttggtcccacacttttgtacagccaaattcgtcggacacgggttgaaccccaaaaggcctccttgcagaattttgggggggccaaaaatcgtttcgcacggcctcttcccctgcaaggttgggatttccaaagggg

SEQ ID NO: 71442 - protein, 51 aa, Zea mays
  misc_feature: Ceres CLONE 1552836
MALGRNLVPHFCTAKFVGHGLNPKRPPCRILGGPKIVSHGLFPCKVGISKG

SEQ ID NO: 71443 - DNA, 1126 bp, Zea mays
  misc_feature: Ceres CLONE 1552841-R
tgggggggtggggccgcctcgtatttttttttttttttgcaggttcaacgatacctcctataactcgaggatatacttactaccttcaatcaccggtacattttacgaacacacgcaggttaaaaactgactcagaacccacctgtcaacatgctcatggaccttaatcacgctgcccagacgtcctaatttgcagtgttcaacagaaaccagaaacctccacaataacagttgcagggtatcttccagctggaaggctgagcttaaaaaaaacaagccagatacaatacaaaacaagctgctgatccaaaaacctcatctctccgaaattgtccgatgatgggggaagtaatgatcgttcagcctgcatatatgaaaggtggattaagactggaaccagggatcggaagccccccccccctgggttgtgggttgggcagtgaaaaatgaaaactagaggccatgggacctctgaatcagggggttcagatttagaactctggccgccttgttcgggaaaaaacggaatattatgttccggttcggagggtcgtctatgcacctggcttttttcccggtttaataccttgattggtatgcgtgggaacaccccacatttactctggcgcttaggctatccgcgagtgcgtgtaaaatataggcaatcctatgtatgtgcccgcgctcgtgccgtacacatgatttggcgtctagttcgagcgggacacgtgagaagaagtgatgtgaggtgatgagcgaggtcatgtgggatatatatgcacatgatgggacaagatatagtaatagaggcacgcccgtatttatagaaggcagttgatgagtcacttcatgtgtgtgtcagtgatggtgcaccagccttgtgggatgtgagtccctcatatattcttttctgattaagcgaacacccaaaccagtggatgggcgcgaggctgagtttgcgcagataatacaggggtgagtggaggtatagaaccgtggtcggcttgctctcattataagagggattgggtccactgttgaggtggtgatatggtggactgcgtggctgtgaataagggggagccttggagaatctaccaaaataccagtattgtgacttgaatcg

SEQ ID NO: 71444 - DNA, 722 bp, Zea mays
  misc_feature: Ceres CLONE 1552842
  misc_feature (196)..(196): n is a, c, t, g, unknown, or other
  misc_feature (255)..(255): n is a, c, t, g, unknown, or other
  misc_feature (257)..(257): n is a, c, t, g, unknown, or other
  misc_feature (332)..(332): n is a, c, t, g, unknown, or other
tccccgcggtggcggccgctctagaactagtggatcccccgggctgcaggaattcgtctcacccctagaaaaagtcggaatatcatacgaaaaccctcgcggcgaggagcgctctccgtcccacacacgcgcgccgcagcctccgcagtccgcacctgcctccacgacttgtcgtgctcgtgcgctactctcctcnagcgcggcgcggagcacggggacatcaaatggcggcagcggcggagatcggtggtttcncngcggcaagagtggcggtggcgacgctcaggccggctgcgcacccagccccggggggggggaccgcagcatcctangaagggcggtgccgcacattctctttcgaacaaccgcccccgggggggcttacctgcgtattctcgccgggcacaaccacggggggttgtgcatgcttcggaaaaaatagaaaggctacaaggtgaaatccctttcccgggcagtttccgggaaatttctagggaaaaagacaaagatttgtctggccccattagggcccctcaacccaacccttggtgaagaaaaatttggaaaagcttggcagaaacagggaacagaattgcacccccgccccttaatattggtcccaggggggaccccccccaccccgcaccagaaaagggtttttttggtttgtgggccagggggacttacaatggggccccaaaaacccttggttgggcaatttg

SEQ ID NO: 71445 - DNA, 2061 bp, Zea mays
  misc_feature: Ceres CLONE 1552847
  misc_feature: Encodes the peptide sequence at SEQ ID NO. 71446
aagaaagctggcctcctccgcctttctttccttcctccctcggggctccgcgcgcgcagcagccaggaacatctccgctgcctgcccccttcaagaacagcggcggtcggctcttctccaatcctgcttcaaggcaaccgctaaggcaattgttcctggcctgagctatatctctgcaggaaagctcagttcagatccattcacttcactcatgggctcatcctcgggccatcagagaagcaaaacgcgcagcaggaacaggaagcccttgggaattcagctcttggagcgggtccgtggcagtggcagccccatctccttcagatcatgccaggctctcgtgctagtgctcacgttcctatcctacgccagctaccacgccaccaggaaaaccacgagcatcgtcaagagcgtcctcgacccaaagacgaagacgaacctaggcacgtcgtcggcgcattactggccccccagccacctcttctatctccacaatctcaaaggtgcggacaacagcagcgccggcggcggcggctgggctccgttcaacgcggcggaagacggcacggcgttgctgggcgagatcgacctggcgttcctcggcgcgtacgcggccggcatgttcttcgcgggccacctgggcgacagggtggacctgaggatcctcctcgccgtagggatggtggggaccgggctcttcaccgccgccttcggcgcgggctactggctcgacgtgcacagcttctactacttcctgggcgtgcagatggtggccggcctgttccagtcgtccgggtggccgtcggtggtcgcggtggtcggcaactggttcgggaagagcaagagggggctcatcatgggggtgtggaacgcccacacctccgtggggaacatttcggggtcgctgatcgccgctgccatgttgaggtacgggtggtgctggagcttcgcggtgcccggtggcgtgatcgcgctggtcgggctcgccgtgttcctgctcttgcctgttgcgcctgatgtgattggagtccgggaggaggatctctgtttggaggacgatgagaagaagcagagcgacatggacgctccattgctggaacgacgaggctcagatgtagaggaaaaggcggttgggtttattgaggcgtggaggatccctggtgtggctcctttcgccctctgccttttcttctgcaagcttgtggcgtatacgttcctgtactggcttcccttctatatcagccacacagctatcggtggagaatacttgtcggactccgcagccggggtactgtcgacgctgttcgacgtggggggcgtcgtgggcggcatcctcgccggccacatctcagaccacctggacgcgcgggcgctgacggccgcgagcttcaccttctcggcgataccggcgctcttcttctaccgcgtctacgggaacgtctcgctggcctggaacatcgccctcatgttcgtcacggggatgctggtgaacggcccctacgcgctgatcacgacggccgtgtccgcggacctcggcacgcacagctcgctcaacggcaactcccgcgcgctggccaccgtcacggcgatcatcgacggcacggggtccatcggcgccgccgtcggcccgctcctcacgggctacatctccgccaggagctggagcgccgtgttcacgatgctgatggcgtcggcgctcgtcgcggggctgctgctgtccaggctggtggcggcggaggtggtcgccaagatggagtcccggaggacgcccgccgctgctgcgagcgacctgctgcccgtgtcctcctcctccatggacgaaccgtagatcgcttctagctgcgccccggctgtggtctcctggtgacatgaaatggtggcgggagagtagatcacctgtgattttaggcctggtgggactgtgggagcaggtgcgcagtgcgcttctgtcccggaactgtgggatcttgctcctgccgtgccgtgcttcaccgcttctggttcgtcatggtatatatatatatggaatgtcttctggttgccgaaaaaaaaaaaaaaaaa

SEQ ID NO: 71446 - protein, 538 aa, Zea mays
  misc_feature: Ceres CLONE 1552847
  misc_feature (44)..(473): Pfam Name: MFS_1 Pfam Description: Major Facilitator Superfamily
MGSSSGHQRSKTRSRNRKPLGIQLLERVRGSGSPISFRSCQALVLVLTFLSYASYHATRKTTSIVKSVLDPKTKTNLGTSSAHYWPPSHLFYLHNLKGADNSSAGGGGWAPFNAAEDGTALLGEIDLAFLGAYAAGMFFAGHLGDRVDLRILLAVGMVGTGLFTAAFGAGYWLDVHSFYYFLGVQMVAGLFQSSGWPSVVAVVGNWFGKSKRGLIMGVWNAHTSVGNISGSLIAAAMLRYGWCWSFAVPGGVIALVGLAVFLLLPVAPDVIGVREEDLCLEDDEKKQSDMDAPLLERRGSDVEEKAVGFIEAWRIPGVAPFALCLFFCKLVAYTFLYWLPFYISHTAIGGEYLSDSAAGVLSTLFDVGGVVGGILAGHISDHLDARALTAASFTFSAIPALFFYRVYGNVSLAWNIALMFVTGMLVNGPYALITTAVSADLGTHSSLNGNSRALATVTAIIDGTGSIGAAVGPLLTGYISARSWSAVFTMLMASALVAGLLLSRLVAAEVVAKMESRRTPAAAASDLLPVSSSSMDEP

SEQ ID NO: 71447 - DNA, 669 bp, Zea mays
  misc_feature: Ceres CLONE 1552851
  misc_feature (577)..(577): n is a, c, t, g, unknown, or other
ggagctccccgcggtggcggccgctctagaactagtggatcccccgggctgcaggaattcgtctcacccctagaaaaaacacaaccgctgccgtttcttcatctcccaatcttcatcttcctcgcagcgtcccttgctcgcgttcggcacataggcgacggcggcggcgctcaggatcgggctctcggcgacggcgctcagggtcgggctcttagcgacggcgtcagcggcttcccctcccgcctcccgttagtcgcctcgcgccctcgcctccggtcctccgcccacccgctggtgaccctgcgagcatgaatcactgacttgtgaaccattacctttatgggaaaagaaaaactccataagcagccctctggccgtctgattgaatctctcaaaatggagaggatgaggaacatcctgactcatagatatccatatccgcatgaacactcaagacattttatcattgctgtgtttgcttgttggcttttcttcatttcctcggataatttgcaaaacccttatatgaagttggacaagatttttaaatgggtgtccatgtatgcttgttttgatnggcttcctctatttcttctcatcgccttttatcagggaagacattcaaccaaactattcgaacttcaatcgatggtatattgcatgggatat

SEQ ID NO: 71448 - DNA, 617 bp, Zea mays
  misc_feature: Ceres CLONE 1552856
  misc_feature: Translation starting site: 178
  misc_feature: SWISSPROT Homolog: EC 2.7.12.1 Dual-specificity kinase
tccccgcggtggcggccgctctagaactagtggatcccccgggctgcaggaattcgtctcacccctagaaaaattgaaatcaatcgtgttcctcgcctgcacgacgagagcccgagaccaatccagccgccgcctccgccttcgcctcgcctagtattccctccgattcagaggccgatggagtgcatcgccgagatgccccgcgcgccgctggacagcaggctgcgcaagcgtcagcgtctcggctgggacgtcggccctgccgagatgtataaggccgtgcggccgcggcacgggtgggacgtcggccccgccgagatgtatcagttagaactttgtggacaagaagttgtgaatgccatcagtgctgcagcgttgggcctttcgtcgggctgtgtttcttctcagtcaaacaagagcagcttcatgatggttcccctcctctgagagaagatgacagggatgggcattatgtttttgctgttggagataacctcacatctcgctataagatcaatgcaaaaatggggagaagtacctttggtcaggtgtttggagtgttggggacaggaaaaggaaagaaatggtggctatcaaaatcattaggggcataaaaa

SEQ ID NO: 71449 - DNA, 374 bp, Zea mays
  misc_feature: Ceres CLONE 1552857
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
ctcgggtggggcgctctaaatgtggatcccccggctgcagattcgtctcacccctagaaaaattccatctccatagacaagtaatcccaatcccgtcctaccctggatggtttcctgccctgtctgtcgcctcgtgacgtctgtcccaagaaaccccttcnnnccctcccccctgttcctgttcttcttttgcaattgcccttttaaataatttggaggactggaatacattgggtccaaaattcccggttttaaacccccctttttttttttcccgcccaaaagggatcccttttttcaaaaaaaaaacaaattttaacccgggcaccttttaaatttggaaaataaaaaccccccccccccccctttttttg

SEQ ID NO: 71450 - DNA, 552 bp, Zea mays
  misc_feature: Ceres CLONE 1552860
  misc_feature: Encodes the peptide sequence at SEQ ID NO. 71451
  misc_feature (267)..(267): n is a, c, t, g, unknown, or other
  misc_feature (286)..(286): n is a, c, t, g, unknown, or other
  misc_feature (287)..(287): n is a, c, t, g, unknown, or other
ctccccgcggtggcggccgctctagaactagtggatcccccgggctgcaggaattcgtctcacccctagaaaaagttgtcgtcaacaagtacttcccggccgcgccatggcagcccgggaagccgccgctgcgtctgcctccggggccacggcagctgccggtgatcggcagcctccaccacctcctcgcgtcgcgccacggcggcctccttcaccgcgccatgcgcgagctgtccatccagcacggcccggtgatgctgctccggnctgggcgccgtgcccacgnnctggtggtggtcctcggcccgaggcgggcccagggaagtgctgaagaccacgacgcgcgttcgcagcggcacagacgcgacgctggagtgtcagctcggcggcgcacatctcttctcccctacgggagctgtgcgcagctccggcgatctgctgctggactctctcgcgcgcccctgcaatcttccccccatcctaaagagaggcccggggctcccccggccgggccaaatcctgccccgggggaaaccgggggtgaactcggga

SEQ ID NO: 71451 - protein, 183 aa, Zea mays
  misc_feature: Ceres CLONE 1552860
  misc_feature (89)..(89): Xaa is any aa, unknown, or other
  misc_feature (95)..(95): Xaa is any aa, unknown, or other
PRGGGRSRTSGSPGLQEFVSPLEKVVVNKYFPAAPWQPGKPPLRLPPGPRQLPVIGSLHHLLASRHGGLLHRAMRELSIQHGPVMLLRXGRRAHXLVVVLGPRRAQGSAEDHDARSQRHRRDAGVSARRRTSLLPYGSCAQLRRSAAGLSRAPLQSSPHPKERPGAPPAGPNPAPGETGGELG

SEQ ID NO: 71452 - DNA, 662 bp, Zea mays
  misc_feature: Ceres CLONE 1552861
  misc_feature: Translation starting site: 114
  misc_feature: SWISSPROT Homolog: EC 1.6.99.5 NADH dehydrogenase (quinone)
ggagctccccgcggtggcggccgctctagaactagtggatcccccgggctgcaggaattcgtctcacccctagaaaaaacatctccgttcgatcccatcgccccgccgccgccatggcgtttctcgcgcgggcgctgcggcagtccaactggcgcctgtcgtcgcgctgccccgccgtggctgcctcctgccgttggatctccccgaccgccgccgcgggttcgccggaggccggcgcagcggtggcgcctgccgacctggagctgcctccgccgcgggagcccgttggaggcgcccgcgtggagcttcctcccaacccggaggacgcgctcgaggtattcgtggatggccatgcggtgcggatccccaagggggttcaccgtgctccaggcctgcgaggtcgccggcgtcgacatcccgcgcttctgctaccatagccgactctccatcgctggaaactgccgcatgtgtctcgtcgaggtcaagaagtcccccaagcccgtcgcttcctgtgccatgcccgcgctccccgggatgaagattaagacaaaacccccttgccaaaaaagcaagggagggtgtcatgaatttcttgctgaagaaccatccaccccactgccccatctgtgatcagggggggcaagtgcaaccctccaggatca

SEQ ID NO: 71453 - DNA, 674 bp, Zea mays
  misc_feature: Ceres CLONE 1552865
  misc_feature: Encodes the peptide sequence at SEQ ID NO. 71454
  misc_feature (69)..(69): n is a, c, t, g, unknown, or other
  misc_feature (624)..(624): n is a, c, t, g, unknown, or other
  misc_feature (674)..(674): n is a, c, t, g, unknown, or other
tcaccgcggtggcggccgctctagaactagtggatcccccgggctgcaggaattcgtctcacccctagnaaaaagcaaaagctgctcatcaccgacgatggtgccacggctaacacaagcaagcaagcaagtcactgagtagctagcagtatataccaccataaaaacaacacacacacacacgtgcgctaataagctaagcttaaggcggtagccgtagctcctctcgatctccggctcggacggacgacgttgccatggctgctcaactgcatcacgcactatacgagctgctgcacgaagcagcagcagcgcaacgagctctgctgctcgcgatccccttctccctgctgctcctcgccgcctcctgctcgggtgacgcgggagggtcggcgtcggcctccgcaacgaaaaccgacgggaggggcgccgggcatccaaccccgaaaaagttcttgagcctgcctgccctcccccccccaatgaaaggttccccattcttgggggcccctgcccccgggatgggggaactccccccacgggccccctcggccgcgcgttgccacaagggtaacggggcgggaactgtgattccggcttcgccgctggggggcgccggtgatntaacgcggggggtgggcttatatggttgcgccctccgccccccacaaaan

SEQ ID NO: 71454 - protein, 138 aa, Zea mays
  misc_feature: Ceres CLONE 1552865
  misc_feature (123)..(123): Xaa is any aa, unknown, or other
MAAQLHHALYELLHEAAAAQRALLLAIPFSLLLLAASCSGDAGGSASASATKTDGRGAGHPTPKKFLSLPALPPPMKGSPFLGAPAPGMGELPPRAPSAARCHKGNGAGTVIPASPLGGAGDXTRGVGLYGCALRPPQ

SEQ ID NO: 71455 - DNA, 653 bp, Zea mays
  misc_feature: Ceres CLONE 1552866
  misc_feature: Encodes the peptide sequence at SEQ ID NO. 71456
  misc_feature (653)..(653): n is a, c, t, g, unknown, or other
ctccccgcggtggcggccgctctagaactagtggatcccccgggctgcaggaattcgtctcacccctagaaaaattccatccccaaccaaacaagtttagatataaaaatatagcatcgcccgcgctctggagagtctggatcctcctgaacctccaagcagcaagcgatgaaaggagggacgcaagcaattagcctgatggtgcaccttgctgtgccatggctctgccttgcttcttgggcagctctgctaccagcgctagcatctggaaatgtgggtgcagcagctccgatactgagagcagattacataaaattgaacttcagcaccgcttcggcgacccccgacaagtacaagagcttcatcgcttctgttcgtgctggcttggtgagcaaagcggggggcaacagcagcgggatccccgtgctggtcgacgaagacaacccgctcgcgctcgaatcgtttctaaacatcactctggtgaacaaagcagggcgctccgtaagcttgaagatggatgtctccagagcctacttcgtggcttacgtagcagggcaacgctcgtgcctcctcaagaaatcaggccgcacgtttctctcggggaattgttactacgggtggcccggggggaaaaagttcggctcctgtcaccn

SEQ ID NO: 71456 - protein, 161 aa, Zea mays
  misc_feature: Ceres CLONE 1552866
  misc_feature: SWISSPROT Homolog: EC 3.2.2.22 rRNA N-glycosylase
MKGGTQAISLMVHLAVPWLCLASWAALLPALASGNVGAAAPILRADYIKLNFSTASATPDKYKSFIASVRAGLVSKAGGNSSGIPVLVDEDNPLALESFLNITLVNKAGRSVSLKMDVSRAYFVAYVAGQRSCLLKKSGRTFLSGNCYYGWPGGKKFGSCH

SEQ ID NO: 71457 - DNA, 652 bp, Zea mays
  misc_feature: Ceres CLONE 1552973
  misc_feature: Encodes the peptide sequence at SEQ ID NO. 71458
cgattgggtaccgggccccccctcgagccactgcagtggtaaaggagcgctttcctgtccgactcccagccgtcgtctgctgcgtactccgcctccagtttggtctgtttcttgcaagttgctcttgcggtagttcccccaactgtcaccatgcagaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcagggcgatgcagacagctccttggacaggctgtggcagaagaagaaggctgatatcaagcagtagattttacatctagtttaccaagaattggacactgccttagctattgttttgattcatgtcactatatgcaatggtgtgatttcagctggtacctttaatctgaagatttagtatcttttgtgggttccttctgaagttgatgtggtggggttcgttttaatccccttggacaaaaaaaaaaaaaaaaccccgagctctgggaaattcctgcagcccggggggatccactaattcttaaaccgcccccccccggggg

SEQ ID NO: 71458 - protein, 81 aa, Zea mays; identical to SEQ ID NO: 6959
  misc_feature: Ceres CLONE 1552973
  misc_feature (1)..(81): Pfam Name: Ribosomal_S21e Pfam Description: Ribosomal protein S21e

SEQ ID NO: 71459 - DNA, 521 bp, Zea mays
  misc_feature: Ceres CLONE 1552975
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (17)..(17): n is a, c, t, g, unknown, or other
  misc_feature (26)..(26): n is a, c, t, g, unknown, or other
ttttttttnnnnngggnggggggggngcgcgcttgtttctttcccccgcccctcctctcccgccccctcttttttttttttttttttcgattgggtaccgggtccccccctcgagccctgcagtggtatagggaatggaggaaaagcccctacgggctacggcctacctgttcacagtgactgggcctcccgactcgactctcctccccctatctctatctgcttcctgctgagctcaaaccccctttccccgcccctccccccattaaaacatttccattccgcccgccgccgccgccctgcgcaaagatgaaatgtgggaagaacctcaagaaaaattggcttggcccctttaccccccccggagggaaaggcgcacctttccccccggaaaaaaaaaaaggcctttttccccaaaaaacccccctaccccccgaattaaacaaagcgcgccttttcataaaaaaaccaccccttttttaaaaaaaaaaaaaaccctcgggggggggggaaaaaaaacc

SEQ ID NO: 71460 - DNA, 762 bp, Zea mays
  misc_feature: Ceres CLONE 1552990
  misc_feature: Encodes the peptide sequence at SEQ ID NO. 71461
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggnnnnnnnttttccggattggggtaccgggccccccctcgagccactgcagtggtaaaggtagagctccctgctttgttcagacttcagagcccttcctcttgtgtccgtgcaaattggtgatacttgaacagggatctcctccatattagtgagcaggatgtataatcctcccagtgggcaggacatgtcctactacgatcatgtgcagaagcgccatgaggagaagggctgcctatatgcatgcctgttcactgcgtgctgctgcttctgctgcttcgagacctgtgagtgctgccctcgagccatctgctgctgctgctagttctgcttggaaggcatgggcgtccatcatcgtggaaatgttggcatgcgggaaaccaccggcaattaaaatgctgtacttaattgacgcaccgtaaaaatgcataagggccggttgaagggaaccttgggggggggccccccccccaactttctttgaccgggaaaaaggtttttaaatttttggaaaaaaaaaaaaaaaacccgaaacctttgggaaattcctccacccccggga

SEQ ID NO: 71461 - protein, 54 aa, Zea mays
  misc_feature: Ceres CLONE 1552990
MYNPPSGQDMSYYDHVQKRHEEKGCLYACLFTACCCFCCFETCECCPRAICCCC

SEQ ID NO: 71462 - DNA, 532 bp, Zea mays
  misc_feature: Ceres CLONE 1552991
  misc_feature: Encodes the peptide sequence at SEQ ID NO. 71463
  misc_feature (391)..(391): n is a, c, t, g, unknown, or other
  misc_feature (474)..(474): n is a, c, t, g, unknown, or other
cgattgggtacgggccccccctcgagccactgcagtggtaaaggaggctcttctcctcctcgcctcctctccctagtctccacgacgcaagggagagtgacggaaagcgacgcggcgcgagcgaggagggccaaggcgaagaggggaagcaccgcaccaggacccttgttcgccgccgccgcctctgatctccgcgaggttgtcaggattcaatatgtcgaccagcacattcgctacttcctgcacgctgttgggcaatgttagaacaacgcaggcctcccagacagcggtgaagagcccttcgtctctaagcttcttcagccaagttacgaaggttccaagccctgagaccctccagaaactggatgtctcccgccatggctgtatacangggtgaagcttgtcggggcctgaaaggtgaagagccacgagttttgatgcctcaagacgacgccttaattcctttgaacgcancccaaaaactggccgggggtgggaatttccccttacctccttggccctggcctggggg

SEQ ID NO: 71463 - protein, 60 aa, Zea mays
  misc_feature: Ceres CLONE 1552991
  misc_feature (59)..(59): Xaa is any aa, unknown, or other
MSTSTFATSCTLLGNVRTTQASQTAVKSPSSLSFFSQVTKVPSPETLQKLDVSRHGCIXG

SEQ ID NO: 71464 - DNA, 668 bp, Zea mays
  misc_feature: Ceres CLONE 1553034
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (385)..(385): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctattgggtacgggccccccctcgtaccactgcagtggtaaaggtggcaacgacgagcgacagtcgctgccgccctacggcaggtgcccaggtcttcttcggtcccttcgccgtcgacgagcactaccaggaacttgatcttataatacaaacttcaatatgttctctgctccagcaaacattctatggctctttgtagcccacggccagggatggagctggctaatatttcacatcatccaaatcaggctcctggggcctggaggaaaacnacgcaccatctaggcctggaggcacaattattgctacttacagggtacccagaatggctttctactggcatgaaattcaaacccggcgggaaactggaaataatttaagggtcccccgaaaaaaggaaatctccttttggggattttccagggggaaaattaaaaaaattttggggtctgtagagggggccaaaaaagggtttttttttacccctcccggggggcactttgtgggggcgcccaaaaattttttttccaaaaaactctaaaaaaaaaagtgtgg

SEQ ID NO: 71465 - DNA, 622 bp, Zea mays
  misc_feature: Ceres CLONE 1553050
  misc_feature: SWISSPROT Homolog: EC 1.11.1.6 Catalase
cgattgggtaccgggccccccctcgagccctgcagtggtaaaggcggtaaatgctgttaggggtggagaattcatttatatctgaactcaacagttccagaatgtaatccctttgatgaacttcgtgattaccatgttgacatatatatatacctagttacttatgcttgagttaaatatcttgcgatcttattaccaaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcag

SEQ ID NO: 71466 - DNA, 658 bp, Zea mays
  misc_feature: Ceres CLONE 1553055
  misc_feature: Translation starting site: 379
  misc_feature: SWISSPROT Homolog: EC 1.11.1.6 Catalase
cgattgggtaccgggccccccctcgagcactgcactggtaaaggtccttatcgccagccgagccgacattgttttctccccgcgtgtctcgcctgtctccttctcccccctaagctagaggcgtttgctcccgcaataccttcagtccgcccgctacgtacgtggtcccaccggcggcacagtggatccatacaagcaccgcccgtctagggaggagcaactccagcttctggaccaccaactccggtcgcccccggtctggaacaacaactctgccctcaccgtcggacagcgaggtccaatcctccttgaggatgtatcatctaatcgaaaagcttgctcaattccacagagaacgtatccctgaacgtgttgtgcatgcacggggagccagtgcctacggtttctttgagagtcactcatgatgtctctcaccttacatgtgctgattttctccgtgctcctggggtccagacacctgttattgtccgtttctctacagttgtgcatgagcgaggaagccctgagaccttgagggatccacgtggctttgctgtctagttctacaccatgagagggtaactttgacctcgtgcgtaacgacatgcctgtgtttttcatgcgagatgggatgaaattccctgacatggtccacgct

SEQ ID NO: 71467 - DNA, 652 bp, Zea mays
  misc_feature: Ceres CLONE 1553073
  misc_feature: Translation starting site: 347
ccgattgggtaccgggccccccctcgagccactgcatgtggtgaagttgccacaccgccggctgttcactgaagggaaagaggacgaataattctagtccgagtcttggagctctcgcatttacgcggtcagggtggaactgccccttgcccgtggttggtgaggcgattcgtggtcgagagcttccgtttctcttcagaggtgaagtggatctgacctactgtaggggaaagagcaaagtacattatcttgtaccaatgtgcattacgctacctttatcataaaccaaatcatctctgttctctgggaacagctaccagtaatttcccatgcaacctcttggttgatggatgttcttccctgctgggtcaggaaagagaaagtcgcacatatagtcactcctttactcatggagcatgcgattggcatcccaaggcatgatgttgcttctacatcgacacctcatccagacaataatgatggcatggatccactgccccgtgatacaaaacgtgcttctggatactgctgatgcatcttactctccgaatgctcctctagcaagcagagatgataatcgccttccgcgtcagccaagtctacattcaggcttccggatatcaattgaactagctgatgatcttagccagat

SEQ ID NO: 71468 - DNA, 571 bp, Zea mays
  misc_feature: Ceres CLONE 1553077
  misc_feature: Encodes the peptide sequence at SEQ ID NO. 71469
cgattgggtaccgggcccccctcgagccctgcagtggtaaaggtgtctctgtctgtcgctctcgctctcagacgactgggccgccgccgcttggtgctgaggctttcgttggtctcttcggcggcgacgagcacccaccagcagttctgtagaaatggctgatggtgaggacatccagcctcttgtctgcgacaatggcaccggaatggtcaaggctggttttgctggggacgatgcaccaagggcggttttccctagcattgttggccgtcctcgccacactggtgtcatggtagggatgggacagaaggatgcatatgttggcgatgaggcacagtccaagagaggtattctcacgctcaagtacccgattgagcacggtattgtgagcaactgggatgacatggagaaaatctggcatcatactttctacaacgagcttcgtgttgcaccagaggagcaccctgtgtgtgctccactgaaggctcctttgaaccccaaaggccaaccggggaaaaagatggacccaaaattattgttttgagaactttttcaattgtccccggcccaa

SEQ ID NO: 71469 - protein, 129 aa, Zea mays
  misc_feature: Ceres CLONE 1553077
  misc_feature (4)..(130): Pfam Name: Actin Pfam Description: Actin
  misc_feature: SWISSPROT Homolog: EC 2.7.10.2 Non-specific protein-tyrosine kinase
MADGEDIQPLVCDNGTGMVKAGFAGDDAPRAVFPSIVGRPRHTGVMVGMGQKDAYVGDEAQSKRGILTLKYPIEHGIVSNWDDMEKIWHHTFYNELRVAPEEHPVCAPLKAPLNPKGQPGKKMDPKLLF

SEQ ID NO: 71470 - DNA, 654 bp, Zea mays
  misc_feature: Ceres CLONE 1553097
  misc_feature: Encodes the peptide sequence at SEQ ID NO. 71471
cgattgggtaccgggccccccctcgagcactgcagtggtaaaggaatggcaaaaggttaaatttacccgttccggcggccgaccgtgcacgacctggccgcctgggcgcctggcgagtggcgaccgtctgcctgccctgcacgcccacttgccgccgccccggcttcgccactaccgccatcccgaccggctcgcgcgccaccgccatctcctcctgcgctcgccttgctgccgcggccgcccccaccacaaggacccagaggggctgccctcgatctgactgaccccacgggacaggatggacaaggggaaatcggtggtagccgagctgtcggcatcgtccagctcgctcccgtcgccctccttctatcctttctcaaagaaggctaaacctcggaaattggtcagcttgtgcctgggcacccttggtcagcatcttgaagatatcatcactgatatttcagaatttgctgccttatttccaccccacataacgttggcaattatgtctattgcaaggagaaaaagcctcctgaatgataaagttttgacttctcttgctgaaagctcctggcaaatcctagatatatctggatctgatgttactgatgctggtttggctactgtagcaaatgtttgtagtaatctacgggc

SEQ ID NO: 71471 - protein, 118 aa, Zea mays
  misc_feature: Ceres CLONE 1553097
MDKGKSVVAELSASSSSLPSPSFYPFSKKAKPRKLVSLCLGTLGQHLEDIITDISEFAALFPPHITLAIMSIARRKSLLNDKVLTSLAESSWQILDISGSDVTDAGLATVANVCSNLR

SEQ ID NO: 71472 - DNA, 646 bp, Zea mays
  misc_feature: Ceres CLONE 1553101
  misc_feature: Encodes the peptide sequence at SEQ ID NO. 71473
  misc_feature (456)..(456): n is a, c, t, g, unknown, or other
cgattgggtacgtggccccccctcgagccactgcagtggtaaaggagccggtccaagaagcagggcacggcaccagacgcgtccatggaccccaccggcgtcgacggcgattccgcggcggcgagggggagcggaggcggaggcggagggggcacaggggccggccggtgggcggttggcgcggtgtgcggggggctggtctactaccactgcgcggtacggcgagccagcgcggtgtcccttgcagcagacgtgctcctcgtcctcctctgctcgctctccatcctcggcctcctcttccgccacctccacatctcggtgcctgtggatcctcttgaatggcagatctctcaggagatggcaaatagcatagttgcatccttagccaatacagtaggagctgctgagtctgtattaagggtggctgcaactggacatgacaagaagctgtttttncaggtggtttctacattgtattttctagcagctttgggaagggtggtgtcaggcgctgccgttgcgtatgctgccctatgcatcttctgcctctacatgtttgcacaaagcaccgatctgtttgatcagctcccttcttggggtcctgtgggtagggattctttgggcggtactcaggataccgcgtgat

SEQ ID NO: 71473 - protein, 186 aa, Zea mays
  misc_feature: Ceres CLONE 1553101
  misc_feature (124)..(124): Xaa is any aa, unknown, or other
MDPTGVDGDSAAARGSGGGGGGGTGAGRWAVGAVCGGLVYYHCAVRRASAVSLAADVLLVLLCSLSILGLLFRHLHISVPVDPLEWQISQEMANSIVASLANTVGAAESVLRVAATGHDKKLFXQVVSTLYFLAALGRVVSGAAVAYAALCIFCLYMFAQSTDLFDQLPSWGPVGRDSLGGTQDTA

SEQ ID NO: 71474 - DNA, 656 bp, Zea mays
  misc_feature: Ceres CLONE 1553115
  misc_feature: Encodes the peptide sequence at SEQ ID NO. 71475
cgattgggtccgggccccccctcgatccactgcagtgttaaaggcagtcttgccccttgcggccgaccacggaagcaaaggaggaggaacatcagcaccacgcggcgccgaggatcggcatcccactcactgcttgcaaccatggctaggggattgaagaatcacttgaagaggctcaatgcgccacaagcattgaatgctcgacaagcttggcggagcttttgctcccaacccatcttctggacctcacaagtccagggagagccttcctctgatcctcatcatctggaacaggctcaagtatgctctgaactacagcgaggccatttctatcctgatgcaaccccatgtacttgttgatggtaaggtcatgactgacaagacctaccctgctgggttcatggatgtcatttccatccctaacacattggacaactacaggctgctttatgacacccagggccgcttccttcttcacccaatcagggatgaggatgccaagttcaagctctgcaaggtgaggtccgttcacttaggtcacaatggcatctcctacctgaacacctacgacggccataccatccgcatccccctacccgctcgtcagaggccaacgactccattaagatcgatctggtataccaacatgatcatgg

SEQ ID NO: 71475 - protein, 153 aa, Zea mays
  misc_feature: Ceres CLONE 1553115
  misc_feature (76)..(153): Pfam Name: Ribosomal_S4e Pfam Description: Ribosomal family S4e
MLDKLGGAFAPNPSSGPHKSRESLPLILIIWNRLKYALNYSEAISILMQPHVLVDGKVMTDKTYPAGFMDVISIPNTLDNYRLLYDTQGRFLLHPIRDEDAKFKLCKVRSVHLGHNGISYLNTYDGHTIRIPLPARQRPTTPLRSIWYTNMIM

SEQ ID NO: 71476 - DNA, 672 bp, Zea mays
  misc_feature: Ceres CLONE 1553132
  misc_feature: Translation starting site: 130
  misc_feature (515)..(515): n is a, c, t, g, unknown, or other
  misc_feature (582)..(582): n is a, c, t, g, unknown, or other
cgattgggtccgggcccccctcgagccctgcagtggtaaaggtgctctctcagaggtgggctggcttctcctccccctcttaccaagtcctcttcgggttagggttacttagggttttgtggacgggcgatggcggcagctgatgtggagtaccgttgcttcgtcggcgggcttgcctgggccaccagcaacgagtcgctggagaatgccttcgcctcctacggcgagatcctcgactccaaggtcatcacctaccgggagacggggaggtctcgcggcttcggcttctttaccttctcctccgagaactccatgctcgacgctatctcagaacatgaacggcaaggagctcgactgccgtaacatcaccgttaaccaggcccagtcccgtggcggtggctgtggccccggcggctacggtcgcggtcgcggcggcggcggctatggtggcggccaccgtgacagcggttatggcgccgttggcggctacggctttccgcgcgaggttgatggcnccggctacggacggcggtggccgctacctggagccggccccaagggtggtggggggggcctatcggnccgcggccagccggaacctggggaggaacttaatgttttgggcccctatcttgggtttttgccccagattatctcttaccccctcctaaa

SEQ ID NO: 71477 - DNA, 662 bp, Zea mays
  misc_feature: Ceres CLONE 1553170
  misc_feature (438)..(438): n is a, c, t, g, unknown, or other
tggcggccgctctagaactagtggatcccccgggctgcaggaattcgtctcacccctagaaaaaaaaaacacgcaaggctgtctgcctgtctggctgtctctgctcccatctcaagaaatccacttcgattcgccctgggacgctcctgcctcctgctagtcgacgcgcaatccttggcactctggcagacaggtgaggcgctgagcctgctacttactacacctagggagcccgggaaatgagggatgcggaggcggaggccgcctcccgcctgcggtggacgctggtgctggtgaacatggcgtccgtgctggagaagcagaccacgtgttgctgccacgccgttgtacaaccgaggtgcggcacggcgctgggagcttgctcgaccgcgctgggtctccccttggcctatgccgtcgcgctcggtcgaggacggnatgggtcgccgctggcggtttaagccgtcgggccaccacataggactccttgggggccgcggttcgaagcctttctcctgggccggcgcaacctttcgttccccccgtttccgggaggattcctaaaaagggtaattcccgggggacccctatgtattgggggtcccccttgtttggcccggggaataaggatccccgtttggggaaatcctcgattgaacccc

SEQ ID NO: 71478 - DNA, 675 bp, Zea mays
  misc_feature: Ceres CLONE 1553171
  misc_feature: Encodes the peptide sequence at SEQ ID NO. 71479
ctccccgcggtggcggccgctctagaactagtggatcccccgggctgcaggaattcgtctcacccctagaaaaaatgaacctctccgctgtctgattgtctgggtgtctctgcttccatctctcgagatccacttcaattaggcctgccgacgctcctgcctcctgctagtcgacgcgcaatacttagctctctggcgcacttgagacgctctgagactgctacaactccctagaagacctggaaatgagggatgcggagcgcgaggccgcatctggaagcagatggatgatgctgggatcaagcacatccccagcgctaccttctcgtactatgatcaggtccttgacaccactgacatgctcggcactgtccccgaacgctactcatgcactgtaggatacattgggtttgacacctacttctccatggccagaggctacgccactgtccctgctatggagatgaccaagtggtttgacaccgactaccactttatagtctcggacttgcgcgcaaacacctatgtctcctatgcttctcacagagctgttaacaaatatatcgaggctggacgcctcggtgttgataccgtgccagtactcgttgggaccagtctcgtacgtggttgactcaaagatgaccaaggtgtggagaggggattccctcttctttc

SEQ ID NO: 71479 - protein, 115 aa, Zea mays
  misc_feature: Ceres CLONE 1553171
  misc_feature (1)..(115): Pfam Name: Meth_synt_1 Pfam Description: Cobalamin-independent synthase, N-terminal domain
  misc_feature: SWISSPROT Homolog: EC 2.1.1.14 5-methyltetrahydropteroyltriglutamate--homocysteine S-methyltransferase
MDDAGIKHIPSATFSYYDQVLDTTDMLGTVPERYSCTVGYIGFDTYFSMARGYATVPAMEMTKWFDTDYHFIVSDLRANTYVSYASHRAVNKYIEAGRLGVDTVPVLVGTSLVRG

SEQ ID NO: 71480 - DNA, 838 bp, Zea mays
  misc_feature: Ceres CLONE 1553171-R
  misc_feature: SWISSPROT Homolog: EC 2.1.1.14 5-methyltetrahydropteroyltriglutamate--homocysteine S-methyltransferase
  misc_feature (672)..(672): n is a, c, t, g, unknown, or other
attgggtactcgagcgtctcgtttttttttttttttttacatcaagtacacgggcaacttgcctcagaaaccaccaaacagagagtagtaaaacaggtaccgcgtgggggcgagatcaagaaaactactaacctaaccacagacggagcacaacagaacggcgggcacaggggggagccctcagccctgtttattggaaacaaattggcatcgacgacgccctcctcggaaacgaaaaaggcaaaaaaaaaggtgctcacttggcgctggcgagctgggtgcggatgagcttagcagcggagaccatgttggtcagggcgggcttcacctccgtgtacttgcgggtcttgaggccgcagtcggggttcacccagaggatgttggtgtccagcaccgccagcatcttgtcgatgcggtcagcgatctcctcagccgacgggatcctgggggagtggatgtcgtagacaccggggccgatgcccgcgccatacttgacgccctcgcggaacacggagagcagcttctcgtcggaccgggagttctcgatggtgatcacgtccgcgtccatgtcgatgatcgagtggatgatgtcgttgaagttggagtagcacatgtgggtgtggatcctgggtggtgtccctggatctcgcagtttggtgattctgaaaggantggacagcccaatcccaagttaaaatgcatgctccagcccttgcggaacaggcagccccttcctctcagtgcaaccctccctcgaatttggaaaaacctggaataccaccaagccctcaagaaccctcgaactttccttccttgattcgcaagaagccgattctga

SEQ ID NO: 71481 - DNA, 683 bp, Zea mays
  misc_feature: Ceres CLONE 1553175
  misc_feature: Encodes the peptide sequence at SEQ ID NO. 71482
ctccccgcggtggcggccgctctagaactagtggatcccccgggctgcaggaattcgtctcacccctagaaaaactccggctccggccctcctcttcctcttcccccaattcccattcccaattcgccctcctcaaatccggcgccgcattcccgacattccgcagatctgggatccgccgccgacggatcccctgccgcccgcaacgacccgggacgcgcgtgatcccgccgcctagccgccaagttggcgcctcagcggaggtcgcagcgcctcgccggcggcggcgcgggctctgccgccgccgccgccgcgcagccgcccggagcctctagcgcgcacgccgcgacgggtgactcgggcgacgccgtcatggcgcgctggctgcagtccgcggggcttcagcacctcgcaacgtcctccgccgccggcgctggcggcgcggactaccgtggtgggatgcctgggtttgggggcgctggcgccggaagcatgctgtcgagcctgctcatgcagggctatgggccagaatcaattgaagaaaagcagaggctttatacgcttctgagaggtctaaattttagcggagagtctgtacccacatcaatctctgagccttacacaccaacagctcagagcttttggtggtgggaaccctgtagaggggttttattcgcctgact

SEQ ID NO: 71482 - protein, 102 aa, Zea mays
  misc_feature: Ceres CLONE 1553175
MARWLQSAGLQHLATSSAAGAGGADYRGGMPGFGGAGAGSMLSSLLMQGYGPESIEEKQRLYTLLRGLNFSGESVPTSISEPYTPTAQSFWWWEPCRGVLFA

SEQ ID NO: 71483 - DNA, 689 bp, Zea mays
  misc_feature: Ceres CLONE 1553182
  misc_feature: Encodes the peptide sequence at SEQ ID NO. 71484
  misc_feature (482)..(482): n is a, c, t, g, unknown, or other
  misc_feature (483)..(483): n is a, c, t, g, unknown, or other
ctccccgcggtggcggccgctctagaactagtggatcccccgggctgcaggaattcgtctcacccctagaaaaaaaaaaggtgccaccctccccaagccctcgcgccgcctccgagacagccgcccgcaaccatggccaccgccgccaccgcggccgccgcgctcaccggcgccactaccgctacgcccaagtcgaggcgccgagcccaccacttggccacccggcgcgccctcgccgcgcccatcaggtgctcagcgttgtcacgcgccacgccgacggctcccccggccactccgctacgtccgtggggccccaacgagccccgcaagggctccgacatcctcgtcgaggctctcgagcgctgtggcgtccgtgacgtcttcgcctaccccggcggcgcatccatggagatccaccaggcactcacccgctcccccgtcatcgccaaccacctcttccgcacgaacaaggggagggcttnncgcgctcggctacgcgcgctctcgggccgcggtggcgtctgcatcgccacctcggccccggcgccaccaactagtctctgcctcgcaaacgcttgctcgactccgtcccatggtcgcatccgggaaaggtgcccgaccctgaatggcccaacccctttgggcccccatcggcaagtccccgttcatcccaagcaaatacctgggcc

SEQ ID NO: 71484 - protein, 185 aa, Zea mays
  misc_feature: Ceres CLONE 1553182
  misc_feature (65)..(170): Pfam Name: TPP_enzyme_N Pfam Description: Thiamine pyrophosphate enzyme, N-terminal TPP binding domain
  misc_feature: SWISSPROT Homolog: EC 2.2.1.6 Acetolactate synthase
  misc_feature (117)..(117): Xaa is any aa, unknown, or other
MATAATAAAALTGATTATPKSRRRAHHLATRRALAAPIRCSALSRATPTAPPATPLRPWGPNEPRKGSDILVEALERCGVRDVFAYPGGASMEIHQALTRSPVIANHLFRTNKGRAXRARLRALSGRGGVCIATSAPAPPTSLCLANACSTPSHGRIRERCPTLNGPTPLGPHRQVPVHPKQIPG

SEQ ID NO: 71485 - DNA, 802 bp, Zea mays
  misc_feature: Ceres CLONE 1553183
  misc_feature: Encodes the peptide sequence at SEQ ID NO. 71486
  misc_feature (392)..(392): n is a, c, t, g, unknown, or other
ccgctggagctccccgcggtggcggccgctctagaatagtggatcccccgggctgcaggaattcgtctcacccctagaaaaaaaccgcgtgttcgttcggagcgcacacacacacaaccagatctcccccaaatccacccggcggcacctccgcttcaagatgcagatctttgtgaaaaccctgaccggcaagactatcaccctcgaggtggagtcgtctgacaccattgacaacgttaaggccaagatccaggacaaggagggcatccccccagaccagctgcggctcatcttcgctggcaaacagcttgaggaccggctcacgcttgctgactacaacatccagaaggagagctccctcccccccgtggtgggggggggggggaggcatncatatctttttcacccccccttttccgcaaaaactatcacccctccaggggggagttcctcctggacgccaattgaccaacggtccaaggcccaagattcctggacacaaggaggggcatcccctccaggacacagctaacggtcttcgacctttgtgctcgggaaagacacctttgaaggacggggcggccgaggcttgtcccgagttccaatcttccacgtaagggagaagtgtcctctcgcccgctgggaggccgccggccccaaggggaaagggcttgcgaaatccctcgtcgaagaaaacgtgatcgcggcgaaatgtagtgctctctcagggagggggagacgtcgctgacagccctccagcgcgcgttgggaagtccgatactctcgtgactatgttctttct

SEQ ID NO: 71486 - protein, 123 aa, Zea mays
  misc_feature: Ceres CLONE 1553183
  misc_feature (6)..(74): Pfam Name: ubiquitin Pfam Description: Ubiquitin family
  misc_feature (78)..(78): Xaa is any aa, unknown, or other
MQIFVKTLTGKTITLEVESSDTIDNVKAKIQDKEGIPPDQLRLIFAGKQLEDRLTLADYNIQKESSLPPVVGGGGRHXYLFHPPFSAKTITPPGGSSSWTPIDQRSKAQDSWTQGGASPPGHS

SEQ ID NO: 71487 - DNA, 713 bp, Zea mays
  misc_feature: Ceres CLONE 1553188
  misc_feature: Encodes the peptide sequence at SEQ ID NO. 71488
  misc_feature (515)..(515): n is a, c, t, g, unknown, or other
  misc_feature (516)..(516): n is a, c, t, g, unknown, or other
  misc_feature (631)..(631): n is a, c, t, g, unknown, or other
ctccccgcggtggcggccgctctagaactagtggatcccccgggctgcaggaattcgtctcacccctagaaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctaccggcggcacgtgcggctgccgaggatcagctgcagcgccaccgaggaggtcagcggcgccgtgtcgtccgtcaccgtggagaggatgctcacggtgacggcgtcnngtggaggcgtcgccggccatcgggcagatgtacttccagcgcgccgtcgacgacatcggcgacctcctcggcaagacgctgctgctcgagctcgtcagctccgagctcgacgcanagtcgggcgtggagaagacgcggggtgacggcgtacgcgcacaagacgctgcgggagggccactacgaggcggagttcaggg

SEQ ID NO: 71488 - protein, 130 aa, Zea mays
  misc_feature: Ceres CLONE 1553188
  misc_feature: SWISSPROT Homolog: EC 1.13.11.12 Lipoxygenase
  misc_feature (84)..(84): Xaa is any aa, unknown, or other
  misc_feature (122)..(122): Xaa is any aa, unknown, or other
MMNLNLKQPLVLPAHHSNVVGSRLSSSSPSAAAASRRTGGGVSSRSGYRRHVRLPRISCSATEEVSGAVSSVTVERMLTVTASXGGVAGHRADVLPARRRRHRRPPRQDAAARARQLRARRXVGRGEDAG

SEQ ID NO: 71489 - DNA, 696 bp, Zea mays
  misc_feature: Ceres CLONE 1553194
  misc_feature: Encodes the peptide sequence at SEQ ID NO. 71490
  misc_feature (684)..(684): n is a, c, t, g, unknown, or other
tggagctccccgcggtggcggccgctctagaactagtggatcccccgggctgcaggaattcgtctcacccctagaaaaaactttctccatagaaaccccatgaaaaagcgttctgggggcccccgcgtcgcctccgcctgggcgacacgggcggcgccccgctccccttgccgccgtcgcccgcaaatcctctctccctttcccttgccgccgccggaggggtctgccggaggccggctcggcccctaggatggcgacggcggggtgtttcgcgcggatctggtgggagttagcgcagctcatcggcggtggagcgcgcgcagcacggtacctatgggtggccgtggccgtgctggggcgcgccgtggcacgcgccgcggagctcgccgggcggcggctgaggcccaggcggccaggcgtggcggggcgtcgccgtgaggacgtcgtggcctgcctccgcgcctcgctcgaggatctgctccggtcgccgctgtcgtgcgctgtcggtgggggcttgggcgacgccgagctgtgcttctgcgaggcggaggccgtcgacgtgtgcgtcagcgggcagatctgtgcgggggtcggcgcacggcggcatgggcgactcagcgtagccggtgcgctggctgcggcgaggagaccactaggtggtgtgactgcggtggagctctggcngtgcggtcgcag

SEQ ID NO: 71490 - protein, 148 aa, Zea mays
  misc_feature: Ceres CLONE 1553194
  misc_feature (145)..(145): Xaa is any aa, unknown, or other
MATAGCFARIWWELAQLIGGGARAARYLWVAVAVLGRAVARAAELAGRRLRPRRPGVAGRRREDVVACLRASLEDLLRSPLSCAVGGGLGDAELCFCEAEAVDVCVSGQICAGVGARRHGRLSVAGALAAARRPLGGVTAVELWXCGR

SEQ ID NO: 71491 - DNA, 711 bp, Zea mays
  misc_feature: Ceres CLONE 1553195
  misc_feature: Encodes the peptide sequence at SEQ ID NO. 71492
  misc_feature (513)..(513): n is a, c, t, g, unknown, or other
  misc_feature (598)..(598): n is a, c, t, g, unknown, or other
  misc_feature (649)..(649): n is a, c, t, g, unknown, or other
ggagctccccgcggtggcggccgctctagaactagtggatcccccgggctgcaggaattcgtctcacccctagaaaaaaaccttcgcctctcctcccgttgtcagccgccgtgcctgttctctctgcctttctaaaagtgcggcgactggttgggctgccgccgactgccggggccttcgccgacctcttcgccggcgaagaggtcccatcaggagaaggagtagatcgtcgacccagaaccctcgctgatggcgactttcgcgaaacctgagaacgcgctgaagagagccgaagaattaatccatgttggtcaaaagcagtcagccctgcaggctttacatgatctcattacctcgaaaaggtacaggtcatggcagaagcctctcgaaaagatcatgatgaagtatgtagaactctgtgttgacctgagggaaggcagatttgcaaaagatggtcttattcagtataggattgtctgcccagcagtaaacgtgtcatccttgggagatgtncataagcacttcatgcagctttcaaatgagaaagctgaacaagctaagagtcaggtcgaagccctggaagatgctctggatgtcnaaaatcttgaagcaaacaagcgtccccaggacttatgctcaatttttttcntggggaaaaaggaaaggccccatccaaaaaaaggggtgaacccccggggttaaggtcccccg

SEQ ID NO: 71492 - protein, 150 aa, Zea mays
  misc_feature: Ceres CLONE 1553195
  misc_feature (117)..(117): Xaa is any aa, unknown, or other
  misc_feature (134)..(134): Xaa is any aa, unknown, or other
MATFAKPENALKRAEELIHVGQKQSALQALHDLITSKRYRSWQKPLEKIMMKYVELCVDLREGRFAKDGLIQYRIVCPAVNVSSLGDVHKHFMQLSNEKAEQAKSQVEALEDALDVXNLEANKRPQDLCSIFFXGKKERPHPKKGVNPRG

SEQ ID NO: 71493 - DNA, 756 bp, Zea mays
  misc_feature: Ceres CLONE 1553197
  misc_feature: Encodes the peptide sequence at SEQ ID NO. 71494
tccccgcggtggcggccgctctagaactagtggatcccccgggctgcaggaattcgtctcacccctagaaaagtaagaaccactttcacctgaactcctgaagcaatggccatgagagctctcccgctgaccccttccaggagctcctcgtttggagctcaccaaaccaggccgagcggcggcggccccagatcagtgagagcttatgcgaagggagacgaggagggcgacaagcagtccctgttcggaagcatcaccgaggcgctggacttctcgcaggtccggtcggagaaggacgccgagctgctgtacgaggccagggagtccaccaaaggtggagggaggatgaccacggacccgtacggaggggcggaggcggaagatttggtggcacctatccacccatttcttcaggtacaatgttggaagtccaccgggcaatacctgggagggagggtttgggtccaacaagaccctggcaagttctgccaaaaaggacccaagggggggagccctaggctatgtttgccaagcctaggaaggaaacgcttcccggttgccgtggcctgggaaaaacccccaaaccaatcgaatcttttttcgcaaaaatgcttcgcctgaatggaaatatgctggcccccgccgaaaaggggtggccccgcccgcctccggggcgtggggaagcatataatatgagggggggggtgggagggggctcgccaagtgggcgcagattgtttccccatttttccctat

SEQ ID NO: 71494 - protein, 171 aa, Zea mays
  misc_feature: Ceres CLONE 1553197
MAMRALPLTPSRSSSFGAHQTRPSGGGPRSVRAYAKGDEEGDKQSLFGSITEALDFSQVRSEKDAELLYEARESTKGGGRMTTDPYGGAEAEDLVAPIHPFLQVQCWKSTGQYLGGRVWVQQDPGKFCQKGPKGGSPRLCLPSLGRKRFPVAVAWEKPPNQSNLFSQKCFA

SEQ ID NO: 71495 - DNA, 611 bp, Zea mays
  misc_feature: Ceres CLONE 1553201
  misc_feature: Encodes the peptide sequence at SEQ ID NO. 71496
agtggatcccccgggctgcaggaattcgtctcacccctagaaaaaattgcctcccccaccaaccaagtttggatatgaaaatatagtatcgcccgcgctctggagagtctggatcctcctgaacctccaggcagcaagcgatgaaaggagggacgcaagcagttagcctgatggtgcaccttgctgtgccatggctctgccttgctacttgggcagctctgctaccaccgctaacatctggaaatgtgggtgcatcagctccgatactgagagcagattacataaaattgaacttcagcaccgcttcgacgacccccgacaagtacaagagcttcatcgcttctgttcgtgctggcttggtgagcaaagcggggaccaacagcagcgggatccccgtgctggtcgacaaagaccacccgctcgcgctcgaatcgtttctaaacatcactctggtgaacaaggtagggcgctccgtaagcttgaagatggatgtatcccgaggctacttcgtggcttacatagcaggacaccgctcgtgcctcctcaagagatcatgccgcactttctcgtcagcgatctgttactacagtgggccgtgcggaaaaagttcg

SEQ ID NO: 71496 - protein, 157 aa, Zea mays
  misc_feature: Ceres CLONE 1553201
  misc_feature: SWISSPROT Homolog: EC 3.2.2.22 rRNA N-glycosylase
MKGGTQAVSLMVHLAVPWLCLATWAALLPPLTSGNVGASAPILRADYIKLNFSTASTTPDKYKSFIASVRAGLVSKAGTNSSGIPVLVDKDHPLALESFLNITLVNKVGRSVSLKMDVSRGYFVAYIAGHRSCLLKRSCRTFSSAICYYSGPCGKSS

SEQ ID NO: 71497 - DNA, 677 bp, Zea mays
  misc_feature: Ceres CLONE 1553203
  misc_feature: Encodes the peptide sequence at SEQ ID NO. 71498
tacccgcggtggcggccgctctagaactagtggatcccccgggctgcaggaattcgtctcacccctagaaaaaaaatttctgcattcaaatgagcccttagtataaatttatatatatatatatttgtttaacagcatcagcatgcatccagttgcagcggcgttcacgtgtccatcagaaacagtatattaacccgagatgccgctgtccctcggggcttgcgccgtctgcagcgtgacatgggccatgcatgcatgcggctgctcttctcctacaaaacctgcatgcttacttgtcgcatcaacttttactgtacattttgactgcgcgtcttgggctgatgcgattgtctgcttcccttctgagttctgacctagctacactacacagcaatgcaagcgcatgcgtgaatgatagagtatgatatcttatccgtcgatgcgttggtccatgcaggagggacagcttcatcacacaccgggcgttctgcgatgcgctcgcgcaggaaagcgcgcggctgccgccgacgagcctcagcagcctcaccagccacctctacggcgcccccagcacggggcacatggcgctcagcctctcgcaggtgggttcccacctcaaccttcactcttcaggaagggccaccaccaccacccgtccgcgggagctcctcccaatc

SEQ ID NO: 71498 - protein, 32 aa, Zea mays
  misc_feature: Ceres CLONE 1553203
MALSLSQVGSHLNLHSSGRATTTTRPRELLPI

SEQ ID NO: 71499 - DNA, 749 bp, Zea mays
  misc_feature: Ceres CLONE 1553204
  misc_feature: Encodes the peptide sequence at SEQ ID NO. 71500
  misc_feature (749)..(749): n is a, c, t, g, unknown, or other
tggagctccccgcggtggcggccgctctagaactagtggatcccccgggctgcaggaattcgtctcacccctagaaaaagtattcctccatcctcccctggactggatcgcatcggagatcctgccggacctgcggtggtcccttccttttctcccataatgagctcgccagcgtataggtgattcatcaggctggtatccaatacctagtccatgctgcctgcatgagcagtatagatgctactggtcgtgcaacgaggatggttcttctcttcttctactaaagctacatgcatagtctcgccctcttgctgctcgtacgcaaagatcaggagaagcccggaaaagtctctccgtggaaccactaccgggtggtggactgggagacctacgcagtgttccacccccccctccgccaaggaccaggctcctgggtaaatgcgctccctctgtctgctttggatgcagggctaattggcttcaagtcgggccttcctccaaagcgacctcccagaatgcgcttggttccggtccatcaaactaagaaaccctcttcttacccaaacaagagagttaaccaccaagggttaccatatctggtgcaacctattgacaatggtgtttctaaaaagaccttccaaataagggattatttgcggacccaccccacaactgtgtgggaggaaagtcctaaaaaaccccgcggtacccttttgggaaaagagtcaaaacacccctgtatactttgn

SEQ ID NO: 71500 - protein, 152 aa, Zea mays
  misc_feature: Ceres CLONE 1553204
MHSLALLLLVRKDQEKPGKVSPWNHYRVVDWETYAVFHPPLRQGPGSWVNALPLSALDAGLIGFKSGLPPKRPPRMRLVPVHQTKKPSSYPNKRVNHQGLPYLVQPIDNGVSKKTFQIRDYLRTHPTTVWEESPKKPRGTLLGKESKHPCIL

SEQ ID NO: 71501 - DNA, 716 bp, Zea mays
  misc_feature: Ceres CLONE 1553208
  misc_feature: Translation starting site: 291
  misc_feature: SWISSPROT Homolog: EC 2.7.9.1 Pyruvate, phosphate dikinase
  misc_feature (716)..(716): n is a, c, t, g, unknown, or other
agctggaggtccgccgcagcggcgtccttactagaacttgtggatcccccgggctgcaggaattcgtctcacccctagaaaaagttcgcctctcaccttttcgctgtactcactcgccacacacaccccctctccagctccgttggagctccggacagcagcaggcgcggggcggtcacgtagtaagcagctctcggctccctctccccttgctccatatgatcgtgcaacccatcgagctacgcgcgtggactgccttccctgggtcggcgcaggaggggatcggaaggatgacggcatcggtttccagggccatctgcgtacagaagccgggctcaaaatgcaccagggacagggaagcgacctccttcgcccgccgatcggtcgcagcgccgaggcccccgcacgccaaagccgccggcgtcatccgctccgactccggcgcgggacggggccagcattgctcgccgctgagggccgtcgttgacgccgcgccgatacagacgaccaaaagagggtgttccacttcggcaagggcaagagcgagggcaacaagaccatgaaggaactgctgggcggcaagggcgcgaacctggcggagatggcgagcatcgggctgtcggtgccccccagggtcacggtgtcgaccggagcgtgccagcagtacaggaacgcgggttgcgcctccccgcggggctctggggcgagatcgtcan

SEQ ID NO: 71502 - DNA, 650 bp, Zea mays
  misc_feature: Ceres CLONE 1553214
  misc_feature: Encodes the peptide sequence at SEQ ID NO. 71503
  misc_feature (587)..(587): n is a, c, t, g, unknown, or other
  misc_feature (618)..(618): n is a, c, t, g, unknown, or other
ctccccgcggtggcggccgctctagaactagtggatcccccgggctgcaggaattcgtctcacccctagaaaaagtcctccacctccctctccgccgcgtcgctcgcgcttgacgcgcgccgagagccgaatcggagccacgaggcagccgccccgggcggatcgatcctagggccagggcatgggcggaggggacgccgacgccggcggcgagcccgcggacgcgcaggccacgctccacatccggtgcaccaacgcctccaagttcaccgtgcgggccgacctgggcgccaccgtcggggcgtttaaggcgatcgtcgccgacagctgcgacgtgccggcgccgcagcagcggctgatctacaagggccggatcttgaaggacgagcaaaccctagccagctacggtgtggagacagaccatacaatccacatggtacgtggtgctgtgccatcaccaacatctactgcacctgcagccaaccaagaacctaccactgctgctcctgccagttccccggcaacaggattggggtggtttgttgcaaagtctgggtactacaggcgctgctgctacagtgaggggntgggtttgggtttggatctgccccccctggnatagaccaaatgcaacaacagctagctgaaaa

SEQ ID NO: 71503 - protein, 145 aa, Zea mays
  misc_feature: Ceres CLONE 1553214
  misc_feature (22)..(90): Pfam Name: ubiquitin Pfam Description: Ubiquitin family
  misc_feature (136)..(136): Xaa is any aa, unknown, or other
MGGGDADAGGEPADAQATLHIRCTNASKFTVRADLGATVGAFKAIVADSCDVPAPQQRLIYKGRILKDEQTLASYGVETDHTIHMVRGAVPSPTSTAPAANQEPTTAAPASSPATGLGWFVAKSGYYRRCCYSEGXGLGLDLPPL

SEQ ID NO: 71504 - DNA, 665 bp, Zea mays
  misc_feature: Ceres CLONE 1553218
  misc_feature: Encodes the peptide sequence at SEQ ID NO. 71505
  misc_feature (388)..(388): n is a, c, t, g, unknown, or other
  misc_feature (391)..(391): n is a, c, t, g, unknown, or other
aagctggagctccccgcggtggcggccgctctagaactagtggatcccccgggctgcaggaattcgtctcacccctagaaaaaaaaacaacgccaagcgcgcctcccgtgaacccagcggcccgtcaagtcaaagcatggacgtgccgctcccgctgctgctcggctccgtggccgtttccctcgtcgtgtggtgccttctgctccgccgcggcggggccgggaaggggaagcggccgctgccgcccggtccccggggctggccggtgctgggcaacctgccgcaggtcggcgccaagccgcaccacaccatgtgtgctctggcgcgggagtacggcccgctgttccggctccggttcggcagcgccgaagtggtggtggccgcgtcngcncgggtggcgggccagttcctgcgcgcccacgacgcccacttcagcaaccgcccgccaaactccgggggcgaacacgtggcgtacaactaccagaacctggggttcgccccgacgggttccgggggggccgccctaccggaacttgtgcccgctccacctctttccccgcaagggccctggacgacctgcccgggtttaggaaggggcaaagtggccccccatgggaggggaacccccccggaggggaaaagaaaaaagggccccctggggcctg

SEQ ID NO: 71505 - protein, 176 aa, Zea mays
  misc_feature: Ceres CLONE 1553218
  misc_feature: SWISSPROT Homolog: EC 1.14.13.21 Flavonoid 3'-monooxygenase
MDVPLPLLLGSVAVSLVVWCLLLRRGGAGKGKRPLPPGPRGWPVLGNLPQVGAKPHHTMCALAREYGPLFRLRFGSAEVVVAASARVAGQFLRAHDAHFSNRPPNSGGEHVAYNYQNLGFAPTGSGGAALPELVPAPPLSPQGPWTTCPGLGRGKVAPHGRGTPPEGKRKKGPLGP

SEQ ID NO: 71506 - DNA, 658 bp, Zea mays
  misc_feature: Ceres CLONE 1553220
  misc_feature: Encodes the peptide sequence at SEQ ID NO. 71507
  misc_feature (483)..(483): n is a, c, t, g, unknown, or other
  misc_feature (531)..(531): n is a, c, t, g, unknown, or other
  misc_feature (534)..(534): n is a, c, t, g, unknown, or other
ccgcggtggcggccgctctagaactagtggatcccccgggctgcaggaattcgtctcacccctagaaaaaacgaccgcttggcgcttcatcactcgttccctttcgaaagcccgcgcacgcacgtcggtcgtcccgagcaggacctcgatcggccgagatggcgacgccgaacgggcttgcgcggatcgagacgaccgggaagaagaagcaggacaacggcgtgtggtacgacgacagctcggcgccggtgcgcgcgcagaccatcgacgagctgcactcgctgcagcggaagcggtcggcgcccagcacgcccaagcggtcggcgcccaccacgcccatcaagggcggtgcccactcgcccttcgccgtcgcgatctccgaggaggagcgccacacgcagcagatgcagtccatcagtgcgtcgttggcgtctctgacgcgtgaaaccgggccgaaagtggtcaagggcgacccggccgcgnagggcgaggccgccgcgcagggcgcgccatcgacgccgagggcgcacnagnaggaccggcacccccggcgcccccggcattggcggtcagggaacagctccctcaggttcactcctgtgctcaacaacctcttcgcttgttgaactgtacaagcagggcattcagtccaagaagg

SEQ ID NO: 71507 - protein, 155 aa, Zea mays
  misc_feature: Ceres CLONE 1553220
  misc_feature: SWISSPROT Homolog: EC 4.1.1.49 Phosphoenolpyruvate carboxykinase (ATP)
  misc_feature (109)..(109): Xaa is any aa, unknown, or other
  misc_feature (125)..(125): Xaa is any aa, unknown, or other
  misc_feature (126)..(126): Xaa is any aa, unknown, or other
MATPNGLARIETTGKKKQDNGVWYDDSSAPVRAQTIDELHSLQRKRSAPSTPKRSAPTTPIKGGAHSPFAVAISEEERHTQQMQSISASLASLTRETGPKVVKGDPAAXGEAAAQGAPSTPRAHXXDRHPRRPRHWRSGNSSLRFTPVLNNLFAC

SEQ ID NO: 71508 - DNA, 658 bp, Zea mays
  misc_feature: Ceres CLONE 1553221
  misc_feature: Encodes the peptide sequence at SEQ ID NO. 71509
  misc_feature (520)..(520): n is a, c, t, g, unknown, or other
  misc_feature (601)..(601): n is a, c, t, g, unknown, or other
ctccccgcggtggcggccgctctagaactagtggatcccccgggctgcaggaattcgtctcacccctagaaaaaaactctgcccaaaaatttgaaatccttttcgcttccatcttcaccgcccccgagcaccctagatggcggatccaccgcctgtgctcacgctcctggtgaagaagggaccctgcgaggggaagaccgtgcagcgccgcgccggcgccacggcgctccgtgtcggccgcgttgccaagggcaacgacctctccgtgggcgacgctggcgcgtcgcagaggcatctctccgtcaagttcctcccaccgcctgcggcccggtggtccgtcaccgatttatgctcctccaacggcaccctcctcaacggtacgcctctcgtggccactatccccgccccgctctctgacggggacctcatcaagatcggggaggccaccgtgctcgccgtctccatatcgaccgaggcaggcccggtaccgggcgccgccgcgactaggcgttccgcgcgncacgcagcagccgtggcgacggcgggcgaggaacaggtgggccgtgtttctcccaggggtcgaccgaagaaggccgtttcngcttgagccccccaagcctgggaatgaagtgagagaggaagctgccctccccactcc

SEQ ID NO: 71509 - protein, 156 aa, Zea mays
  misc_feature: Ceres CLONE 1553221
  misc_feature (31)..(101): Pfam Name: FHA Pfam Description: FHA domain
MADPPPVLTLLVKKGPCEGKTVQRRAGATALRVGRVAKGNDLSVGDAGASQRHLSVKFLPPPAARWSVTDLCSSNGTLLNGTPLVATIPAPLSDGDLIKIGEATVLAVSISTEAGPVPGAAATRRSARHAAAVATAGEEQVGRVSPRGRPKKAVSA

SEQ ID NO: 71510 - DNA, 680 bp, Zea mays
  misc_feature: Ceres CLONE 1553222
  misc_feature (662)..(662): n is a, c, t, g, unknown, or other
ctcaccgcggtggcggccgctctagaactagtggatcccccgggctgcaggaattcgtctcacccctagaaaaaaaaaaaccgccggtggaaaaactttggaggcgcccaacttccaagatacccactagctcccagcctcctaccttgccctttccacccttcgctgatgctagctaggatgatgggatttttcgagctctaagacaagtactactgatccttgcgcttcacacgccctcttgctccctgcgtgttcttgattcggcctcaaaatttgttgcctgttttctcgtggtgacgaactatcttccctacttgttagttgttaggggatgggacgtttttttatttctccttgaaatttatatgcatgctaatttgtttgattctttttgcagtttgaggtgatatctcggttctaaaaatctgccagatttcttctccccgtttgtatggacaaatttgggaacgaaccctagtctgtgtgtgaagcagccaaagtggtgttcttgcggagcaaagcaaagctaaagctgcagcagttggtgaggatacatgagatacagaagggcttgttagattctgtaaagacactcttattagctgatacttttttcccatcactgggggccggttttttcggaagtacgcccatctggnattaaagcctctccattt

SEQ ID NO: 71511 - DNA, 560 bp, Zea mays
  misc_feature: Ceres CLONE 1553225
  misc_feature (438)..(438): n is a, c, t, g, unknown, or other
  misc_feature (439)..(439): n is a, c, t, g, unknown, or other
  misc_feature (463)..(463): n is a, c, t, g, unknown, or other
  misc_feature (464)..(464): n is a, c, t, g, unknown, or other
ggagctccccgcggtggcggccgctctagaactagtggatcccccgggctgcaggaattcgtctcacccctagaaaaacatcagagaggacgacgccccggccgtggccacggatggttcccgcctcgcatcgtacctggcggcctcctcgcacgagcccaagccgctgcgggcccgcgcgccacagccggcgcccctctcctcggtggctggccggagcccagcgcgcgaccacgcgcaccaccaccacacctccgactcctccgacaccgcctccccgagctccaccggcggcggcggcggcgccgtcgtcggcgacgtgctgctgcagtgggggcacaagaagcggtcgagctgccggcgcgactccgccaaccgccgcggcggcgtccgcgcagcgccgacagtctgcggtcggtggcgggttcaagatccaannggggcggttctgggccggggcccnncggaaaaacctaatggccgccgccgccagccgccccaagggggaatcaaaatggggggggggggggccccctttcccgtgtccggggccttccgcc

SEQ ID NO: 71512 - DNA, 687 bp, Zea mays
  misc_feature: Ceres CLONE 1553226
  misc_feature: Encodes the peptide sequence at SEQ ID NO. 71513
  misc_feature (526)..(526): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (542)..(542): n is a, c, t, g, unknown, or other
  misc_feature (545)..(545): n is a, c, t, g, unknown, or other
  misc_feature (546)..(546): n is a, c, t, g, unknown, or other
  misc_feature (548)..(548): n is a, c, t, g, unknown, or other
tggagctccccgcggtggcggccgctctagaactagtggatcccccgggctgcaggaattcgtctcacccctagaaaaagcgagcgagaggcgcgctgttgcggaaatgccgctcccggcgttcctggcggcggcggcgaggctcgccgtcctgctggccgccgccgtgactgcggccaacgcggtctccttcgcgcgctaccggcgccgccacctccgccgcatccccaaccccatcgacgagtccgccgaccccgtcgccgacttccgcgccctccgccccgcctcggccgaggacgccgcagaagatgacagcttcttctttgggctagcgaccgcgccggcacatgtggaggacaggttggaagacgcttgtcttcagtttgcggtggagcactcctgcgacgacaaggaggccatgcgcgaccctacgacagcagatgcggtgatggcgtccgctgcaggggacggaggtgctcagttggcttctcgtaggtcgtccagaggggatgatgataggaggggntttgnnnnnntttttnaannanccctcttaataatcgccctggaggcgatgcctcagggggttttgaaatgttttgctgagggtggtggagtcaaggttctggctgctgctgctgggtgacaagttgccagcccacaacgtttgcggctttggccacaatg

SEQ ID NO: 71513 - protein, 179 aa, Zea mays
  misc_feature: Ceres CLONE 1553226
  misc_feature (142)..(142): Xaa is any aa, unknown, or other
  misc_feature (143)..(143): Xaa is any aa, unknown, or other
  misc_feature (144)..(144): Xaa is any aa, unknown, or other
  misc_feature (146)..(146): Xaa is any aa, unknown, or other
  misc_feature (147)..(147): Xaa is any aa, unknown, or other
  misc_feature (148)..(148): Xaa is any aa, unknown, or other
MPLPAFLAAAARLAVLLAAAVTAANAVSFARYRRRHLRRIPNPIDESADPVADFRALRPASAEDAAEDDSFFFGLATAPAHVEDRLEDACLQFAVEHSCDDKEAMRDPTTADAVMASAAGDGGAQLASRRSSRGDDDRRGFXXXFXXXLLIIALEAMPQGVLKCFAEGGGVKVLAAAAG

SEQ ID NO: 71514 - DNA, 669 bp, Zea mays
  misc_feature: Ceres CLONE 1553228
  misc_feature: Encodes the peptide sequence at SEQ ID NO. 71515
  misc_feature (659)..(659): n is a, c, t, g, unknown, or other
aaagctggagctccccgcggtggcggccgctctagaactagtggatcccccgggctgcaggaattcgtctcacccctagaaaaagagattgagagcaaaagggaaataaaggagctctcgcaggcactcggtactgacatgagtgatctcatgctcttgataccttggtactcttacatcaccccttcttcttcaccttcttcttgttcttgctcatccctcctctccggccctctcttcctcctgcctctctctagctaggacgatcttcaacaaccctctccccctctaattctctttccccatatagagagaataaaggagagagagagagaggcgaaggcaggcagctaattttcttttgttcaagggaaaggacagcacgtgccggagcgagctcataagctggtagctgcatcagttcctgaggcaaaaccacctgtttacgatcttgcagtcatcatcacgctattagttgaggataatttcgcgcacaagagcacgacaagccgagatttttgggggcgtcggcttcgacctgtaggcgatggcggcgtactaccacggtggcgccggcacggacatccaggccagcaccgacggcctgcagacgctgtacctcatgaacccgagctacgccggcggctacgctgacgacngcggcgcgtc

SEQ ID NO: 71515 - protein, 40 aa, Zea mays
  misc_feature: Ceres CLONE 1553228
  misc_feature (38)..(38): Xaa is any aa, unknown, or other
MAAYYHGGAGTDIQASTDGLQTLYLMNPSYAGGYADDXGA

SEQ ID NO: 71516 - DNA, 596 bp, Zea mays
  misc_feature: Ceres CLONE 1553232
  misc_feature: Encodes the peptide sequence at SEQ ID NO. 71517
  misc_feature (371)..(371): n is a, c, t, g, unknown, or other
  misc_feature (372)..(372): n is a, c, t, g, unknown, or other
  misc_feature (373)..(373): n is a, c, t, g, unknown, or other
  misc_feature (394)..(394): n is a, c, t, g, unknown, or other
  misc_feature (433)..(433): n is a, c, t, g, unknown, or other
tccccgcggtggcggccgctctagaactagtggatcccccgggctgcaggaattcgtctcacccctagaaaaaactggaggagcaccaagagttatctccggctcgaacccgagccaggtcctgactcctgatccgcaccgcacacggcaagggggcatcgccgacgggccgtcagcggcgagacccaagccaacacagcccagcgatgtcggcgcgtgaccgcgagacggccgaggcgctggtgcgcctcgccgcctcgctggacggggcggtgctcggcctcggcacggctgccgtcgccgtcgcgtcgtgggtcaagtacctcgccgtctcggggcagctacgcctcgtcgcctccgcggcgacggcnnntcatcgcgaacgccgctcccntctctcaggggacggcgccgagccggcgatcgccgcggntgcggggctacgtgcggggccctgaacaagttcttccgggccccggttctcaggcgaggcgggggcgtcgttaccaaacaaaccccagaatgggttggttccacaaaatgggaaagggcttctttggaaagggaccttttgaatcggcaggccccttcttttt

SEQ ID NO: 71517 - protein, 83 aa, Zea mays
  misc_feature: Ceres CLONE 1553232
  misc_feature (56)..(56): Xaa is any aa, unknown, or other
  misc_feature (63)..(63): Xaa is any aa, unknown, or other
  misc_feature (76)..(76): Xaa is any aa, unknown, or other
MSARDRETAEALVRLAASLDGAVLGLGTAAVAVASWVKYLAVSGQLRLVASAATAXHRERRSXLSGDGAEPAIAAXAGLRAGP

SEQ ID NO: 71518 - DNA, 574 bp, Zea mays
  misc_feature: Ceres CLONE 1553236
  misc_feature: Encodes the peptide sequence at SEQ ID NO. 71519
  misc_feature (403)..(403): n is a, c, t, g, unknown, or other
  misc_feature (433)..(433): n is a, c, t, g, unknown, or other
tggagctccccgcggtggcggccgctctagaactagtggatcccccgggctgcaggaattcgtctcacccctagaaaaaatccccccctctccacactgccaactcgctccgaagagggaggaggacgacgccggttgccactgccactgccgcgccgcgccgctcccgtctcccctccctccgcgggaactcgacgccaccatgctgtccacgcgcaccgccgccgtcgccgcctccgcgtcccccgcctccccgtggaagctgggaggacggagcgagggcggcgccagctgcgacggatgccggacctacaggaacaccctgcggaggagggccgcgcccgccaaggtgcgcgcttgccgccaggcggtggacgcggtcgcgatggtctcccaacgcganaccgagaacgagaagagcaggaggagcggngccgcagcgagaactgccgtcatgccctgggcaacttcgtcgcaggcggtacaccctttgagggatccccccccaacaaggggcttggtttccccaaaggaggaaagggggtgggcccctcccttggtgggaactggtccc

SEQ ID NO: 71519 - protein, 124 aa, Zea mays
  misc_feature: Ceres CLONE 1553236
  misc_feature: SWISSPROT Homolog: EC 1.1.1.40 Malate dehydrogenase (oxaloacetate-decarboxylating) (NADP(+))
  misc_feature (67)..(67): Xaa is any aa, unknown, or other
MLSTRTAAVAASASPASPWKLGGRSEGGASCDGCRTYRNTLRRRAAPAKVRACRQAVDAVAMVSQRXTENEKSRRSGAAARTAVMPWATSSQAVHPLRDPPPTRGLVSPKEERGWAPPLVGTGP

SEQ ID NO: 71520 - DNA, 662 bp, Zea mays
  misc_feature: Ceres CLONE 1553237
  misc_feature: Encodes the peptide sequence at SEQ ID NO. 71521
  misc_feature (601)..(601): n is a, c, t, g, unknown, or other
ctccccgcggtggcggccgctctagaactagtggatcccccgggctgcaggaattcgtctcacccctagaaaaagccgtctcggaccaacccgagcgccgaaccccaaggctcgcgaccgcgacactcttgtgtcctcctgctctccagatctcgccgtcggcggcggcatgctcccctccaccgtcggcggccgcggccgctacctcatgctcggcatcgcccttgccctcgctgccctgctcgcgctcgcctccgcttccgagtccgaccacaagtacaaaactgaagagccagttaagctttgggtgaataaagttggcccttacaacaatcctcaagaaacttacaactactacagccttccattttgtcaaccgtctgagaaccctacacataaatggggtggtcttggagaggtcctgggtggaaatgagctgattgatagtcagcttgaaataaagttcttaaaaaacgtggagaagggcttcatttgtacacttgagctagatgctaaaaaggtccagcagtttgctgatgccattgaaagctcatattggtttgaattttttatagacgatctgcctctttgggggttttgnttggggagactgacaagaacagtgaaaacaagcattatctttacacgcacaagaacatcct

SEQ ID NO: 71521 - protein, 164 aa, Zea mays
  misc_feature: Ceres CLONE 1553237
  misc_feature (144)..(144): Xaa is any aa, unknown, or other
MLPSTVGGRGRYLMLGIALALAALLALASASESDHKYKTEEPVKLWVNKVGPYNNPQETYNYYSLPFCQPSENPTHKWGGLGEVLGGNELIDSQLEIKFLKNVEKGFICTLELDAKKVQQFADAIESSYWFEFFIDDLPLWGFXLGRLTRTVKTSIIFTRTRTS

SEQ ID NO: 71522 - DNA, 689 bp, Zea mays
  misc_feature: Ceres CLONE 1553239
  misc_feature: SWISSPROT Homolog: EC 2.4.1.13 Sucrose synthase
aagctggagctccccgcggtggcggccgctctagaactagtggatcccccgggctgcaggaattcgtctcacccctagaaaaagacaaggagagcatgtaccccttgctcaacttccttcgcgcccacaactacaaggggatgaccatgatgttgaacgacagaatccgcagtctcagtgctctgcaaggtgcgctgaggaaggctgaggagcacctgtccaccctacaagctgataccccatactctgaatttcaccacaggttccaggaacttggtctggagaagggttggggtgattgcgctaagcgtgcacaggagactaaccacctcctcttggacctcctggaggccccagatccgtcccaccctggagaagttccttggaacgatcccccatgtggtccaccgcccttatccctctcccctcatgggtacttcgctcaagcttatgtcttggggttaccctgacaccggaaggcaggttgtctacatcttgggacaagggcgcccatggaagaacaaaatgctgctgaagataaaaaatgggggtcttgactccccccgaaaatcccttttggccacaggttgctcccctgaagaaatggggccccccctggggccagcccctttgaaaaggccttgggccccaaaaacgggctattcctttccgggggccttttaaaaaaa

SEQ ID NO: 71523 - DNA, 672 bp, Zea mays
  misc_feature: Ceres CLONE 1553242
  misc_feature: Encodes the peptide sequence at SEQ ID NO. 71524
ctggagctccccgcggtggcggccgctctagaactagtggatcccccgggctgcaggaattcgtctcacccctagaaaaagaactcctctctccgcccccctcgctagcctcgcggagccgccgcacccagcgaccctcccgaagtctaaccctagatccggaccggccatggcgtcccgccgggtcgtctcctcgctccttcgctccgcctcccgcctccgtgccgcctcgcccgccgcgccgcgcccgcgcggggcgccgcaccgcccgtccccggccgggtacctcttcaaccgcgccgccgcctacgcctccgccgccgcggcccaggcggcgcccgccaccccgccgccagccaccgggaagaccggcggcggcaagatcaccgacgagttcaccggcgcgggcgccatcggccaggtgtgccaggtgatcggcgccgtcgtcgacgtgcgctacgatgagggcctcccgcccatcctcacggcggctcgagggtgctcgacaacgaacttccgcctcgtggctcgaggtgggcgcaccacccttggccaaaaaaaatgggtggcgccccattccctttgggacgggcacggagggggttcgttccgggggcaaggggccctaaaaaatggtttcccccataacccgtggcctgttggacgggggcc

SEQ ID NO: 71524 - protein, 167 aa, Zea mays
  misc_feature: Ceres CLONE 1553242
  misc_feature: SWISSPROT Homolog: EC 3.6.3.14 H(+)-transporting two-sector ATPase
MASRRVVSSLLRSASRLRAASPAAPRPRGAPHRPSPAGYLFNRAAAYASAAAAQAAPATPPPATGKTGGGKITDEFTGAGAIGQVCQVIGAVVDVRYDEGLPPILTAARGCSTTNFRLVARGGRTTLGQKKWVAPHSLWDGHGGGSFRGQGALKNGFPHNPWPVGRG

SEQ ID NO: 71525 - DNA, 2227 bp, Zea mays
  misc_feature: Ceres CLONE 1553247
  misc_feature: Encodes the peptide sequence at SEQ ID NO. 71526
agcgtgcgatgtagcagtggccagctactcggcagcagcgctcgctctctagacgcttgggcttggcacgccgtcgccgagatcatccatggccggcgcaggccaggaagaagaaaaggtggagcacgagggagaagaaatggtggccggccggcagcaaggatcgtcgcgcggcgccgtggagcaatgcggcggccaagcacagcctgccgtcaccgctccatgctcgtccaagaacccgccggacgcgaggaagccttacgcgactccggaggggtgctccgtccacccggggccgccgcgggatcaacggcccaacgcgtcgccgaaccaccgcgtgtccctggagaacgacgttaggcagctgcagctgcatttgcgtcaggagaggtctgtccgggtcatgctcgatcgggccattggccgggcgtccagcgcgctgtctcctggccataggcatttccgggatttcccggcgcagacaaaggagctgatagcggagatcgaattgctcgaggaggaaatcgccaaccgcgagcagcacgttcttactctctacaggagcatcttcgaccagtgcatgtctgggccaccgtctgggcagagctctggcatctcgtcccccgcgcacgccaaaactatcaccgctaggacacgaaggcagccgagcataatatcgagtgcattttgctcgtccaagaagctcccgctccagcccttccacatcacagagtcactctccgagtcgggaagaaccaagaacacgctcaaggctaagatcaagcacccatctttttcaagcgaaacattggatagcagccattctacttccttcccaccggacccaaaaaagctaccttattctgggagtggcggctctcttgcccgcactctgaaagaccacctctaccaatgcccaagcaaaatatccgaagaaatggtcagatgcatggcatccatatactatcttctgcgcaccgaggcgccagcaggaaagcctgagaaggcccgctcgccattcttgtcaaggtcatcgacgaatgtcatccttcctcggcgggtgaacggagaggaaaacagcgcaccgaacaacaggtgcacggtggaaatagcttccatatcagttgacaagaaccagatgccagatgtctcttacgcgatcacccactacaggttgcttgtggaacagcttgaaagagttgatctgagcgtgtcggagaacagcgttaagttggccttctggattaacgtttacaattcgcttatcatgcatgcgtatctggcatatgggattccaaacagctctctgaaaagaatggcgctatttcacaaggctgcctacaatattggagggcatgccattaccgccaatgctatcgagcacgccttgctgtgcttcaggtctccacggatcggtcgttggttcgagtccatcctctcgacggctatgcggaagaaatgcccggacgagaagcagctggtccagctcaagttcggcctgcaggagtgccagcctctggccctcttcgccctgtgcaccggcgcttcgtctgaccccatgctgcgggtgtacacggcgaagaacgtgatggaggagctggagcgcgccaagcgagagttcctgcaggcgacggtggtggtgcgcaagtccacgaagaagctgttcctgccgcgcctggtggagcggtacgcgagggaggcgtgcgttggccccgacagcgtcctcccgtgggcgcagcgcgagggggccgtcgccgtcgtcgacgaccggccgcagcaggaggccgcccagcggggcgtggggagccggcgcaaggccgtgcaggccgtagagtggctgccgtacgccaccagattccgctatgccttcgccaggagcatggtcgacaagccacactgctagctgcttcgcctcgcacagtcgcactcctcgcatcgcagctgttgccgtctggccccgtttccgctggagaaagacatctgatcgctgtggcgcagccattctgatggctagatgtaaatgtctcgttgatgctgcgatgttgacggctagatagtactgctctgttccgtagtgaacaagtggcaaggatgggacgaagggtttgactaattttgcacaaggtgtacagaagctagttgatcgctattatttcaggtttcagcagcagtctgttggagaccatttgaattcattcgaattgtttatctaaaaaaaaaaaaaaaa

SEQ ID NO: 71526 - protein, 604 aa, Zea mays
  misc_feature: Ceres CLONE 1553247
  misc_feature (362)..(512): Pfam Name: DUF547 Pfam Description: Protein of unknown function, DUF547
MAGAGQEEEKVEHEGEEMVAGRQQGSSRGAVEQCGGQAQPAVTAPCSSKNPPDARKPYATPEGCSVHPGPPRDQRPNASPNHRVSLENDVRQLQLHLRQERSVRVMLDRAIGRASSALSPGHRHFRDFPAQTKELIAEIELLEEEIANREQHVLTLYRSIFDQCMSGPPSGQSSGISSPAHAKTITARTRRQPSIISSAFCSSKKLPLQPFHITESLSESGRTKNTLKAKIKHPSFSSETLDSSHSTSFPPDPKKLPYSGSGGSLARTLKDHLYQCPSKISEEMVRCMASIYYLLRTEAPAGKPEKARSPFLSRSSTNVILPRRVNGEENSAPNNRCTVEIASISVDKNQMPDVSYAITHYRLLVEQLERVDLSVSENSVKLAFWINVYNSLIMHAYLAYGIPNSSLKRMALFHKAAYNIGGHAITANAIEHALLCFRSPRIGRWFESILSTAMRKKCPDEKQLVQLKFGLQECQPLALFALCTGASSDPMLRVYTAKNVMEELERAKREFLQATVVVRKSTKKLFLPRLVERYAREACVGPDSVLPWAQREGAVAVVDDRPQQEAAQRGVGSRRKAVQAVEWLPYATRFRYAFARSMVDKPHC

SEQ ID NO: 71527 - DNA, 655 bp, Zea mays
  misc_feature: Ceres CLONE 1553256
  misc_feature: Encodes the peptide sequence at SEQ ID NO. 71528
  misc_feature (474)..(474): n is a, c, t, g, unknown, or other
ctccccgcggtggcggccgctctagaactagtggatcccccgggctgcaggaattcgtctcacccctagaaaaaacactccccagtccccagtcccccgctgggagcggcagccagcacgaggcaggagcagcgcgagggcaggcgccatgggggtccggtcggcggccacaaagctgcacatcccaccatccgccgcccgccgacccacgttcctgccattcgtggccgtcctcctcctctgctctgcctcctatctcatcggcgtctggcagcacggcggcttcgccactccatccgacaaacccgccgccgtctccaccgctacggccgtcgcctgcaccaacgtcgccgccgccccgaagaggaggaccccggtcggcgccagctccccgtccctcgactttctcgcgcgccacgcggccgcggcggacgacgcgctcgacgctagcaccggcaccgccgcctcctcggncgcggcggggaagtcgtcgtacccggcgtgcccccgccagttactccgagtacccccgtggcagaccgtgaagcggtccctccggttcccccgggaccccctggttacccgaaagcggatttccccggctccgaaacgggaacggctccgttcccttggccccccccccccgggtaaccac

SEQ ID NO: 71528 - protein, 169 aa, Zea mays
  misc_feature: Ceres CLONE 1553256
  misc_feature (109)..(109): Xaa is any aa, unknown, or other
MGVRSAATKLHIPPSAARRPTFLPFVAVLLLCSASYLIGVWQHGGFATPSDKPAAVSTATAVACTNVAAAPKRRTPVGASSPSLDFLARHAAAADDALDASTGTAASSXAAGKSSYPACPRQLLRVPPWQTVKRSLRFPRDPLVTRKRISPAPKRERLRSLGPPPPGNH

SEQ ID NO: 71529 - DNA, 651 bp, Zea mays
  misc_feature: Ceres CLONE 1553259
  misc_feature: Encodes the peptide sequence at SEQ ID NO. 71530
  misc_feature (390)..(390): n is a, c, t, g, unknown, or other
  misc_feature (447)..(447): n is a, c, t, g, unknown, or other
  misc_feature (448)..(448): n is a, c, t, g, unknown, or other
  misc_feature (449)..(449): n is a, c, t, g, unknown, or other
  misc_feature (450)..(450): n is a, c, t, g, unknown, or other
  misc_feature (451)..(451): n is a, c, t, g, unknown, or other
  misc_feature (452)..(452): n is a, c, t, g, unknown, or other
  misc_feature (453)..(453): n is a, c, t, g, unknown, or other
  misc_feature (454)..(454): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (468)..(468): n is a, c, t, g, unknown, or other
  misc_feature (469)..(469): n is a, c, t, g, unknown, or other
  misc_feature (470)..(470): n is a, c, t, g, unknown, or other
  misc_feature (471)..(471): n is a, c, t, g, unknown, or other
  misc_feature (472)..(472): n is a, c, t, g, unknown, or other
  misc_feature (473)..(473): n is a, c, t, g, unknown, or other
  misc_feature (474)..(474): n is a, c, t, g, unknown, or other
  misc_feature (475)..(475): n is a, c, t, g, unknown, or other
  misc_feature (476)..(476): n is a, c, t, g, unknown, or other
  misc_feature (477)..(477): n is a, c, t, g, unknown, or other
  misc_feature (478)..(478): n is a, c, t, g, unknown, or other
  misc_feature (479)..(479): n is a, c, t, g, unknown, or other
  misc_feature (480)..(480): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (488)..(488): n is a, c, t, g, unknown, or other
  misc_feature (489)..(489): n is a, c, t, g, unknown, or other
  misc_feature (490)..(490): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (495)..(495): n is a, c, t, g, unknown, or other
  misc_feature (496)..(496): n is a, c, t, g, unknown, or other
  misc_feature (497)..(497): n is a, c, t, g, unknown, or other
  misc_feature (498)..(498): n is a, c, t, g, unknown, or other
  misc_feature (499)..(499): n is a, c, t, g, unknown, or other
  misc_feature (500)..(500): n is a, c, t, g, unknown, or other
  misc_feature (501)..(501): n is a, c, t, g, unknown, or other
  misc_feature (502)..(502): n is a, c, t, g, unknown, or other
  misc_feature (503)..(503): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (510)..(510): n is a, c, t, g, unknown, or other
  misc_feature (511)..(511): n is a, c, t, g, unknown, or other
  misc_feature (512)..(512): n is a, c, t, g, unknown, or other
  misc_feature (513)..(513): n is a, c, t, g, unknown, or other
  misc_feature (514)..(514): n is a, c, t, g, unknown, or other
  misc_feature (515)..(515): n is a, c, t, g, unknown, or other
  misc_feature (516)..(516): n is a, c, t, g, unknown, or other
  misc_feature (517)..(517): n is a, c, t, g, unknown, or other
  misc_feature (518)..(518): n is a, c, t, g, unknown, or other
  misc_feature (519)..(519): n is a, c, t, g, unknown, or other
  misc_feature (520)..(520): n is a, c, t, g, unknown, or other
  misc_feature (521)..(521): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (530)..(530): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (536)..(536): n is a, c, t, g, unknown, or other
  misc_feature (537)..(537): n is a, c, t, g, unknown, or other
  misc_feature (538)..(538): n is a, c, t, g, unknown, or other
  misc_feature (539)..(539): n is a, c, t, g, unknown, or other
  misc_feature (540)..(540): n is a, c, t, g, unknown, or other
  misc_feature (541)..(541): n is a, c, t, g, unknown, or other
  misc_feature (542)..(542): n is a, c, t, g, unknown, or other
  misc_feature (543)..(543): n is a, c, t, g, unknown, or other
  misc_feature (544)..(544): n is a, c, t, g, unknown, or other
  misc_feature (545)..(545): n is a, c, t, g, unknown, or other
  misc_feature (546)..(546): n is a, c, t, g, unknown, or other
  misc_feature (547)..(547): n is a, c, t, g, unknown, or other
  misc_feature (548)..(548): n is a, c, t, g, unknown, or other
  misc_feature (549)..(549): n is a, c, t, g, unknown, or other
  misc_feature (550)..(550): n is a, c, t, g, unknown, or other
  misc_feature (551)..(551): n is a, c, t, g, unknown, or other
  misc_feature (552)..(552): n is a, c, t, g, unknown, or other
  misc_feature (553)..(553): n is a, c, t, g, unknown, or other
  misc_feature (554)..(554): n is a, c, t, g, unknown, or other
  misc_feature (555)..(555): n is a, c, t, g, unknown, or other
  misc_feature (556)..(556): n is a, c, t, g, unknown, or other
  misc_feature (557)..(557): n is a, c, t, g, unknown, or other
  misc_feature (558)..(558): n is a, c, t, g, unknown, or other
  misc_feature (559)..(559): n is a, c, t, g, unknown, or other
  misc_feature (560)..(560): n is a, c, t, g, unknown, or other
  misc_feature (561)..(561): n is a, c, t, g, unknown, or other
  misc_feature (562)..(562): n is a, c, t, g, unknown, or other
  misc_feature (563)..(563): n is a, c, t, g, unknown, or other
  misc_feature (564)..(564): n is a, c, t, g, unknown, or other
  misc_feature (565)..(565): n is a, c, t, g, unknown, or other
  misc_feature (566)..(566): n is a, c, t, g, unknown, or other
  misc_feature (567)..(567): n is a, c, t, g, unknown, or other
  misc_feature (568)..(568): n is a, c, t, g, unknown, or other
  misc_feature (569)..(569): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
gctggagctccccgcggtggcggccgctctagaactagtggatcccccgggctgcaggaattcgtctcacccctagaaaaagcacaacacaagagctactactacagctcctcatctcaagtgtgtagacgagacagagagacactgagagagcgccatggccagcctccaagtcactcctacttcggcgttcactgagtggaacgagctgaagttcgaaggcctgtacctgttccacacgcccctgggctcaggcgccaaccaagctcgggtcatagacaacaaggcgccgattggcatcggtgccaccgtagttaacaactggacagtgtatgacgggccagggccgaacgcaaagctggttgcccgtgcacagggcttgcatatccnagcccggcactgggtcaactccttcagcctagtggttccgtgggatccaaaaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 71530 - protein, 96 aa, Zea mays
  misc_feature: Ceres CLONE 1553259
  misc_feature (78)..(78): Xaa is any aa, unknown, or other
MASLQVTPTSAFTEWNELKFEGLYLFHTPLGSGANQARVIDNKAPIGIGATVVNNWTVYDGPGPNAKLVARAQGLHIXARHWVNSFSLVVPWDPKR

SEQ ID NO: 71531 - DNA, 667 bp, Zea mays
  misc_feature: Ceres CLONE 1553260
  misc_feature: Encodes the peptide sequence at SEQ ID NO. 71532
ccgcggtggcggccgctctagaactagtggatcccccgggctgcaggaattcgtctcacccctagaaaaaagcaaatcactacacacaccttgtctctaatcagatatcaaagaagtagccattaagttaacgatggcttccgccgacctcgcagaggccatcgagcccagcaggaagaagaagagcaacgtcaagtatgcctccatctgcgccatcctcgcctccatggcctccgtcatccttggctacgatattggggtgatgagcggagcggccatgtacatcaagaaggacctgaagatcacggacgtgcagctggagatcctgatagggatcctcagcctctactcgctcatcgggtccttcgcgggcgcgcggacgtccgacaggatcggccgccgcctgaccgtcgtcttcgccgccgtcatcttcttcgcgggcgcgctgctcatgggtttcgccgtcaactactccatgctcatggtgggccgcttcgtggccggagttggcgtgggctacgggggcatgatcgcgcccgtgtcacggccgagatctcggcggcggcgtcccgcggcttcctcacgtccttccccgaaagtgtcatcaacgtcggcatcctgctcggctacctgtcgaactttgcgtttgcgcgcctaccgctccgcc

SEQ ID NO: 71532 - protein, 178 aa, Zea mays
  misc_feature: Ceres CLONE 1553260
MASADLAEAIEPSRKKKSNVKYASICAILASMASVILGYDIGVMSGAAMYIKKDLKITDVQLEILIGILSLYSLIGSFAGARTSDRIGRRLTVVFAAVIFFAGALLMGFAVNYSMLMVGRFVAGVGVGYGGMIAPVSRPRSRRRRPAASSRPSPKVSSTSASCSATCRTLRLRAYRSA

SEQ ID NO: 71533 - DNA, 2279 bp, Zea mays
  misc_feature: Ceres CLONE 1553262
  misc_feature: Encodes the peptide sequence at SEQ ID NO. 71534
agtcaccaaacagcgccgcgctccgcattgcgctagggttttagaactcttcctccggtcctccccgttatccctccaaaaggcagcgcccgctagggttttagccgccgcctccttccctctcctcctccacgtctcctcaacagccgctgccacccggagccttcccgcagcgacgccatgtgggctcttcgccgagctggcaaccccctcaggttccgtgcccaaaaagttgcaagtgcccatgtctgtgcgagtcttgaggtgctgctagctgctgatgcaaagaatgtagaagagcaccatgaggcagactgccagaaaatgtgctgctgtcataaaccaaggtcaccagcctttcaattgtcattttcatctggccagtttgcttgcagtaggggtttctcctctcagccaggtgcaaattctggtgacaaagctgatgagttagaggacggattttctgatctcgaggttccaccagcagctgttcaaaacgatgacgggttggcatctgaagatagttctgatgaggatgctgctgacgaatttggcttgcctgatgtggatgctgatgcaaaacctgagaaggagcacactagaagattatctgattctattctcctcaagacattatctgattctattctcctcaagactgtgttggaagctccgaggcatcaagtcacttcagcacttgagaaatgggcaaaggatggcaatgcatttgataggggtgaactctattatgttcttcttaatcttcgaaagcggcattggtactccaaagccttggagcttgttgagtgggttcaaaaatcacagctattcgaatttgtagagcgtgattatgctgcacatcttgatttaacagctaaggtctatggtcttcataaagcagaacagactattgagaaaattcctgcatcttgtaggggtgagattgtttatagaacacttttggccaattgtgtttctgcatccaatataaaaaaatcggagcaagtttttaataggatgaaggatcttggatttccggttacacaattttctttcaatcagcttctgttactctacaaaaggctggacaggaagaagattgctgatgttcttgcaatgatggaaaaggaggatgtgaaaccatctctctttacttacaagattcttgtagatgccaagggttcagttggagatatagaagctatggagaaagtgattgaatcaatggagaaagatagcattgagccagatctcacgtttaatgctacaattgccagacactacatattttatggccagcgtgagaaagcagaggcacttctgaaggcaatggagggtgatgatatccagaaaaatcgtgctgcttgcaagactttattacctttacatgcttttctgggcaatagtgatgctgtggaaagaatttggaaggcgtgtgaggataatactcgcgtagctgagtccgtgtctgctatagaggcctttggtaagcttggtgatgttgaaaaggcagagaaggtttttgaggatatgcttgtgcattggaaaacactctcttccaaattctacaacgcgttgctaaaggtgtatgctgatcacaacctcttagacaagggtaaggaactagcaaagcggatggatgagaaccgtgtcaggtttggggccccaactctggatgcacttgtgaagctatacgttgaggctggagaggtggagaaagctgagtccctagtgcacaagctatctatacagaaccacatcaagcctatatacaacacatacatgacgctgcttgacagctactcaaagaaaggagacgtccgcaactcagagaaagtgttcaacaagttgcggcagtccggctacactgggaggatcaggatgtaccagtcgctgctccatgcttatgtacatgctaaggcccctgcttatggattcagagagaggatgaaggctgacaacattttccccaacagtgctgtgtcaactttgattgccgctactgatccgtttgtcaagaagaaatcgatatctgacttgctcgattaggttattgagtagtgtgagatccatcatgtttccgtgcaacgcatgtgctgcctttttttttgcattctgctaaagaatacggcgggataataatgtgtcctagtcttgtaatgaactactagtgtctttgcatttggactggttcgcttgtgagtcatagagattgctgaactcgtgagtcatggaaattggcaactgtgggctatttgttctaaaaaaaaaaaaaaaaa

SEQ ID NO: 71534 - protein, 622 aa, Zea mays
  misc_feature: Ceres CLONE 1553262
  misc_feature (324)..(358): Pfam Name: PPR Pfam Description: PPR repeat
MWALRRAGNPLRFRAQKVASAHVCASLEVLLAADAKNVEEHHEADCQKMCCCHKPRSPAFQLSFSSGQFACSRGFSSQPGANSGDKADELEDGFSDLEVPPAAVQNDDGLASEDSSDEDAADEFGLPDVDADAKPEKEHTRRLSDSILLKTLSDSILLKTVLEAPRHQVTSALEKWAKDGNAFDRGELYYVLLNLRKRHWYSKALELVEWVQKSQLFEFVERDYAAHLDLTAKVYGLHKAEQTIEKIPASCRGEIVYRTLLANCVSASNIKKSEQVFNRMKDLGFPVTQFSFNQLLLLYKRLDRKKIADVLAMMEKEDVKPSLFTYKILVDAKGSVGDIEAMEKVIESMEKDSIEPDLTFNATIARHYIFYGQREKAEALLKAMEGDDIQKNRAACKTLLPLHAFLGNSDAVERIWKACEDNTRVAESVSAIEAFGKLGDVEKAEKVFEDMLVHWKTLSSKFYNALLKVYADHNLLDKGKELAKRMDENRVRFGAPTLDALVKLYVEAGEVEKAESLVHKLSIQNHIKPIYNTYMTLLDSYSKKGDVRNSEKVFNKLRQSGYTGRIRMYQSLLHAYVHAKAPAYGFRERMKADNIFPNSAVSTLIAATDPFVKKKSISDLLD

SEQ ID NO: 71535 - DNA, 686 bp, Zea mays
  misc_feature: Ceres CLONE 1553268
  misc_feature (24)..(24): n is a, c, t, g, unknown, or other
  misc_feature (263)..(263): n is a, c, t, g, unknown, or other
  misc_feature (265)..(265): n is a, c, t, g, unknown, or other
  misc_feature (304)..(304): n is a, c, t, g, unknown, or other
  misc_feature (327)..(327): n is a, c, t, g, unknown, or other
  misc_feature (329)..(329): n is a, c, t, g, unknown, or other
  misc_feature (341)..(341): n is a, c, t, g, unknown, or other
  misc_feature (342)..(342): n is a, c, t, g, unknown, or other
  misc_feature (343)..(343): n is a, c, t, g, unknown, or other
  misc_feature (344)..(344): n is a, c, t, g, unknown, or other
  misc_feature (345)..(345): n is a, c, t, g, unknown, or other
  misc_feature (346)..(346): n is a, c, t, g, unknown, or other
  misc_feature (360)..(360): n is a, c, t, g, unknown, or other
  misc_feature (361)..(361): n is a, c, t, g, unknown, or other
  misc_feature (362)..(362): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (416)..(416): n is a, c, t, g, unknown, or other
  misc_feature (417)..(417): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (434)..(434): n is a, c, t, g, unknown, or other
  misc_feature (443)..(443): n is a, c, t, g, unknown, or other
  misc_feature (447)..(447): n is a, c, t, g, unknown, or other
  misc_feature (448)..(448): n is a, c, t, g, unknown, or other
  misc_feature (457)..(457): n is a, c, t, g, unknown, or other
  misc_feature (458)..(458): n is a, c, t, g, unknown, or other
  misc_feature (460)..(460): n is a, c, t, g, unknown, or other
  misc_feature (474)..(474): n is a, c, t, g, unknown, or other
  misc_feature (491)..(491): n is a, c, t, g, unknown, or other
  misc_feature (534)..(534): n is a, c, t, g, unknown, or other
  misc_feature (535)..(535): n is a, c, t, g, unknown, or other
  misc_feature (571)..(571): n is a, c, t, g, unknown, or other
aaagctgagcttctgcggtggcgncgctctagactagtggatcccccggctgcaggatcgtctcaccctagaaaaaaaaccgaaaaggaggacaaaatttctcctctcgaagaccctagcggcaaaacctttgctccgtccgccgtcgcctgctccctcccgccgcctgcgctgcacccgcatctgccctgggctcgccgccggggagggggttgcggtgctgcgctgtctgctgggcccgaggctggctcgcgccccctccntncttgtgtggtgtggggtttgggtttggatgggtcggtgntgttgggtgtcttggggctaccngnggcgccccccgnnnnnncccccccccccccnnngggggggggggggtgggtggtggttttttttgtgttggcccccccccnnncctnntgcctgttggtgnnntnggtgggggnggcnnttgcgtttnngnttggtggggggagngggctgttccctgggtnggggggggccctttgtccgaggggccgcggcggtggtgctgtnnaggtgggtgttcgggctcgtttttttcttgtttccngggtgggggtccctcctcctctttgttgatggatcatgtgggagttagggactcgcagtcttgcgtttcgctcccgcccgtctcgcgccgcccccgcctccccttcggccgcctc

SEQ ID NO: 71536 - DNA, 691 bp, Zea mays
  misc_feature: Ceres CLONE 1553269
  misc_feature: Encodes the peptide sequence at SEQ ID NO. 71537
  misc_feature (573)..(573): n is a, c, t, g, unknown, or other
agctccccgcggtggcggccgctctagaactagtggatcccccgggctgcaggaattcgtctcacccctagaaaaactagaaaaaaaaaatccctcccgatcagatccctcgacaatggcactccaggcagcctacgagtacctgcagcaggccgtcggccatggcgcgtggtcgtccacgcagacgctgacgctgctgctcatcgccgtacccaccgtactactgctgctagcgtccctcgccaagagcacgtcgtcgtccggtaggggcaagccgccgctccctccctcgccgccgggcaccctccccatcgtggggcacctacaccacatcgggccccagacccacatctcgctccaggagctggtggccaagtacgggcacaacgggttcctgttcctccgcgccggcgccgtgcccaccctgatcgtgtcgtcgcccagcgccgccgaggccgtgatgcgcacccacgaacacatcttcgcgtcccggccgtgggtcattgcctcccacatcctccggctacaacacctggggacgtggcctttcttcgccgcttcggcgaatacctnccagccgaccagggagactggatgaaccccccccttgctcagcaaccagaaagggctactcctttcccccattggccccaaggaaaaaagggggccccctctctgggaaacccccccg

SEQ ID NO: 71537 - protein, 160 aa, Zea mays
  misc_feature: Ceres CLONE 1553269
  misc_feature: SWISSPROT Homolog: EC 1.14.13.68 4-hydroxyphenylacetaldehyde oxime monooxygenase
  misc_feature (153)..(153): Xaa is any aa, unknown, or other
MALQAAYEYLQQAVGHGAWSSTQTLTLLLIAVPTVLLLLASLAKSTSSSGRGKPPLPPSPPGTLPIVGHLHHIGPQTHISLQELVAKYGHNGFLFLRAGAVPTLIVSSPSAAEAVMRTHEHIFASRPWVIASHILRLQHLGTWPFFAASANTXQPTRETG

SEQ ID NO: 71538 - DNA, 605 bp, Zea mays
  misc_feature: Ceres CLONE 1553271
  misc_feature: Translation starting site: 136
tccccgcggtggcggccgctctagaactagtggatcccccgggctgcaggaattcgtctcacccctagaaaaaatcgccccccttcggccttccccactgtactctccaatctcgccgccaagcctcaccgcaccatggcgaccttcaccgcggcctcctccctctccctcctcttctcccacccgcactcccactcccgccaaccatccgcccaggggcccaccgccagctcccacctccgcctgcatccgcgcgccagccgcgcgcgctgcgcctcttccgacacgacggccacgaagcaccgccgcccagcggaggagaacatccgcgaggaggcggcgcggctcccaggccccgcccagggttgctctggtggtacgagcccctccccccgggccccgggggcaacccaaaggagcgctactccctggacaaaggcggcctccccctcccgcctcggggggcccccccccaagtgggccccaaaaattgggagggccctggcccccctttacccggggggtcccaaagggggggggcaacccccttcgaaacccccccgggggggggggccaaacccggcgtgtggggcccccctaggggg

SEQ ID NO: 71539 - DNA, 675 bp, Zea mays
  misc_feature: Ceres CLONE 1553273
  misc_feature: Encodes the peptide sequence at SEQ ID NO. 71540
  misc_feature (531)..(531): n is a, c, t, g, unknown, or other
ctccccgcggtggcggccgctctagaactagtggatcccccgggctgcaggaattcgtctcacccctagaaaaaatttttccccatttttacggacaccagcaagccacgccacactcccaatcgccgcagcagctggtcccctgctcggctcgtctgatccagcggctgaatccacaggccatggggttcgacaaggaggcgagctcctcctcctcgcggctcgacgcggcgccgctgctcccgcagcacggcggcggcggcgcgggcgggcacctgtcgtcgcagcccaagacgttcgccaacgtcttcatcgccgtcgtcggctcgggcgtgctgggcctcccctacaccttctcccgcacgggctgggcggcggggacgctgctgctcctcgccgtcgccgcgctcaccttccactgcatgatgctcctcgtcgcagcgcgccgcccggatcgcggacgcgcaccccaagatcgcctccttcgggggactgggccaccgcatctacggcgcgcccgggcgcccaccngtcgacgccatgctcgtgctcagccaggccagcttctggcgtcggtacctgatcttcatctccacaccatggcgcactctaccccatcgccatggggggccagtccccggggtccccgttcctagggcaaagggttctttattg

SEQ ID NO: 71540 - protein, 157 aa, Zea mays
  misc_feature: Ceres CLONE 1553273
  misc_feature (117)..(117): Xaa is any aa, unknown, or other
MGFDKEASSSSSRLDAAPLLPQHGGGGAGGHLSSQPKTFANVFIAVVGSGVLGLPYTFSRTGWAAGTLLLLAVAALTFHCMMLLVAARRPDRGRAPQDRLLRGTGPPHLRRARAPTXRRHARAQPGQLLASVPDLHLHTMAHSTPSPWGASPRGPRS

SEQ ID NO: 71541 - DNA, 681 bp, Zea mays
  misc_feature: Ceres CLONE 1553274
  misc_feature: Encodes the peptide sequence at SEQ ID NO. 71542
  misc_feature (59)..(59): n is a, c, t, g, unknown, or other
tggcggccgctctagaactagtgggatcccccggggctgcagggaattcgtctcacccnctagaaaaaaaaaaaaaaaaaaaaaaaaaatacgccttctgctttagcagtagtttccaaccagaggcaggcacctcgagaggcgggtgaacatggagggcgataagaaggcgggcgccgtggcagagaagaaggcggcggcggcggatcagagcaaggaggtggccgctggtgatgtgagcctgaaggagctgtccaggaggctcaacgacttcgccaaggagagggactgggagcagcaccatagcccccggaacctgctgctcgccatgatcgctgaggtcggggagctgtcagagctgttcatgtggaaagggggaggtgcgcaagggcctcgccgactgggacgagggcggagaagagcacctcggcgaggagctctccgacgtgctgctctacctggtcccgctctcgaatgtggcgcgtaaacctcgcgacgccgccctcaggaaaatctcaagaccgccgtcaagtccccggccccgtccaggaacaaggcgcccgaagaagacaaaaatacccccgggggagccccttctttgatcttgggaaaaccggggccccggggaaaaaaacccgccccggaaattttgaaacgggggtgtgggcccctttttccccc

SEQ ID NO: 71542 - protein, 111 aa, Zea mays
  misc_feature: Ceres CLONE 1553274
MEGDKKAGAVAEKKAAAADQSKEVAAGDVSLKELSRRLNDFAKERDWEQHHSPRNLLLAMIAEVGELSELFMWKGGGAQGPRRLGRGRRRAPRRGALRRAALPGPALECGA

SEQ ID NO: 71543 - DNA, 484 bp, Zea mays
  misc_feature: Ceres CLONE 1553275
  misc_feature (202)..(202): n is a, c, t, g, unknown, or other
caccgcggtggcggccgctctagaatagtggatcccccgggctgaggaattcgtctcacccctagaaaaagctccacgttcacctctctctccgtgtctccctcgtacacgtctcgtctaccattactggaaccaaagaaagcctggtgtttgtttctttccgaagacagcatgatcccggcgttgccgatcccgcgacaanttggacggggcgcgcgccacccgttgcttccggaaacgaccctcggggcgcccttgcccccccgggcttggaaaattggcggggggggggggggaaaaaaaaactttttttaccgggccgggtttcccccggggtctgttttttttcttggggggtaagggccctcccttcaaaaaccccctaaggggggggggggggggggctcccccccggagggggggccccccccggggggggaggggggttttaaaaaaaaaacccccccccccccccccccccccc

SEQ ID NO: 71544 - DNA, 617 bp, Zea mays
  misc_feature: Ceres CLONE 1553280
  misc_feature (228)..(228): n is a, c, t, g, unknown, or other
  misc_feature (229)..(229): n is a, c, t, g, unknown, or other
  misc_feature (324)..(324): n is a, c, t, g, unknown, or other
  misc_feature (325)..(325): n is a, c, t, g, unknown, or other
  misc_feature (354)..(354): n is a, c, t, g, unknown, or other
  misc_feature (355)..(355): n is a, c, t, g, unknown, or other
  misc_feature (356)..(356): n is a, c, t, g, unknown, or other
  misc_feature (372)..(372): n is a, c, t, g, unknown, or other
  misc_feature (375)..(375): n is a, c, t, g, unknown, or other
  misc_feature (409)..(409): n is a, c, t, g, unknown, or other
  misc_feature (440)..(440): n is a, c, t, g, unknown, or other
  misc_feature (460)..(460): n is a, c, t, g, unknown, or other
  misc_feature (461)..(461): n is a, c, t, g, unknown, or other
  misc_feature (467)..(467): n is a, c, t, g, unknown, or other
  misc_feature (480)..(480): n is a, c, t, g, unknown, or other
  misc_feature (501)..(501): n is a, c, t, g, unknown, or other
  misc_feature (502)..(502): n is a, c, t, g, unknown, or other
  misc_feature (506)..(506): n is a, c, t, g, unknown, or other
  misc_feature (507)..(507): n is a, c, t, g, unknown, or other
  misc_feature (508)..(508): n is a, c, t, g, unknown, or other
  misc_feature (509)..(509): n is a, c, t, g, unknown, or other
  misc_feature (531)..(531): n is a, c, t, g, unknown, or other
  misc_feature (532)..(532): n is a, c, t, g, unknown, or other
  misc_feature (533)..(533): n is a, c, t, g, unknown, or other
  misc_feature (534)..(534): n is a, c, t, g, unknown, or other
  misc_feature (535)..(535): n is a, c, t, g, unknown, or other
  misc_feature (586)..(586): n is a, c, t, g, unknown, or other
  misc_feature (587)..(587): n is a, c, t, g, unknown, or other
  misc_feature (594)..(594): n is a, c, t, g, unknown, or other
ctccccgcggtggcggccgctctagaactagtggatcccccgggctgcaggaattcgtctcacccctagaaaaaagaggagagagtcgctcagcactgcacgactcctcccccatctaccactacctgtctacctacccagcccatcgatcacccctcgcaacgcaatggcgctggccaccaactccgccgctgccgcagcagctgccgtatccggcggcgcggcatnncccagccgcaccggcggcgggcccacggttttcctctccccccggtgaaaaaaagggggggggcccacccttttttttccgccgcccaaattttnnacacgcccgccgcccgggaaaaacacaannntttttttttcactttnttnaaaaaaaaaaaagaaaggggggggggggggcgcnccgtttttttcccccccctcccccccggggncgcgccccgccccccccccnnaaaaanaaaaaaaaaaaanaatttctcccccctccccccnncccnnnncgggggggcccccccgcccccnnnnnaaaagggaaaaaaaaaaaatattttggcgacagcccgggggggcgccgggnnagtttcntttgaggggaaaagttttttgtt

SEQ ID NO: 71545 - DNA, 685 bp, Zea mays
  misc_feature: Ceres CLONE 1553283
  misc_feature: Encodes the peptide sequence at SEQ ID NO. 71546
  misc_feature (405)..(405): n is a, c, t, g, unknown, or other
  misc_feature (407)..(407): n is a, c, t, g, unknown, or other
  misc_feature (461)..(461): n is a, c, t, g, unknown, or other
  misc_feature (467)..(467): n is a, c, t, g, unknown, or other
  misc_feature (470)..(470): n is a, c, t, g, unknown, or other
  misc_feature (471)..(471): n is a, c, t, g, unknown, or other
  misc_feature (477)..(477): n is a, c, t, g, unknown, or other
ctggagctccccgcggtggcggccgctctagaactagtggatcccccgggctgcaggaattcgtctcacccctagaaaaaatgggccactactgctagagctagtgctagtagcagcgtggagaggcagagaagtagccaaagccaagtaggaggaggaggaggagcggcaggtagggcgcggggcgagagcttgacgcggcaaccaccgctgcactgcactgcactgcaccccctagctcctccgagctcagcagctcgctcgcggcaagtcgccatccatgtcaggaaagatttatctggtcggccgatcgagctcctctccttctccgaagcactgaagctccagcggctgccctgcctgacagccacttcgcgggagggagttaaaaagcgcgggcaatcnanatggcgcacgaccccagcctgggcttcgcggactacttctcggcggcggcggcngctgcngcnngcggcnccacggcgatggacgacgacctcgggggcgccggactctatggcctggatggccaccacatggagtcctcgggatgcgtggccgggcgcccttgccccctggcgcggggacaccaccaccccaccaccttcaggggcaacaggaagggcggtgcgctcctccaccaacaacaacgcggggggggggggcaaaaacttagcgggttccg

SEQ ID NO: 71546 - protein, 92 aa, Zea mays
  misc_feature: Ceres CLONE 1553283
  misc_feature (22)..(22): Xaa is any aa, unknown, or other
  misc_feature (24)..(24): Xaa is any aa, unknown, or other
MAHDPSLGFADYFSAAAAAAAXGXTAMDDDLGGAGLYGLDGHHMESSGCVAGRPCPLARGHHHPTTFRGNRKGGALLHQQQRGGGGQKLSGF

SEQ ID NO: 71547 - DNA, 665 bp, Zea mays
  misc_feature: Ceres CLONE 1553285
  misc_feature: Encodes the peptide sequence at SEQ ID NO. 71548
  misc_feature (389)..(389): n is a, c, t, g, unknown, or other
ctccccgcggtggcggccgctctagaactagtggatcccccgggctgcaggaattcgtctcacccctagaaaaaaagcaggcgacacccgttcggtccgtacaggaggggtccaccatgccgtgctcctcctcttcgtcgtccaaccccttccactccctcgcctccgccttccccttcctctcctccacatccccacccccatccccacccgcctcgcccgcgcccgccgctccccacctcgccgtcccgctcctcctccccgtctcctcggcttccgagtcccgccgcggggcgcagccgctgccgggcacgcggatggtcggcgcgggcgcgaccggcgggggtaacatggccagccgtggtgggggggcccgcgttcgtgggcanggtgttcaccatgctcgacccatccgggaccgggctcatgggcgttacacacgcttcgagctcccgcgcttcctcaccaaaggactcctatgtggttcaaaaggatgctatcaccgtcgaaaagactgaaaatagcccagatattaggttttttatgggatctgaatgatgcagtatcctatgtaaagcgactaaatgggccaagcggaagggggggggctttgcccccttgaggttacaaaatgaactttcaaggagaaaccccccatggttccg

SEQ ID NO: 71548 - protein, 133 aa, Zea mays
  misc_feature: Ceres CLONE 1553285
  misc_feature (91)..(91): Xaa is any aa, unknown, or other
MPCSSSSSSNPFHSLASAFPFLSSTSPPPSPPASPAPAAPHLAVPLLLPVSSASESRRGAQPLPGTRMVGAGATGGGNMASRGGGARVRGXGVHHARPIRDRAHGRYTRFELPRFLTKGLLCGSKGCYHRRKD

SEQ ID NO: 71549 - DNA, 664 bp, Zea mays
  misc_feature: Ceres CLONE 1553288
  misc_feature (214)..(214): n is a, c, t, g, unknown, or other
  misc_feature (640)..(640): n is a, c, t, g, unknown, or other
ctccccgcggtggcggccgctctagaactagtggatcccccgggctgcaggaattcgtctcacccctagaaaaacaacccacccacctcccactctcgccaccgtgtggtccagacgtccagtcctctaaccgaaccaggaagcaccacaccaggcagcggaagctcgcgctgggatcggctaccaacataatatcgttcctcgcctccctcanctctgaacgagaacgcgaacgcgccctgtgatcactaccccacagcatgtgctcaggaactcgcaagccgtccacaccccctctggcggggggggacgggccaaggaatcctccgccattgccggtgctgctttgaacttgcggcggccgaacaaaatccttggggttcaagggcccccctggaagggcgacaaaacccccaacctttggacaaaccgggtcacttggtaagggcgcctccccccgggggggccggggggcttccccttggggcctcaagggggggacctcccggccatggtgggcggcccccttatcgaaggaaaggggggggtgggggtaaattcttttcccccccccccccgcgggagggccccccccccctctcccccccgaaggaggggccacctcttcttctcttttttnggggggggggggggcccggggggc

SEQ ID NO: 71550 - DNA, 672 bp, Zea mays
  misc_feature: Ceres CLONE 1553292
  misc_feature: Encodes the peptide sequence at SEQ ID NO. 71551
ggagctccccgcggtggcggccgctctagaactagtggatcccccgggctgcaggaattcgtctcacccctagaaaaaaccgagactctctcaattccccactcatatagtcatatttgctcagccttttgcaaacgagttgaaatcaccttgttcaaatcgtcccctcctctctctctctcgctcgctcgccaagcacaatcttctgcgcgttcgtgttgcggatttgttaattggttggtcagctcctctctgacccagaggcaaagccatggctctcacgctgcgttcctcgacgtcgttcctgtcgcctgtggaccccacgtccaagctcctccacaagcccgccgacgaggcgcagccctgctgcgtcgccgtaccccctgcgcccggccgcaggccgcgcgcgctcagggcggccgcggccgcggccgcggcgccctcaccggcgacgggccgcgcgccggcggaagcgggcgagctgctgcacggcggcggcacagagcagcaccacgggcttccgcgcgggcgggtgcccggatacctgatgctgccgctggacacgggggggccaggcggccagctgtcgcggcacgcgcgttggcggccagtctaatgggccttccgggccccgggggggaggcctcatggtgaacttttggtgggccctgc

SEQ ID NO: 71551 - protein, 114 aa, Zea mays
  misc_feature: Ceres CLONE 1553292
MALTLRSSTSFLSPVDPTSKLLHKPADEAQPCCVAVPPAPGRRPRALRAAAAAAAAPSPATGRAPAEAGELLHGGGTEQHHGLPRGRVPGYLMLPLDTGGPGGQLSRHARWRPV

SEQ ID NO: 71552 - DNA, 571 bp, Zea mays
  misc_feature: Ceres CLONE 1553294
  misc_feature (260)..(260): n is a, c, t, g, unknown, or other
  misc_feature (350)..(350): n is a, c, t, g, unknown, or other
  misc_feature (362)..(362): n is a, c, t, g, unknown, or other
ctccccgcggtggcggccgctctagaactagtggatcccccgggctgcaggaattcgtctcacccctagaaaaaccccgccccaccaaacactcccgcagacccacagccccgcccgtccccgtccgtccacagccagctccgcctcccatccagcgcccgtccacagccgccgcagttccagtgagatcgagcgaggtaagcttagatctgagcgatttctctcgcgcgtcgcaggtaaagttcactcgacttcgactnctctcatcctcttctgttcttctggttccgtctctcctcgagcagcagcgagagaccgtgccttttagatcggggctcgatctgctgttnctctcggttggntctagtctagcgtgtacagtactagtcgtaggtggtagccagagaggtctttttcccacctccctggcgcagtgagtccggtccttgaggggatctacccacccatgggatttggttttttaccggggggtggttggggtcccccccaagttttcttccttttgttccctggggttggccttggggggggggggggaaaaaaaaaccca

SEQ ID NO: 71553 - DNA, 425 bp, Zea mays
  misc_feature: Ceres CLONE 1553301
  misc_feature (222)..(222): n is a, c, t, g, unknown, or other
  misc_feature (325)..(325): n is a, c, t, g, unknown, or other
  misc_feature (327)..(327): n is a, c, t, g, unknown, or other
  misc_feature (328)..(328): n is a, c, t, g, unknown, or other
tccccgcggtggcggccgctctagaactagtggatcccccgggctgcaggaattcgtctcacccctagaaaaaaaaccattcaccattctaaaaaaaatccccgatcttactacctttctcctcctctctctcacggtctcacctctagtttccagggatgacaaaaatatgagatcagaattcgattcgtgagcctgtagaaacaaggaatgctccctccnatcccttactaaaattgaaacccacccagcaaaaattcccggggggcaagataaaattccccctttttggggaagaaacggggctttttttaaaaaaaagccncnnacaaaaattggggggggggggccaaagggccccccaagggggggttttccctttttttttgggggggatttttttctgggggggccggggggggggg

SEQ ID NO: 71554 - DNA, 626 bp, Zea mays
  misc_feature: Ceres CLONE 1553302
  misc_feature: Encodes the peptide sequence at SEQ ID NO. 71555
  misc_feature (225)..(225): n is a, c, t, g, unknown, or other
  misc_feature (232)..(232): n is a, c, t, g, unknown, or other
  misc_feature (247)..(247): n is a, c, t, g, unknown, or other
  misc_feature (257)..(257): n is a, c, t, g, unknown, or other
  misc_feature (260)..(260): n is a, c, t, g, unknown, or other
  misc_feature (292)..(292): n is a, c, t, g, unknown, or other
  misc_feature (321)..(321): n is a, c, t, g, unknown, or other
ctccccgcggtggcggccgctctagaactagtggatcccccgggctgcaggaattcgtctcacccctagaaaaaaagaagagtacgcccactcctccggctcttcttctccaccggcaccagtccaccacctcctgccaccgcgcggccccaaacaacccacacgcagcgcagcaatggcgggcaacggcgccatcgtggagagcgacccgctgaactggggcgncgcggcngcggaactggccggnagccacctgnacnaagtgaaccgcatggtggcccaggccccgcanccccgtgttcaaatcaagggctccacctntcgcggtcggcaggtggcccccttcccctccccaagggacccttcgggggtcccctttaaactctaaaaaaaaggcccccccccccttcagggcccacccaaagggatcctccaattgtttccccccggggggaaatatttagggggtaccccaccggttttggggggcccctcccccccccccccaagaaaaggggccccccccccccggggaaagtgttcttggtttctctaccccgggaaatttttttccccccgggagagaagggggaacaccctccccccgaaagaaaccccccccccgg

SEQ ID NO: 71555 - protein, 70 aa, Zea mays
  misc_feature: Ceres CLONE 1553302
  misc_feature: SWISSPROT Homolog: EC 4.3.1.5 Phenylalanine ammonia-lyase
  misc_feature (17)..(17): Xaa is any aa, unknown, or other
  misc_feature (28)..(28): Xaa is any aa, unknown, or other
  misc_feature (29)..(29): Xaa is any aa, unknown, or other
  misc_feature (39)..(39): Xaa is any aa, unknown, or other
  misc_feature (49)..(49): Xaa is any aa, unknown, or other
MAGNGAIVESDPLNWGXAAAELAGSHLXXVNRMVAQAPXPRVQIKGSTXRGRQVAPFPSPRDPSGVPFKL

SEQ ID NO: 71556 - DNA, 677 bp, Zea mays
  misc_feature: Ceres CLONE 1553305
  misc_feature: Encodes the peptide sequence at SEQ ID NO. 71557
ctccccgcggtggcggccgctctagaactagtggatcccccgggctgcaggaattcgtctcacccctagaaaaagcacgcaccccaccccctcctgccgtcctcgatctcgtctcctcctccctacccaatccctcgcggtgggcgagggtggaagcgagtgacgatggcggcgctggaggcggcgagggagtgggcgggctccgtcataccgccggagctcgccgccgccgcggggggagacccgctcgccgcgctggcggccaccgccgcggccctcttcgcagggctgcttattatcgctgtctggttccgatccggaggcgggacgccgtccaagccggtcgccacgccggtacggccaccgccggtcaaggtagacgccgacgccgacgttgatgacggccggaagcgcgtcaccatcttcttcggcacacagactggcaccgccgaggggttcgccaagtccatggcggaggaggcgagggcccgttacgagaaggccgtgttcaaagtggtggatctgggatgactatgctcaggaggacgagggatactaggagaagctgaagaaagaaactgtgggtgctgtttcttcctaacaaccctatgggggatgggggacccacctgatagtggaggcccgattctaccaactggcttaccggggggaaaaag

SEQ ID NO: 71557 - protein, 121 aa, Zea mays
  misc_feature: Ceres CLONE 1553305
  misc_feature: SWISSPROT Homolog: EC 1.6.2.4 NADPH--hemoprotein reductase
MAALEAAREWAGSVIPPELAAAAGGDPLAALAATAAALFAGLLIIAVWFRSGGGTPSKPVATPVRPPPVKVDADADVDDGRKRVTIFFGTQTGTAEGFAKSMAEEARARYEKAVFKVVDLG

SEQ ID NO: 71558 - DNA, 648 bp, Zea mays
  misc_feature: Ceres CLONE 1553311
  misc_feature: Encodes the peptide sequence at SEQ ID NO. 71559
  misc_feature (360)..(360): n is a, c, t, g, unknown, or other
ctccccgcggtggcggccgctctagaactagtggatcccccgggctgcaggaattcgtctcacccctagaaaaattcggtgagccgtgccacggaatcgggagctccaagtgggccatttttggtaagcagaactggcgatgcgggatgaaccggaagccgggttacggtgccaaactgcgcgctaacctagaacccacaaagggtgttggtcgattaagacagcaggacggtggtcatggaagtcgaaatccgctaaggagtgtgtaacaactcacctgccgaatcaactagccccgaaaatggatggcgctgaagcgcgcgacccacacccggccatctgggcgagcgacatgccccnatgagtaggagggcgcggcggcccgcccaaaacccggggcgcgagcccgggcggaacggccctcggtgcagatcttggtggtagtagcaaatatcaaaatgagactttgaagcccaaaaaggagaaaggtccatggtgaacggcactggccatgggtaacccgattctaagggacgggggaaacccggcagaaagcgcgatcacccccgtcccccgaaagggaaatcggttaaaatttccccaaccgggacgtgccggcaaacggcaacctttggaatcccgaaaccc

SEQ ID NO: 71559 - protein, 40 aa, Zea mays; identical to SEQ ID NO: 66130
  misc_feature: Ceres CLONE 1553311

SEQ ID NO: 71560 - DNA, 701 bp, Zea mays
  misc_feature: Ceres CLONE 1553318
  misc_feature: Translation starting site: 355
  misc_feature (285)..(285): n is a, c, t, g, unknown, or other
  misc_feature (288)..(288): n is a, c, t, g, unknown, or other
  misc_feature (291)..(291): n is a, c, t, g, unknown, or other
agctccccgcggtggcggccgctctagaactagtggatcccccgggctgcaggaattcgtctcacccctagaaaaacctagcggccaccacaccgcgacggccgccccgtcgtcggcgccgtccaagggcaagtcgtcggcgccgaaccctagcggcaaccacgctgcgacgccggcgccatcggggacgccttcaaagggcaagtcggcggcagcgcaggccgcggctttgggccacggttcctcctcccaccaccactctgccggcgtggccggtgggtggcnctnacncgtccgccaccaccctcaagcgcaagcgcggcgtcttccagaaagacctgcaacacatgatgtatggctttggggatgatccaaatccacttccagaaacggttgcacttgtgggaagacattgttgtggaatatgtcactgacctggtgcaccaggcgcagaccgttgcctcaaagagggggaagctcctgacagaggattttcttttatcttatacccaggattttcggaaacctggaccgggctactggaataccggccatgaatgaagagctcaagccaagcaagggaaaccttttgacggaaaaaaaaaacacctggcccacaaaaaaaataaggaggttttcccaagccgaaaaaaccggcggtttatttgaacccgtttgtaaaaaggccaggaagtgggtcg

SEQ ID NO: 71561 - DNA, 715 bp, Zea mays
  misc_feature: Ceres CLONE 1553319
  misc_feature (684)..(684): n is a, c, t, g, unknown, or other
  misc_feature (687)..(687): n is a, c, t, g, unknown, or other
  misc_feature (695)..(695): n is a, c, t, g, unknown, or other
  misc_feature (710)..(710): n is a, c, t, g, unknown, or other
caaagctggagctcaccgcggtggcggccgctctagaactagtggatcccccgggctgcaggaattcgtctcacccctagaaaaaacaaacgaaggcgcggagacgtgctgcagagcctgcagaggcttttcttccccccaccacacccatcgcgtgtgagtccacggtgtgatgtcacggagcggtggcggctttcccgattcactgtgcgggagaaatccccgtgcagccttcttccacctcctcctactctccgctattcgtcttcgctgatttctgccgctccaattccatcgcttccctgctttagaaccttctctgctagcttctccccgtcacagcttttgctgcctcgtcatcggcgaccaaaccgccggcgaccggataaactaagccagctccttcgctccgaaagtcgtctctcgtagagagcacttgctcacctgctccccgccccccctctactggcgctggacttgctcggagtggagatccatccggacctcacctggttcgatttcttcatttcgggttcgattcggtttttctatcccagagcgaaagatcaatatcacctgacacaacataacgatttcgtggaagccgaggttgcttctctgctcagtgggtggataactggattgtggattttgctaactacatgctgggttatcagcctatcntanggaaaacnaagaagagaccaccnagcat

SEQ ID NO: 71562 - DNA, 862 bp, Zea mays
  misc_feature: Ceres CLONE 1553320
  misc_feature (36)..(36): n is a, c, t, g, unknown, or other
ggcggggtcgggtggtttctcgtgttatcttctaangaggggggggggaaaggtggtgctcaccgcggtggcggccgctctagaatagtggatcccccgggctgcaggaattcgtctcacccctagaaaaaatctcgaatctggatctccctgctctacccgcatcaccccggcgttgccgggcccttcctgcgacttcccagatcgccgtcggcacctcgtaatcttcgtcatcgcccgcgcttgcgcgccccgtgtctccaccccgttcaccgccgaaccctcggcgtcgtcgtcccacgactcgtgctatccggtcactattggagcgcacccagcccattcgctgcttcagccaccccctcttccttggccggagcccgcgcctcctctctgggcctgggggttctccggttccggggccgcgcttctctgcgggtgaacccaaggcctcagggctggctgccccccgggagatgccgggcccttaggggccccaaccgaaaggcggtcggcgctccttgttttcgggggttggggtccgctgagccactcgtgcggaaaagggagtgccggctggcccttgtcgggactccgcccgccaaaaaaaggctccccccaaaggggggggggtcctgttttcccctctcgttgcagcttggggtgcccgctgagaaccccttcctggggagggttgaagctaccattctgtgacacgccccttctgcccgttcggagataaaactgggcctccacaatgggttgtgtataggataggagcctggcttggcgcttcttttaatgcacgaggcctcgccgataattcctgtggcggtttccatccggctatgggtggtgctgg

SEQ ID NO: 71563 - DNA, 699 bp, Zea mays
  misc_feature: Ceres CLONE 1553324
  misc_feature: Encodes the peptide sequence at SEQ ID NO. 71564
  misc_feature (312)..(312): n is a, c, t, g, unknown, or other
  misc_feature (405)..(405): n is a, c, t, g, unknown, or other
attgctggagctccccgcggtggcggccgctctagactagtggatccccgggctgcaggaattcgtctcacccctaggaaagcgcatccgcatcactgcgtgtcctcctcctctccccctcactggggcgcatccacatctgccaatttctccacctcctcctcctcgcccgtgtgcctcgacatctcgcatccgctccatctatggaaggccaccacgcgccatggatcgccgctctctaccgccacctcaattgaaggttcaccgctctctacgcggattttccccctcctcggggggcgccgtcaatanaaggccctttttctcctctcccattacttctctgcccattactttttttccccccccccccagggggaagaaaggggggattttcttcccttncccccccctctagggggggtcctaaatccccccctccccatcaccccccgcgcgggcccctgccactcccccccttttttgtaaattccgccaaccttgacgtcaacacctcgtcattattggctgtcggtggagtcggcgccccccgcccgagcgcccgtgcagggggggggattgaactctctccttccagccgccgcccctgttaacgccgcttctgtaagtgaaaagccgtcccctcgggacacgagtgctccgtccgccctcgtgccccctttatctccctcctctccc

SEQ ID NO: 71564 - protein, 64 aa, Zea mays
  misc_feature: Ceres CLONE 1553324
  misc_feature (30)..(30): Xaa is any aa, unknown, or other
  misc_feature (61)..(61): Xaa is any aa, unknown, or other
MDRRSLPPPQLKVHRSLRGFSPSSGGAVNXRPFFSSPITSLPITFFPPPPRGKKGGIFFPXPPL

SEQ ID NO: 71565 - DNA, 671 bp, Zea mays
  misc_feature: Ceres CLONE 1553326
  misc_feature: Encodes the peptide sequence at SEQ ID NO. 71566
aaagctggagctcaccgcggtggcggccgctctagaactagtggatcccccgggctgcaggaattcgtctcacccctagaaaaaacagcatctcaagccaccatcgaccttcaagtctcgctacgtatgcagtgcaataaaaaaagcagccgcaatggcgagcagcaccatggccctctcctccacggccttcgccggcaaggccgtgaacgtgccgtcgtcgtccaccttcggcgaggcccgcgtgacaatgcgcaaaacggcggcgaaggccaaaccagcggcggcgtccgggagcccgtggaacggccccgaccgcgtgctgtacctgggcccactgtccggagagccaccaagctacctgacgggcgagatcccgggcgactaccgctgggacaccgcggggctgtcgacagacccggagacattcgccaagaaccgggagctggatgtgatccactcccgctgggccatgcgtgggtgcgctctggctgcatcttctccgagctgctcgccccgcaacggcggtcaagttccgggcgagggccatggtgggttcaagggcactgtttccccaaaaatttttaacctgagggggggggcttggaaaaacccccggggagaacccaaaacccctataaaaaaccccccaaaaaaaatatttgtttgtt

SEQ ID NO: 71566 - protein, 172 aa, Zea mays
  misc_feature: Ceres CLONE 1553326
  misc_feature (65)..(153): Pfam Name: Chloroa_b-bind Pfam Description: Chlorophyll A-B binding protein
MASSTMALSSTAFAGKAVNVPSSSTFGEARVTMRKTAAKAKPAAASGSPWNGPDRVLYLGPLSGEPPSYLTGEIPGDYRWDTAGLSTDPETFAKNRELDVIHSRWAMRGCALAASSPSCSPRNGGQVPGEGHGGFKGTVSPKIFNLRGGAWKNPRGEPKTPIKNPPKKIFVC

SEQ ID NO: 71567 - DNA, 730 bp, Zea mays
  misc_feature: Ceres CLONE 1553328
  misc_feature: Encodes the peptide sequence at SEQ ID NO. 71568
  misc_feature (647)..(647): n is a, c, t, g, unknown, or other
aaagctggagctccccgcggtggcggccgctctagaactagtggatcccccgggctgcaggaattcgtctcacccctagaaaaaacgccgctgctccaagaaaccaccgccgagcccaaccgcacaagcgcgcgaggcaggagagagagagagagagagaggcggggagcaaaacaatggaggggaaagaggaggacgtgcgcctgggcgccaacaagttctcggagcgccagcccatcgggacggcggcgcagggcgccgctgacgacaaggactacaaggagcccccgccggcgccgctgttcgagcccggggagctcaagtcctggtccttctaccgcgcgggcatcgccgagttcgtcgccaccttcctcttcctctacatcaccatcctcaccgtcatgggcgtctccaagtccacctccaagtgcgccaccgtcggtatccagggcatcgcctggtccttcggaggaatgatcttcgcgctcgtctactgcaccgccggcatctccggaggacacatcaacccagctgtgactttcgggctgttcttagccaggaagctgtccctgactagggccctcttctacattatcatgcaatggctgggtgccctctgtggagctggagtggtgaagggcttccancaggaacttttcaggggccacgggtgtgggcgccaatgtttgtcgcacctggctaccaccaagggtgatggcccttgccgctt

SEQ ID NO: 71568 - protein, 184 aa, Zea mays
  misc_feature: Ceres CLONE 1553328
  misc_feature (47)..(182): Pfam Name: MIP Pfam Description: Major intrinsic protein
  misc_feature (157)..(157): Xaa is any aa, unknown, or other
MEGKEEDVRLGANKFSERQPIGTAAQGAADDKDYKEPPPAPLFEPGELKSWSFYRAGIAEFVATFLFLYITILTVMGVSKSTSKCATVGIQGIAWSFGGMIFALVYCTAGISGGHINPAVTFGLFLARKLSLTRALFYIIMQWLGALCGAGVVKGFXQELFRGHGCGRQCLSHLATTKGDGPCR

SEQ ID NO: 71569 - DNA, 636 bp, Zea mays
  misc_feature: Ceres CLONE 1553329
  misc_feature: Encodes the peptide sequence at SEQ ID NO. 71570
  misc_feature (529)..(529): n is a, c, t, g, unknown, or other
ctggagctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggccaggagcatactgcgagcagaccagcgctgggtgctgcaagccgaccaccggcgtctcgccggcgcgcgacttctacataacgggcttcaccgtccttaacgcgaccaccgacgctgcagtgacgggatgcagcaacaaagttccttacgaccctaacctgattaccggcatccaaggcctgaatcagtactggagcaacatcaggtggccccatgcaacaacgtggcagaagcagcttggaagaaacgcctggaagaaggcctgcgcctgctccggcctcagcgagaaagactacttcgagactgccctctccttncgtagcgggatcaacccactccgttcgcctcaaaacccaaaggtatcggagcccggaattccggccctacgggccccaaagggggaacccccaaagggcccttaaaa

SEQ ID NO: 71570 - protein, 177 aa, Zea mays
  misc_feature: Ceres CLONE 1553329
  misc_feature: SWISSPROT Homolog: EC 3.1.27.1 Ribonuclease T(2)
  misc_feature (143)..(143): Xaa is any aa, unknown, or other
MASCRMALLLGLLLLVVASPAIADDDSGIYYQLALMWPGAYCEQTSAGCCKPTTGVSPARDFYITGFTVLNATTDAAVTGCSNKVPYDPNLITGIQGLNQYWSNIRWPHATTWQKQLGRNAWKKACACSGLSEKDYFETALSXRSGINPLRSPQNPKVSEPGIPALRAPKGEPPKGP

SEQ ID NO: 71571 - DNA, 649 bp, Zea mays
  misc_feature: Ceres CLONE 1553331
  misc_feature: Encodes the peptide sequence at SEQ ID NO. 71572
ctccccgcggtggcggccgctctagaactagtggatcccccgggctgcaggaattcgtctcacccctagaaaaatcccggcccttcctttccttctcgcgcgcgaccaaataactcctcactaaaaccctagggctcccggccgccactgcctacgccgtcgccatggagaccctcaagcgcaaggccgtggacagccccggagacgcctaccaggcctcttctctcaagccgccgctcgccgccgccgccgtggagcctcgcgctccgaccaccctcgcggccgccgaaccagtcgcttgcgtgcacgacgtctcctaccccgagggctacgacccatccgcctctacgtcccgcgccatttgcggcggagctgatgcctctgagccagcaaagaaagtttcttttcagctcgaccccttccagccgaaggcatacgctggctcgacaatgtgaatccgtcatggttcagctcatacgtcagcgggaaaaacagtagtcgccgtgtatgcaataacgatgtcttttcccaacccaaagcggggcatttaacttccccaatcagggccttgaacacccaaaagcccggggttccaaaaaaaaattccctgatgttggccccagaccggggattcccaattggccccaag

SEQ ID NO: 71572 - protein, 96 aa, Zea mays
  misc_feature: Ceres CLONE 1553331
METLKRKAVDSPGDAYQASSLKPPLAAAAVEPRAPTTLAAAEPVACVHDVSYPEGYDPSASTSRAICGGADASEPAKKVSFQLDPFQPKAYAGSTM

SEQ ID NO: 71573 - DNA, 962 bp, Zea mays
  misc_feature: Ceres CLONE 1553331-R2
acgattgggtacctcgagcgtctcgttttttttttttttgcagcaagggggtatcacttccccctggagcgtttgcctccgcggaaaagttcccgggttcgttcgctttattttcgatggggtaaagccttccaggttgcaaaaaaggcaccccttgtttgggaaaaaaaacaatttctgggacatccttctttaaacccctgggctgctgtaaaaaatcgaaataatccttcaagctccccgcttcctcaattaccatggaatttccccctgatcccagtcccttgatttgcttcccaaaatcaggaaaaaaacggccaccctgaaattgataaaatgaatgccggaggagcttttctggatccccatcctcaaatcgcatttgatttaacaccatattgtacctcaaataaaaggcactgttcaaactatctgcacttcctttcagcatctttttggcagttaaaggttccattttcccgtctcccatcagtttacaaatcccacgcaaatcattacctcgacaaccagcacggccactcttttggatgtactctccactcgacaaccatttaaatcggtctccgtcaaattttcgcacattggtaaacacaacagtctttgcgggcttgttcaaaacaatactgaatgtttctgtggcaaacaaacacttgatgaggccctcctgaaaagtatcccaatgacttcctttaaaatagggcacagaccagaatgatgcacgcccatgcccccgtttcagtaaggggagcatgtttgaaacctgaggaagctttttgccttcttcaaaaagcatttccttagccctccaaaaaattgtttcgaagttggcctttcccccatccccatttaaagccattttaaccatttgcaaagcaagaaattcccattcccttttggcaaagctaaaaagttttccggatccttttgggcgctaattatct

SEQ ID NO: 71574 - DNA, 967 bp, Zea mays
  misc_feature: Ceres CLONE 1553331-R
gagacatgtgtctatatgtgagaaagagctgagtgcgtctgactatattcaatgcggacaagccttccaggttgcaagaaaggcagcacatgtttgggagagagaacaatatcatggacatccttctttaaactcctgtgctgctgtaagagatcgtaataatccttcaagctctccgcttcctcaattaccatggaatttctctctgattccagttccttgatttgcttctcaagatcaggaagagaacggtcagcctgaaattgataaaatgaatgccggaggagcttttctggatccccatcctcagatcgcatttgatttaacagcatattgtagctcagatgaaaggcactgttcaaactatctgcacttcctttcagcatcattttggcagttgaaggttccatttttctcggctaccatcagtatacagataccacgcagatcaatacctcggacgaccagcacggccactcatttggatgtactctccactcgacaaccatctgaatcggtctccgtcaaattttcgcacattggttaacaccacagtcttttgcaggcttgtttcaaaaaatactgaaagggttccgtgggaaaaaaaccacttgattgaggcccctcctgaaaaaaatatctcaagtgagcttcccttttaaaaatggggcaccggaaccagaaagggatgcacccccatgggcccccgttttaaataaagggggagcattggtttaaaacccggagggaacgctttttgttcttcctcagaaaaagaatttcccttgcgccctccaaaaaatatggttccatgtttggcccttataaaatacctcatttcaatcccatcttttgccttttggcttagcaaggaaatccgcgttccccttttgccaaagcgcaaaaattttgccgggcctatttggggcttaattatttttctcccaggcttgaaaatggcacgtcc

SEQ ID NO: 71575 - DNA, 643 bp, Zea mays
  misc_feature: Ceres CLONE 1553334
  misc_feature: Encodes the peptide sequence at SEQ ID NO. 71576
ctccccgcggtggcggccgctctagaactagtggatcccccgggctgcaggaattcgtctcacccctagaaaaaatgggccactactgctagagctagtgctagtagcagcgtggagaggcagagaagtagccaaagccaagtaggaggaggaggaggagcggcaggtagggcgcggggcgagagcttgacgcggcaaccaccgctgcactgcactgcactgcaccccctagctcctccgagctcagcagctcgctcgcggcaagtcgccatccatgtcaggaaagatttatctggtcggccgatcgagctcctctccttctccgaagcactgaagctccagcggctgccctgcctgacagccacttcgcacgaccaaattaaaaagcgcgggcgatcgagatggcgcacgaccccagcctgggcttcgcggactacttctcggcggcggcggcggctgcggcggcgggcgcccacgcgatggacgacgacgtcggggcgccggagctctatggcctgcatgccgacgacatggagttcctcggcatgcgtggcctggccgccatgcccccgtgcgggggaaacacccaccaccacaacataaggggcacagcaagggccgttgcgctcctcgacgacaagaa

SEQ ID NO: 71576 - protein, 80 aa, Zea mays
  misc_feature: Ceres CLONE 1553334
MAHDPSLGFADYFSAAAAAAAAGAHAMDDDVGAPELYGLHADDMEFLGMRGLAAMPPCGGNTHHHNIRGTARAVALLDDK

SEQ ID NO: 71577 - DNA, 729 bp, Zea mays
  misc_feature: Ceres CLONE 1553337
  misc_feature: Encodes the peptide sequence at SEQ ID NO. 71578
  misc_feature (1)..(1): n is a, c, t, g, unknown, or other
  misc_feature (492)..(492): n is a, c, t, g, unknown, or other
  misc_feature (605)..(605): n is a, c, t, g, unknown, or other
  misc_feature (638)..(638): n is a, c, t, g, unknown, or other
naaagctggagctccccgcggtggcggccgctctagaactagtggatcccccgggctgcaggaattcgtctcacccctagaaaaactcctgctccctccaacggacttgaccactaaaagctaagcacacccccggccatggcgctcgcgtccacctccgccaccgcgcccgctgccgtgctcaagaccccgttcctcggtgccaggcgcgcgctcgccaatgccgccgcgcccaagcccgcgccgcgccgcgcgctcctcgccgtcgccgcggccgccgccaagaagtcgtggatccccgccttcaagagcgacgccgagttcatcaacccgccctggctcgacggatcgctccctggcgacttcgggttcgatccgctggggctgggcaaggacccggcgttcctcaagtggtatcgggaggcggagctgatccacgggcggtgggcgatggctgccgtgctgggcatcttcgtggggcaggcctggagncgcatcccgtgcattcgagccggcgccgacccgggcgccatcgcgcccttctccttcggctcgctgctgggcacgcagctgctgctcattggggtggggtgaagtcgaaacgntggggtggacttctttcaaccggaaatcccaantcccgccagggggcccacacgactggtcccgcactgccgagaacttcggccaacttcaccggcgaccagggctacccccggcggcaagttc

SEQ ID NO: 71578 - protein, 151 aa, Zea mays
  misc_feature: Ceres CLONE 1553337
  misc_feature (63)..(152): Pfam Name: Chloroa_b-bind Pfam Description: Chlorophyll A-B binding protein
  misc_feature (118)..(118): Xaa is any aa, unknown, or other
MALASTSATAPAAVLKTPFLGARRALANAAAPKPAPRRALLAVAAAAAKKSWIPAFKSDAEFINPPWLDGSLPGDFGFDPLGLGKDPAFLKWYREAELIHGRWAMAAVLGIFVGQAWXRIPCIRAGADPGAIAPFSFGSLLGTQLLLIGVG

SEQ ID NO: 71579 - DNA, 806 bp, Zea mays
  misc_feature: Ceres CLONE 1553339
  misc_feature: Encodes the peptide sequence at SEQ ID NO. 71580
  misc_feature (35)..(35): n is a, c, t, g, unknown, or other
  misc_feature (36)..(36): n is a, c, t, g, unknown, or other
  misc_feature (42)..(42): n is a, c, t, g, unknown, or other
tgttttgtggttttttttatctgtttttgtattannttttgnggggggtgggtggggctccccgcggtggcggccgctctagaatagtggatcctccgggctgcaggagttcgtctcacccctagaaaagtcatcttgtcctgatcctctggtccgtggccatggcgtcgtccatgctctccgctaccaccgtgccactcctgcaggttgtcggcctgtcccagttctccgggctcacgagctccgcgtctctgcccatgcgccggaatgccacctccgacgacttcgtgtccgccgtctccttcaggacccacgcggaggtcacgagcggggggccgcggcgggcgcccacggacgcgaagctgagcgtggccatcagtgggttcggccgcttcgggcgcaacttcctgccgtgctggcccgggtgcagcgacgcctcgcccctcgacatcatcgccatcaacgacaccggaggcttcaagcaggcgtcccacctgctcaagtacgactccacgctcggtattcttcaatgccgacgtcaagccccgtctgctacaacgccatcttccctcgaccggcagggtcatcagggtcggtgtcccaaccgcaaccccagaaaccttgccttgggggtaaggctcgtcatccacctgggtcatcgaagggctaccggtttcctttctcgaaccgcctaggggcgcggtgaaaactctattccaggccgtgggcccatgaaaggggcttattctacggcgccccggggaaggggtacattccccccacttatcatcctgggtggggataga

SEQ ID NO: 71580 - protein, 177 aa, Zea mays
  misc_feature: Ceres CLONE 1553339
  misc_feature (68)..(178): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MASSMLSATTVPLLQVVGLSQFSGLTSSASLPMRRNATSDDFVSAVSFRTHAEVTSGGPRRAPTDAKLSVAISGFGRFGRNFLPCWPGCSDASPLDIIAINDTGGFKQASHLLKYDSTLGILQCRRQAPSATTPSSLDRQGHQGRCPNRNPRNLALGVRLVIHLGHRRATGFLSRTA

SEQ ID NO: 71581 - DNA, 726 bp, Zea mays
  misc_feature: Ceres CLONE 1553340
  misc_feature (615)..(615): n is a, c, t, g, unknown, or other
  misc_feature (643)..(643): n is a, c, t, g, unknown, or other
  misc_feature (726)..(726): n is a, c, t, g, unknown, or other
ctccccgcggtggcggccgctctagaactagtggatcccccgggctgcaggaattcgtctcacccctagaaaaagattgcctggagggaagcggatgggggctggccaccgccaccggcagtatggggtcctgcctgcatcgccctctggctggtcccaggtatgggctgtgaccgacagagcttctgtcatctcctccctgctcaatgtacgaccacgcgccctccaattctgagctcctatgcgcgcgaaaattcttctgcgctgcaccctgatgacccctgctctgctcccgagatccctcccatggctggtgttcggtgcctggggtcctcccaacgaactccctgagcctggcactttcctgggtgccggcgccgagggaattcccctagtgttcccccccccccgcagccttccctgccggtctgggctcccccttctccatggggcaggagctttcttcattcttccttgcgccacaccggccttttcaggtgcttcccgcgtcgcgtccccacccatgtggggagaattcccactcccttggccgacctcccagtgggcgaaggccccatccccccagattcccccccgaattctcccctacccacnctccacccggcggggtttatcccccgcncgccccgttggtccccgtgaaaatccggcccgccttgcccctggttcacaacggcccacgctgaagggccattgtaaacatcn

SEQ ID NO: 71582 - DNA, 574 bp, Zea mays
  misc_feature: Ceres CLONE 1553341
  misc_feature: Encodes the peptide sequence at SEQ ID NO. 71583
tccccgcggtggcggccgctctagaactagtggatcccccgggctgcaggaattcgtctcacccctagaaaaaacgtgtaatcgccgaaaaccccaccgccagtcaccactattcatcggccatggccgggcggtggctccaggtgactctcgccctcgtcgtcgtcacggcggcggcaacgacgctgtcctcagcccagcagacggcagcatcgttcccggccatgcccagctgcccgccggcgccgctcagcctgtccccgtgcatcggctacgtcttcggcgtcggctcggcgacgctcgcctcctgctgctcccagctccgtggcttcctccaggcccaggcgccgtgcatctgcgccgcatccaagctcgcgcccagccccatcggcgtgttcctcggccaggcgcagggcatgatccccaacgtctgcgacctgcccagcccatgcaaatgccgggccccccccggggaaagggtttccaaacccccccgggggggaaaaacttttccccccggggtttttaaaaaaaaaaaaaacttcccggggagttttaaaacccccctcaacgg

SEQ ID NO: 71583 - protein, 150 aa, Zea mays
  misc_feature: Ceres CLONE 1553341
  misc_feature (38)..(110): Pfam Name: Tryp_alpha_amyl Pfam Description: Protease inhibitor/seed storage/LTP family
MAGRWLQVTLALVVVTAAATTLSSAQQTAASFPAMPSCPPAPLSLSPCIGYVFGVGSATLASCCSQLRGFLQAQAPCICAASKLAPSPIGVFLGQAQGMIPNVCDLPSPCKCRAPPGERVSKPPRGGKTFPPGVFKKKKNFPGSFKTPLN

SEQ ID NO: 71584 - DNA, 717 bp, Zea mays
  misc_feature: Ceres CLONE 1553342
  misc_feature: Encodes the peptide sequence at SEQ ID NO. 71585
  misc_feature (352)..(352): n is a, c, t, g, unknown, or other
  misc_feature (362)..(362): n is a, c, t, g, unknown, or other
  misc_feature (444)..(444): n is a, c, t, g, unknown, or other
  misc_feature (460)..(460): n is a, c, t, g, unknown, or other
aagctggagctcaccgcggtggcggccgctctagaactagtggatcccccgggctgcaggaattcgtctcacccctagaaaaaagcgcccgtcgcctccctttccccttccctccctccctctccccgcgggccgccagaggcaatttcgccctcgattcgaccccgattcgtccgcccgcgaccgggattccctccgccaagcgcggatctgaacgctgcgctccgtgtcgccgctcgaatccgccatgaagggggccaaatccaagggcgccgccaaggccgatgccaagctggcggtgaagagcaagggggcggagaagcccgccaagggcaggaaagggaaggccggncaggaccccnacaagcctaagagggctcccagcgctttctttcgtgtcatggaggaatttcgcaaggagttcaagggagagaaccctaagancaagtctgtcgctgcngtggggaaagctgctggcgacaggtgggaatcccctgagcgagtccgacaaggctccctatgtagccaaagctaaacagctccagctcgagtaacacaaggccttcgctgcctaacaacaagcgcaagagccctggcactaaaaagggtccctggcccggggggaaaaagggggaaatttaaaggggtgtctgacaattcccaatccgagggcccatggccaggaattttaaaaaaggggatgggggggggataaaa

SEQ ID NO: 71585 - protein, 95 aa, Zea mays
  misc_feature: Ceres CLONE 1553342
  misc_feature (41)..(96): Pfam Name: HMG_box Pfam Description: HMG (high mobility group) box
  misc_feature (39)..(39): Xaa is any aa, unknown, or other
  misc_feature (66)..(66): Xaa is any aa, unknown, or other
MKGAKSKGAAKADAKLAVKSKGAEKPAKGRKGKAGQDPXKPKRAPSAFFRVMEEFRKEFKGENPKXKSVAAVGKAAGDRWESPERVRQGSLCSQS

SEQ ID NO: 71586 - DNA, 723 bp, Zea mays
  misc_feature: Ceres CLONE 1553344
  misc_feature: Encodes the peptide sequence at SEQ ID NO. 71587
ataagctggagctccccgcggtggcggccgctctagaactagtggatcccccgggctgcaggaattcgtctcacccctagaaaaaacgcctcccaacctcctctgctctcccccacctcccggtccggcagcagagagcgggggtgcagagagatcgagatccggaggccgcgagtgggagcgccaccaccagcgactgcggcaatggcgggcacggtgacggtcccggggtcgtcgaccccctccacgccgctgctcaaggacgagctcgacatcgtgatcccgacgatccgcaacctcgacttcctggagatgtggcggcccttcttccagccctaccacctcatcatcgtgcaggacggcgacccgaccaagaccatcaaggtgcccgagggcttcgactaccagctctacaaccgcaacgacatcaaccgcatcctcgggcccaaggcctcctgcatctccttcaaggactccgcctgccgctgcttcggctacatgggctccaagagaaagtacttctacaccttccaacaaaaaaagggttttttttttcccaagggcccccccccggggaagggaaataaaaggggccccttggaaacaccaccttttttagagaaaaaaaatttttttctgggcgtttatttcccacccgggtgtttttttttttttttttttaataaacaacctcttgggggagacaacccaacccctctctgg

SEQ ID NO: 71587 - protein, 173 aa, Zea mays
  misc_feature: Ceres CLONE 1553344
  misc_feature (13)..(173): Pfam Name: RGP Pfam Description: Reversibly glycosylated polypeptide
MAGTVTVPGSSTPSTPLLKDELDIVIPTIRNLDFLEMWRPFFQPYHLIIVQDGDPTKTIKVPEGFDYQLYNRNDINRILGPKASCISFKDSACRCFGYMGSKRKYFYTFQQKKGFFFPKGPPPGKGNKRGPLETPPFLEKKNFFLGVYFPPGCFFFFFFNKQPLGGDNPTPLW

SEQ ID NO: 71588 - DNA, 663 bp, Zea mays
  misc_feature: Ceres CLONE 1553347
ctccccgcggtggcggccgctctagaactagtggatcccccgggctgcaggaattcgtctcacccctagaaaaagctcgcttctcttctttgccgtccagtcgtcgtcgtctcctcgtgggctcgcggccgtggcgcattaaggattcgaacccactcgtcaaagagaatccatccgcaagatcgaaagcaacagcagctgattattaaagccccgctttttcaaaagccgcaagggctatacccctagttgtaaattggcggaaaggaaattcgcctcctcttttccaattgcagctgcagttgcgtgctcgagaggggtgaagaacctagaagccctgccagcgcgcggcgccagcgccttgtttactctgcgacggcacgcggattgcattggtactgttcttctcctgatcacacacatgacaagggtcatccatgactccggagatgacatgcagaaaggagcacttgatttggtctcatctgatgttattttccccaagggcatttcccagactataggattggacccaacaccaaatcatttttcagaggagaccctggagctgtacttctcaggagatggttcaaaggaaacaccgaacctgctaaacaccacaacgtctttctgtggtgatctcaggaaaatttggaaaggggt

SEQ ID NO: 71589 - DNA, 685 bp, Zea mays
  misc_feature: Ceres CLONE 1553349
  misc_feature (278)..(278): n is a, c, t, g, unknown, or other
  misc_feature (279)..(279): n is a, c, t, g, unknown, or other
  misc_feature (295)..(295): n is a, c, t, g, unknown, or other
  misc_feature (296)..(296): n is a, c, t, g, unknown, or other
ggagctccccgcggtggcggccgctctagaactagtggatcccccgggctgcaggaattcgtctcacccctagaaaaagagctccgtcttgccttctcttctctacctgccgcacccgcacagccacagccaaccacacaccccacatcacaacagctccctctgcatctccgcctcgtcgccgtcgtctgcctgcacaaccttcttcttcatctctctctcttcttccgctgccaccctcccagcaccgagggaaggcaagcccacccaggaatctnncgtccgctcccgggcnngcgtccttctcataatcgcatcggatctgtattgggttttcagtaaagagcagaaaacgccttagggaatgcagaaagatgggcttgcacgtcaaagagctactttgtgaaggacttggggaggaaaaccacgcctaatttttattccttggcacccttttgatgacttccaaacctcagaataaccgttttttcccccccggggctttcccaaaaggggtttcaaattggcgggtccccccccctttttaaaaacccactcccgggggagaaaggggggaaatttttcaccccccccccacacccttttgggggggcaaaaaattttttttttttccggggaagagaaaaaaaaaagaaccctttggtgtgaacaccccccacccccc

SEQ ID NO: 71590 - DNA, 687 bp, Zea mays
  misc_feature: Ceres CLONE 1553353
  misc_feature: Encodes the peptide sequence at SEQ ID NO. 71591
  misc_feature (311)..(311): n is a, c, t, g, unknown, or other
  misc_feature (314)..(314): n is a, c, t, g, unknown, or other
  misc_feature (353)..(353): n is a, c, t, g, unknown, or other
aacgtctggagctccccgcggtggcggccgctctagaactagtggatcccccgggctgcaggaattcgtctcacccctagaaaaaacgttgcccttctcttcccactcgcctccgctcaccttgcctcgatcgttccaggagtaataaaacactaaaatggcgatggcggcggcgaggagagcgctcctggcccacctccgcgtgccggtggtccaccctgcagcggcggcagcgaccatccccgcggcagggcggctcctgtcgtcgacgacggagagaaaggtctcgctcctcgacaagggcgaggtcnctnaccgtgtcttctccctcgtcaaaaatttccagaaggtcnaaacttctttgcccccccccccgggggttgttaggagggacctttaactttatatctttcacccttgggagatcgtgaatgggtttaaggaaggatttcccccccaacatcctggacaacgaaacatgaggaaattggtccccatccgggaccgcgggtgggatgtcgcggccctcccctcgcctcctaccaaaatgacaggggttccgttttcaggcgcagtttcggagagggggtttaagcgcccccgaaacttcaatccgacccgggccgagcgaactcgctctctttgcttcccgccgacggcagcgaaggtaaggtctacccccctccc

SEQ ID NO: 71591 - protein, 80 aa, Zea mays
  misc_feature: Ceres CLONE 1553353
  misc_feature (52)..(52): Xaa is any aa, unknown, or other
  misc_feature (53)..(53): Xaa is any aa, unknown, or other
  misc_feature (66)..(66): Xaa is any aa, unknown, or other
MAMAAARRALLAHLRVPVVHPAAAAATIPAAGRLLSSTTERKVSLLDKGEVXXRVFSLVKNFQKVXTSLPPPPGVVRRDL

SEQ ID NO: 71592 - DNA, 703 bp, Zea mays
  misc_feature: Ceres CLONE 1553354
  misc_feature: Encodes the peptide sequence at SEQ ID NO. 71593
tcccccgggctgcaggaattcgtctcacccctagaaaaacgttgcccttctcttccccactcgcctccgctcaccttgcctcgatcgttccaggagtaataaaacactaaaatcgcgatggcggcggatgaggagagcgctcctggcccacctccgcgtgccggtggaccaccctgcagcggcggcaccgaccatccccgcggcagggcggctcctgtcgtccacgacggatagaaagggttcgttcctcgacaaggcgaaaattccctgacccgtgtcctctcacgtcttcagaacttgcagaaggtcggaaccctcacacgccgaccccccaggggctggggttggcagaaggggaccttgcgactttgatagacgtggccccccccccccaaacacctttcaacggcgtttttggagggaaggaattttccttttttgtggattccctccacccacccaaagcgagcaaaaatatctcgcccgcccttccgaggaacaggggggggtgtagtctcaaatagccctcccccctccgccgcggccaaaaagaaaaaggatttctcctttttatctccgcaatctccaaaacgccggcttatagcgtcccacaaacaccacctcacacgcggagatattaaggttcttcctcaagccttcccgggccacccaagtagggaaatgctttgttccccacaccgtg

SEQ ID NO: 71593 - protein, 47 aa, Zea mays
  misc_feature: Ceres CLONE 1553354
MRRALLAHLRVPVDHPAAAAPTIPAAGRLLSSTTDRKGSFLDKAKIP

SEQ ID NO: 71594 - DNA, 640 bp, Zea mays
  misc_feature: Ceres CLONE 1553356
  misc_feature: Encodes the peptide sequence at SEQ ID NO. 71595
  misc_feature (393)..(393): n is a, c, t, g, unknown, or other
tggagctccccgcggtggcggccgctctagaactagtggatcccccgggctgcaggaattcgtctcacccctagaaaaaattgttcgcgtcgtccgccttctctctctctctaacccactgccagccacctctgcgaccgtcgcgaccactcgccaagtaaattttcttccgcccacctgactacgcctcgacctcggcctcggcgccgcctccgtccgccggacgcggcagccatggcgccagcggtggggctcaagcgctccgccacgcagaccatcactctgccgccgcccgacacgcggctggctgtgcgcgatgtcatgcgctccacgatcccgtcgcagcccgccgtggcgccggcgtccccggagaggcaggcgcccgccgcggcntttcaggggttcctgtgcctggaagaggtggacggaaagccgtggacctcctgggggacggggggggccccaaagggaagaaccagggccggggcctccccccctggggccccccctcgggggccgtccccttcaatcccccccttcccccctgcgaagaaaaaaaggggctttccaaaaaacatatgggggggcccgaaaaggggttccaaaaacggggttaccccctccctaggggcccttacgg

SEQ ID NO: 71595 - protein, 135 aa, Zea mays
  misc_feature: Ceres CLONE 1553356
MAPAVGLKRSATQTITLPPPDTRLAVRDVMRSTIPSQPAVAPASPERQAPAAAFQGFLCLEEVDGKPWTSWGTGGAPKGRTRAGASPPGAPPRGPSPSIPPFPPAKKKRGFPKNIWGGPKRGSKNGVTPSLGALT

SEQ ID NO: 71596 - DNA, 631 bp, Zea mays
  misc_feature: Ceres CLONE 1553357
  misc_feature: Translation starting site: 147
  misc_feature (416)..(416): n is a, c, t, g, unknown, or other
  misc_feature (417)..(417): n is a, c, t, g, unknown, or other
  misc_feature (529)..(529): n is a, c, t, g, unknown, or other
tggagctccccgcggtggcggccgctctagaactagtggatcccccgggctgcaggaattcgtctcacccctagaaaaaaaaaggaccaacgtgctcgatctccatctcgaccgtcgctcaccgggaagctacgctacgacgaagcatggcgtccgtcaccgcccgcgccccggtcgcagccctgcgcccgtcgtcgtcgtcggccttccttggccactctagccgcctcggccgcactgctaccgcgtcgccgacgaggcgcagcctcaaggcggaggccaagggcgagtggctcccgggccttccctcccccgcctacctcgactgcagcctgccgggtgacatgggctcgacccgttgggcctggcgaggacccggagacctgaggtgtacgtgcaagcgaactggtgacggnncgtgggcgatgcttggcgtggcccggatgctgatccgggagtgctgaccagggcgggctgatcacccccccgcaatggtacaccccggaaatcggagtacttccggtcctcntcaaacctgttcgggatccagttcacccggttcactactggaaatcccggggggggaaggaaattaaaaaaccccgggggggttaaccagggcccccttttt

SEQ ID NO: 71597 - DNA, 697 bp, Zea mays
  misc_feature: Ceres CLONE 1553358
  misc_feature (395)..(395): n is a, c, t, g, unknown, or other
tggagctccccgcggtggcggccgctctagaactagtggatcccccgggctgcaggaattcgtctcacccctagaaaaagcagcactagcactggtaccagcaaccttcacgagctgcgtggtgaggttgaccaggactccttccggatcctgaaataaggccaccgctcgtttcctctccacctccctcctccttcactccctccccttgcgtttagcctcccgctgttgtggagccgcgggccattcccaaccatcgttgcggtggtggccggtattggccgacacccatgggcatccaggtcgcggcggtcgtgatcccgccgccctgctcttctccttcctcctctccggcggtcccctccctcctcgggcaggggcggggtcgcccccanaatgccctttcttggcgcccggcttggcaaggacccaatcctcccctggctttcctggaaccccccccgccctcggccgggggccccgcggggaaacccccaattcaggcccccttttctgcccaagcttcaaaagagtttggggaacaccccccgggaaccattaagaatttctccggaaagaaccccggggcccccgggggggctcccccccccgggccccgcgcgcttttcgggtgtgccccgaaaatcgtctaaaccaaaacccccaatctccctcgggccccccccgtcccccccgc

SEQ ID NO: 71598 - DNA, 675 bp, Zea mays
  misc_feature: Ceres CLONE 1553360
  misc_feature: Encodes the peptide sequence at SEQ ID NO. 71599
  misc_feature (521)..(521): n is a, c, t, g, unknown, or other
aaagctggagctccccgcggtggcggccgctctagaactagtggatcccccgggctgcaggaattcgtctcacccctagaaaaactcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggacctgcaattgctgcaactgtaggtgtggcagttcctcaagtcgaggagaagactatcgccgtgcagcctatgcatgtcgctgaaaccagcgaggctgctgctgttatcgcgaaggccaatgaatgcccaaacctgtgcgcaacctgtaggaagcgttgttggttgacggntttttactgccgatgcgggaaccacttactggttcgatgccaccggtacccccgaaaaaaacgaatgggccaatttcaaaattttcaaaactgggggcttggggagccctttttccccaaagggccaaacccctgggtgggtaaaaaaacgcct

SEQ ID NO: 71599 - protein, 174 aa, Zea mays
  misc_feature: Ceres CLONE 1553360
  misc_feature (14)..(38): Pfam Name: zf-A20 Pfam Description: A20-like zinc finger
  misc_feature (123)..(123): Xaa is any aa, unknown, or other
MEHKEAGCQQPEGPILCINNCGFFGSAATMNMCSKCHKEMIMKQEQAQLAASSIDSIVNGGDNGKGPAIAATVGVAVPQVEEKTIAVQPMHVAETSEAAAVIAKANECPNLCATCRKRCWLTXFYCRCGNHLLVRCHRYPRKKRMGQFQNFQNWGLGEPFFPKGPNPWVGKKTP

SEQ ID NO: 71600 - DNA, 715 bp, Zea mays
  misc_feature: Ceres CLONE 1553361
  misc_feature: Encodes the peptide sequence at SEQ ID NO. 71601
  misc_feature (279)..(279): n is a, c, t, g, unknown, or other
  misc_feature (280)..(280): n is a, c, t, g, unknown, or other
aaagctggagctcaccgcggtggcggccgctctagaactagtggatcccccgggctgcaggaattcgtctcacccctagaaaaagctgcacatgcactcctcctctcttgcccaccagcgactcccgtagctggaactcgctcgtcaaaaggaaaagaaacacttcgcttcagctggttgacagacgactcagagcaaaatgggtatactggtgattacggtggacctagactgctgtcgctgcagagccaagatcaccaaggtcctggactgtctcannagagagttctgcatcgagaaagtggagttcgatgacaagaaggacaacaaagtggtggtggtgcgtgggaagttcaacgccaagaaactctgcaagaaggtgtgttcaaaggccgggagatcgtgaaggggaatgtcatccctgaggggtgccaatgccacccccccccaagaatgccagcctgaagcccccaaattgttccaatggacaaggggcagcccaagcccaagcttgaccccccaatatgtttcccttggaaaaagggaaaccccaagcccaagcctgaccccccaaaattgtcccccttggaaaatggaagcccaagctggaccccccaaaacaaaaaaagggcgggggccggtgttccctgaagcctaaccctgacccaaacccttataatttgtgttgttcccccctcccccggaaaaaaaaaga

SEQ ID NO: 71601 - protein, 68 aa, Zea mays
  misc_feature: Ceres CLONE 1553361
  misc_feature (27)..(27): Xaa is any aa, unknown, or other
MGILVITVDLDCCRCRAKITKVLDCLXREFCIEKVEFDDKKDNKVVVVRGKFNAKKLCKKVCSKAGRS

SEQ ID NO: 71602 - DNA, 700 bp, Zea mays
  misc_feature: Ceres CLONE 1553363
  misc_feature: Encodes the peptide sequence at SEQ ID NO. 71603
ggagctccccgcggtggcggccgctctagactagtggatcccccgggctgcaggaattcgtctcacccctagaaaagagcagccccatccatgatagtgctgcctctgagctaaggtgctctcacctacccacccgctcaccctgaccccagtccccgccggcgatggccgcaatgccggcgccggcagcgggcttggccgtcctggtgctcttcgccgccgccctgccggccatttctgccgatgacctcaacaccgacgcacaggcgctgcaggcgctgcgctcggcggtcggccgctccgcgctgccatcgtggaacagcaccacgcccacgtgccagtggcagggcgtcacctgcaaaaccggccgggtggtggagctccccctccccggggccggggctcatggcaacctccccctcgggggtgctcgggcaacctgtcggcccccccgcacccttgtccctccggaacaacgcgctcacggggcccattcccgaacaaccccccccgccggtccgaacctcggggcgaatctacttccgacaaaaaagggttccccggggagggccccaggggcctttttttcaacccagaaaaacccccgggggggtgggaattccgaggggaaacaatttccgcgggaaaaatccccccggaacttcacaaggggggaccccccccgggggccgttttaaag

SEQ ID NO: 71603 - protein, 177 aa, Zea mays
  misc_feature: Ceres CLONE 1553363
  misc_feature (29)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAMPAPAAGLAVLVLFAAALPAISADDLNTDAQALQALRSAVGRSALPSWNSTTPTCQWQGVTCKTGRVVELPLPGAGAHGNLPLGGARATCRPPRTLVPPEQRAHGAHSRTTPPAGPNLGANLLPTKKGSPGRAPGAFFSTQKNPRGGGNSEGKQFPREKSPRNFTRGDPPRGPF

SEQ ID NO: 71604 - DNA, 730 bp, Zea mays
  misc_feature: Ceres CLONE 1553368
  misc_feature: Encodes the peptide sequence at SEQ ID NO. 71605
  misc_feature (509)..(509): n is a, c, t, g, unknown, or other
  misc_feature (705)..(705): n is a, c, t, g, unknown, or other
aagctggagctcaccgcggtggcggccgctctagaactagtggatcccccgggctgcaggaattcgtctcacccctagaaaaaccgctctgaaaacattcccaggcccgcccgacttcctgcccttgtacaacgcacggtccccgtcccaatggcccagactctgtccgccgcctccgagctggccaccctgaagcgcccgttcggcaacgacgggttcggcgatggcagcaacaacggcagcgccaccggcgagaagcccaaggcgcggcggcgggaggcggacccggcggcggcgctggccgcggcgcggcacgagttcggcgagcacggcggcgtgaacatgtccatcgaggcgtcggcgacgttcacggtgatggagccggacacgatgcggcggctgttcgcgggcgagctgggccccgaccgcggcgacatgtacatctacagccggcacttcaacccgacggtgctggcgctggggcggcagatggctgcgctggagggcancgaggcgggctactgcacggcgtccgggatgtccgccatctcgtccgtgctgatgcagctggtgggcgccggcgggcacgtggtggcgtcgcggtgcctgtacggcgggacacacgcgctgctggcccggttcctgccgcgcgccctcggggtgcgcgcccacttcgtggacgccgacaaccaagccgcgtgcgcngccgcggtgtccccgcgagacgcgg

SEQ ID NO: 71605 - protein, 193 aa, Zea mays
  misc_feature: Ceres CLONE 1553368
  misc_feature (49)..(193): Pfam Name: Cys_Met_Meta_PP Pfam Description: Cys/Met metabolism PLP-dependent enzyme
  misc_feature: SWISSPROT Homolog: EC 4.4.1.11 Methionine gamma-lyase
  misc_feature (120)..(120): Xaa is any aa, unknown, or other
MAQTLSAASELATLKRPFGNDGFGDGSNNGSATGEKPKARRREADPAAALAAARHEFGEHGGVNMSIEASATFTVMEPDTMRRLFAGELGPDRGDMYIYSRHFNPTVLALGRQMAALEGXEAGYCTASGMSAISSVLMQLVGAGGHVVASRCLYGGTHALLARFLPRALGVRAHFVDADNQAACAAAVSPRDA

SEQ ID NO: 71606 - DNA, 734 bp, Zea mays
  misc_feature: Ceres CLONE 1553372
  misc_feature: Encodes the peptide sequence at SEQ ID NO. 71607
  misc_feature (469)..(469): n is a, c, t, g, unknown, or other
  misc_feature (514)..(514): n is a, c, t, g, unknown, or other
  misc_feature (574)..(574): n is a, c, t, g, unknown, or other
  misc_feature (591)..(591): n is a, c, t, g, unknown, or other
  misc_feature (600)..(600): n is a, c, t, g, unknown, or other
  misc_feature (692)..(692): n is a, c, t, g, unknown, or other
ggagctcaccgcggtggcggccgctctagactagtggatcccccgggctgcaggatttcgtctcacccctagaaaagctcgctcgccagtcgccaccccgctcacggagacagagaggccgatggcgagctcgctggcccgccctgggagcggcgctgccacgcgcgcgcccacgcgctgcgacccgcacccctgccacccgccgcggtgggacgcccgcggcgctcggcgccctcccgccgcgccgcaccgaacgtttgcaggtgcctagtttcattccgacgttaaagtagcccctacatcggacttcaaggacagtagcaaatctgaaacttggaggatcaagatgctctacgacggtgattgccctctctgtatgcgtgaggtaaacatgctaagagaaagaaacaaatcctatggagcaataaagtttgttgacataagctcgaaagattactctccagatgancatcaggggcttgattatgaaacttccatggggaggatacatgcngttctttcagatggaactgttgtcacagacgttgaagcatttagaaaactgtacgagaangtaggacttggatgggnttatgctgntactaagtatgagcctgtagctagcatggcaaatgcagtatatggtttgtgggcaaaataccgtatgcaaattacaggtcgacctccgctangagagatcatggcatccccgaagagctgcaggcgaatgtaaa

SEQ ID NO: 71607 - protein, 128 aa, Zea mays
  misc_feature: Ceres CLONE 1553372
  misc_feature (1)..(113): Pfam Name: DUF393 Pfam Description: Protein of unknown function, DUF393
  misc_feature (41)..(41): Xaa is any aa, unknown, or other
  misc_feature (76)..(76): Xaa is any aa, unknown, or other
  misc_feature (82)..(82): Xaa is any aa, unknown, or other
  misc_feature (85)..(85): Xaa is any aa, unknown, or other
  misc_feature (116)..(116): Xaa is any aa, unknown, or other
MLYDGDCPLCMREVNMLRERNKSYGAIKFVDISSKDYSPDXHQGLDYETSMGRIHAVLSDGTVVTDVEAFRKLYEXVGLGWXYAXTKYEPVASMANAVYGLWAKYRMQITGRPPLXEIMASPKSCRRM

SEQ ID NO: 71608 - DNA, 644 bp, Zea mays
  misc_feature: Ceres CLONE 1553375
  misc_feature: Encodes the peptide sequence at SEQ ID NO. 71609
  misc_feature (411)..(411): n is a, c, t, g, unknown, or other
  misc_feature (412)..(412): n is a, c, t, g, unknown, or other
  misc_feature (422)..(422): n is a, c, t, g, unknown, or other
ggagctccccgcggtggcggccgctctagaactagtggatcccccgggctgcaggaattcgtctcacccctagaaaaagaggcggcttcccagttcactccaggcccagggcgcccggtcgccatgaactcccgctcctcctccggcggcgtgcggtccgagagctcgctgtcgttgggggagcgcctctgcgcggtcttcttccccgtcatcgccatcgccgaggccgttttcttcgccttcaccgactgcctcgcggacctctgcaccgactccggctcctcgcactcgcgccgcttcggcgcgggcgcgtcctcctccgcccgcaggacagtcggagcaacatttgcagccccacacagacctttgctacgccgcgccactgcgggtggatggaccccccccaacctnncgcagttcgnacgcctcgccgacgagtcccgatgcttctcggtgaccagggggaggcgctcttgagctccacaagaaaatagctgctcattcatcgacaaacgcctctcccaaaggaaagacctcccctgggccctggtcaaaactccaagcgggaagaatctttttcttggaaaagttttttattttggtttgaagaaaaagaaaaagggggggactcaatttttaaagat

SEQ ID NO: 71609 - protein, 117 aa, Zea mays
  misc_feature: Ceres CLONE 1553375
  misc_feature (97)..(97): Xaa is any aa, unknown, or other
  misc_feature (100)..(100): Xaa is any aa, unknown, or other
MNSRSSSGGVRSESSLSLGERLCAVFFPVIAIAEAVFFAFTDCLADLCTDSGSSHSRRFGAGASSSARRTVGATFAAPHRPLLRRATAGGWTPPNLXQFXRLADESRCFSVTRGRRS

SEQ ID NO: 71610 - DNA, 637 bp, Zea mays
  misc_feature: Ceres CLONE 1553377
  misc_feature: Encodes the peptide sequence at SEQ ID NO. 71611
ctggagctccccgcggtggcggccgctctagaactagtggatcccccgggctgcaggaattcgtctcacccctagaaaaagtctgccgagcgcacatcacaaccagtcaaccacacacaacacaacacaaccgatacgaagaagcttcttgtctagctagccgcgcccgcgcgccatgtcctccatgaagagaagcattgcgtctagcgtcatcgtcgtcctactggtgctctcccttgaagccaccttcgctgacgctgtccgcgtcatacccgacgccccggccggcggcgccatcgtccgccttccgagcgacggcgaaagaggagtgactacttcggcgggcggcggggacgacaagaagcagctccggtggtgcgagcacccaatctgcttccctgagtccgacatctgcttctgcccctacacccgcgccgaccggacgacgacggagagcggcccgcggcccaaaggacaagctagtgcatggacagtctcctaagggcccccgcggcccacccgccaccccccttggggagccccccgtttctgcttttttttacagggggaaaaacccgggtgttcaaggggccctctaaaaggaaaaccgggggggggggcccccccaaaaggggag

SEQ ID NO: 71611 - protein, 108 aa, Zea mays
  misc_feature: Ceres CLONE 1553377
MSSMKRSIASSVIVVLLVLSLEATFADAVRVIPDAPAGGAIVRLPSDGERGVTTSAGGGDDKKQLRWCEHPICFPESDICFCPYTRADRTTTESGPRPKGQASAWTVS

SEQ ID NO: 71612 - DNA, 672 bp, Zea mays
  misc_feature: Ceres CLONE 1553379
  misc_feature: Encodes the peptide sequence at SEQ ID NO. 71613
  misc_feature (407)..(407): n is a, c, t, g, unknown, or other
  misc_feature (436)..(436): n is a, c, t, g, unknown, or other
  misc_feature (515)..(515): n is a, c, t, g, unknown, or other
  misc_feature (536)..(536): n is a, c, t, g, unknown, or other
  misc_feature (586)..(586): n is a, c, t, g, unknown, or other
  misc_feature (587)..(587): n is a, c, t, g, unknown, or other
  misc_feature (619)..(619): n is a, c, t, g, unknown, or other
ccccgcggtggcggccgctctagaactagtggatcccccgggctgcaggaattcgtctcacccctagaaaaatggccagcttcggcgtcgacacccgcccggccgccgcggcctccggcggcggcgtgggcgtggcggggacgagggagggcgcgctctcgttcctctcccgcgggctgcgggaggacctccgtctcatccgcgcgcgggccggggagctcgagaccttcctcagcgcgccggtgccggaacccgagctgttcgcgcgcctccgtcgcgcctactcctgctcggcgtcctcttcgcggacgcggctcgacctgtccgccatcgggaaggcgttcgaggccgacgcgtggaggggcgccaggactgccaggtggaggtgggaggcggagacggaggcngaggagtgggagccagtcaggatggtcanggcgcacctcagggagctcgagcggaggaggctggcccagtcgcccagcgacatgctgcacaagctcaagctcagcttngaatcactgacctttgcgccntgagcgtctgaggatgttctgccactggatttaggggaaacttctgcttnnatttgtaaagcatctgtaccactattcgaccnacttgtataaaaagagatgtatgtgaccagttgggtggagtctctgtgcagca

SEQ ID NO: 71613 - protein, 155 aa, Zea mays
  misc_feature: Ceres CLONE 1553379
  misc_feature (122)..(122): Xaa is any aa, unknown, or other
  misc_feature (148)..(148): Xaa is any aa, unknown, or other
MASFGVDTRPAAAASGGGVGVAGTREGALSFLSRGLREDLRLIRARAGELETFLSAPVPEPELFARLRRAYSCSASSSRTRLDLSAIGKAFEADAWRGARTARWRWEAETEAEEWEPVRMVXAHLRELERRRLAQSPSDMLHKLKLSXESLTFAP

SEQ ID NO: 71614 - DNA, 696 bp, Zea mays
  misc_feature: Ceres CLONE 1553380
  misc_feature (1)..(1): n is a, c, t, g, unknown, or other
  misc_feature (315)..(315): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (404)..(404): n is a, c, t, g, unknown, or other
  misc_feature (405)..(405): n is a, c, t, g, unknown, or other
  misc_feature (406)..(406): n is a, c, t, g, unknown, or other
  misc_feature (407)..(407): n is a, c, t, g, unknown, or other
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (412)..(412): n is a, c, t, g, unknown, or other
  misc_feature (444)..(444): n is a, c, t, g, unknown, or other
  misc_feature (694)..(694): n is a, c, t, g, unknown, or other
nttttctggagctccccgcggtggcggccgctctagactagtggatcccccgggctgcaggaattcgtctcacccctagaaaaagccgcacgcttcttgttgccaaagaattccctcccctagccgccgccgccgctcgtctccctgagaggtgccgggaccgaggaactggccgaattctaggtagagaatcggttttgcttgtctcagcacggggtctgctgcgtctggtggtggtgaagggaaaaaattctgagatctgttccggatcaggcgtgcttatttccccatcaagggggtgcacacataacttcntcattttttatttgatggacaaatgggagctaagggtgtttttttttccccccccccccggggtaaagaatggggggnnnttccctttnnnnnnnnncctttttaatcttacaaacaaaaaaaaacctnacaaattgcgggggggggtgcttactccaacctcctctaaaaaacccacccgggactccctcttggcctgcccccttccagaagcttagaaattccttttctgacgctgtggatcctgacaaaatctccctgggcttggttgcttccctgaaattcagcccgtttccccattcttgatccctggacctccaccccctccccagtggaggaggttcgggacgcaatctcccctcctccagggtgatgtatnac

SEQ ID NO: 71615 - DNA, 677 bp, Zea mays
  misc_feature: Ceres CLONE 1553381
  misc_feature: Encodes the peptide sequence at SEQ ID NO. 71616
  misc_feature (63)..(63): n is a, c, t, g, unknown, or other
  misc_feature (677)..(677): n is a, c, t, g, unknown, or other
gcggtggcggccgctctagaactagtggatcccccgggctgcaggaattcgtctcacccctangaaactcctcctcctcctgcccctcccccacccccacccgtcgggacgcctccccactttcccctcccccggatccgcatggcgcctctgcagcccgcgccgctcggcctcccgtagccgacgcccggccccgtcccaccgcccgctgcgccgagcgctgcccgtcccaggctcatatttgcacagagtcattggaggaagtttgatgtttcagcagtactgtgacctttattagatgtctttccgcagcattgtgcgtgatgtaagagatggctttgggagcttgtctcgaagagggtttgaggtgaagtttctgggccaccgccgaggcaaatcctcacggtgctgtccatgagctgcgtgatccagcccccggtgatcaagaacagttgctgggcctaattggccccctgaattggttcaagatgtgattggaaagggtggaaggccattgaagccccctgggcctaaccaggaaagaagggagtcctcttgggccagcttgttttgtcggaacctgggaagaaaaatctgcaaaagagatcgttaaaaaatcccggagtttccccgggaaaaaaacccctttttcccgggggtcccttaaaaggcacccn

SEQ ID NO: 71616 - protein, 39 aa, Zea mays
  misc_feature: Ceres CLONE 1553381
MSFRSIVRDVRDGFGSLSRRGFEVKFLGHRRGKSSRCCP

SEQ ID NO: 71617 - DNA, 610 bp, Zea mays
  misc_feature: Ceres CLONE 1553382
  misc_feature: Encodes the peptide sequence at SEQ ID NO. 71618
  misc_feature (207)..(207): n is a, c, t, g, unknown, or other
  misc_feature (434)..(434): n is a, c, t, g, unknown, or other
  misc_feature (463)..(463): n is a, c, t, g, unknown, or other
gcggtggcggccgctctagaactagtggatcccccgggctgcaggaattcgtctcacccctagaaaaaagatccctctcccccaactcagctgcgctagcctccgtcaacccgggccgcgccgcctcctccgcccgcctcgcgctctcgctgccgtgcggcgcgtgggtcggccgaagcgggctcgtccgccgcgccgccgccttcntccgggacacggccgcgtttcgcgggcgccagggcgcagatcggggccgccgtgcctgccgtcgagcagttccagcgcaggatggcaacccaagctactgtgcatgccttcaaggatattctgaccagcctccctaagcctggaggtggtgaatatggaaagttctacagccttcctgcactaaatgatccaaggatttgatagctgccgtactccatccgtattcnttctgagtcagctatccttaactgtgatnacttccagttaccaagaatgattgttgaggaaattatttgactgggaaaaccccttctccaaagctgggccagaaaaccatttcaagccaggctgggatttcttccttcgggacttccctggaatttcccaccaatttggttgaatc

SEQ ID NO: 71618 - protein, 39 aa, Zea mays
  misc_feature: Ceres CLONE 1553382
  misc_feature: SWISSPROT Homolog: EC 4.2.1.3 Aconitate hydratase
MATQATVHAFKDILTSLPKPGGGEYGKFYSLPALNDPRI

SEQ ID NO: 71619 - DNA, 741 bp, Zea mays
  misc_feature: Ceres CLONE 1553384
  misc_feature: Encodes the peptide sequence at SEQ ID NO. 71620
  misc_feature (648)..(648): n is a, c, t, g, unknown, or other
tggagctcaccgcggtggcggccgctctagaactagtggatcccccgggctgcaggaattcgtctcacccctagaaaaatcggctgggcctgccctcccctcctgtagcggctgtcgcctcgctttccccttgcctccctgccctctccccgcgggcctgccagaggcaattgtcgccctcgattcgaccccgattcgtccgcccgcgaccggtattccctccgccaagcgcggatctgatacgctgcgctccgtgtcgccgctcgaatccgccatgatagggggccaagatccaagggcgccgccaaggcctgatgccaagctgcgctccaaaagcaagggggctgcagaacccgccaagggcaggacagggaaggcgcggcaaggaccccaacaagcctaagacggctcccagcgctttcttcgtgttcatggacgaatttcgcttggagttcatggagaagaaccctatgaacaggtctgtcactgcggtggggaaagctgctggcaactcgtgaaaatccctgatctagtcgcacaacgctccctatgtagccaaggctaactagctcaagctcgagtacgacaaggccatcgctgacgtacacagggtcgagagcactgcatctaatatcgctctcgccaggnagtgacatcatgcatatgacattgagtctgacatctcccatctcgcacgtcatgacaatgatgatgaatagtgtagtgcagaagatgcagatt

SEQ ID NO: 71620 - protein, 67 aa, Zea mays
  misc_feature: Ceres CLONE 1553384
MPSCAPKARGLQNPPRAGQGRRGKDPNKPKTAPSAFFVFMDEFRLEFMEKNPMNRSVTAVGKAAGNS

SEQ ID NO: 71621 - DNA, 648 bp, Zea mays
  misc_feature: Ceres CLONE 1553385
  misc_feature: Encodes the peptide sequence at SEQ ID NO. 71622
  misc_feature (385)..(385): n is a, c, t, g, unknown, or other
  misc_feature (386)..(386): n is a, c, t, g, unknown, or other
  misc_feature (405)..(405): n is a, c, t, g, unknown, or other
ctccccgcggtggcggccgctctagaactagtggatcccccgggctgcaggaattcgtctcacccctagaaaaattccaggtcgtggtctttgccaaattcccacgcccctgcccaccctgcccgaatcctctcgccctttacccccgcccgcgaccccattcacactctcgctgctccactccgctccgctcagctcgtcgggacgcgcccccgcctcccatcccatgcccgcccccgcgctcgtcggaggccgctcgcggcggcctcccatcccgccgcgctgacgagagggcctctcggtgggggcgcttcgggtgttcattttgtcccttcggggaaggggagtgcggcaatggggaagcacaggaggggaagcggcggcnncgggagaagacgggaaacngaaggggagggggagacagctgcagcggcggtgccggaggacgcggcgccagtggccgggtgctggatccgcttcccgcgcctccgcggctgcatgcggtcgcgcgccaaggtcaactccctcaccagcgcgcgtggccggcggccggggaaccaaaccatctactgatgatgctttgccaggaccaatcagtaccaccagccctctggttccgcaacaccagtaaccctgggaagtttctcc

SEQ ID NO: 71622 - protein, 72 aa, Zea mays
  misc_feature: Ceres CLONE 1553385
  misc_feature (11)..(11): Xaa is any aa, unknown, or other
MGKHRRGSGGXGRRRETEGEGETAAAAVPEDAAPVAGCWIRFPRLRGCMRSRAKVNSLTSARGRRPGNQTIY

SEQ ID NO: 71623 - DNA, 686 bp, Zea mays
  misc_feature: Ceres CLONE 1553388
  misc_feature (197)..(197): n is a, c, t, g, unknown, or other
agctccccgcggtggcggccgctctagaactagtggatcccccgggctgcaggaattcgtctcacccctagaaaaatcagaccgccagcagtcgccagcccagcaaggcagagcagcgagcggctatgggaagagaggcgccggcgatggcggtagcgctgctggcggcgctagtcgcttccgcggccatgttggcnggggaccgcgagcgcgtccccggggcgagggatccagccgctgtcccagatcgccgtccacagggccaccgtcgaaatgcagccgttcgcgtacgtgcggggcgacaccgtgcttcctcggcgaggcaggagaaaacccccagtggggtgaccggtaaatttcgcttggaaaaaccctcccaagacaactgggattgggggccttttccccccccggaaatcaaacccgccggggtgaattggcccaaacccctgggccccaaaaaaaacccctttttttttgcgggagccccctttaagggttatgttttcccacctactctcggggaaaaatatttactgggggggaagggggggaactccggggtgggggtttaataacaaggggggccggaattttttttttcccccctttttaaggggggggcctttaacccacagggggatttacccgggggtgggagaccccatcttttttttttaaaaccc

SEQ ID NO: 71624 - DNA, 666 bp, Zea mays
  misc_feature: Ceres CLONE 1553390
  misc_feature: Encodes the peptide sequence at SEQ ID NO. 71625
ctccccgcggtggcggccgctctagaatagtggatcccccgggctgcaggaattcgtctcacccctagaaaaaggagttgctagctccctccttcccgttacctacctacctctctctgtctcttcctcagttcgtactccttgactcttttcttcttcatattagctttcaatctgtgtatgtctttacagataagttgatatttgttcacagtactgttccgcggacagaatgaccaaagacgaggagttcaagctggtcaatatacagaaacatgtggtgaaggagaacatacactgggacgggtgcaagcacaacgtcaagaagcttcttcagaagatccaaagcgtgtacacggcggccgttgatgtggacaaccacaaggtctcggtgacgggcgatgtggactcggagaccctgatgaagaagctcaccaggggcggctagcacgcggagctgtggtcgcagccctagggcggcggcaaccagggccacaagggcaataatggccagcagcagatacagcagcggccggagatcgtgaacctgaagctaccagcagatcataagcaaggtgccaatctcagcaatgatgggcacaacaagaactgcaacggcggcccagaaggaccagcgggaaacacgaggtagatgtaggggctggc

SEQ ID NO: 71625 - protein, 71 aa, Zea mays
  misc_feature: Ceres CLONE 1553390
MTKDEEFKLVNIQKHVVKENIHWDGCKHNVKKLLQKIQSVYTAAVDVDNHKVSVTGDVDSETLMKKLTRGG

SEQ ID NO: 71626 - DNA, 712 bp, Zea mays
  misc_feature: Ceres CLONE 1553393
  misc_feature (477)..(477): n is a, c, t, g, unknown, or other
  misc_feature (496)..(496): n is a, c, t, g, unknown, or other
  misc_feature (507)..(507): n is a, c, t, g, unknown, or other
  misc_feature (508)..(508): n is a, c, t, g, unknown, or other
  misc_feature (551)..(551): n is a, c, t, g, unknown, or other
caaagctggagctccccgcggtggcggccgctcctagaactagtggatcccccgggctgcaggaattccgtctcacccctagaaaaaattctcgaatctcgatctccctgctctacccgcatcaccccgccgttgccggccccttcctcccgcttcccaccctcgccgtcgccacctcttcctcttcctcatcgccggcgcttgcgcgccccttcctccaccccgttgaccgccgcacccacggcctcgccgttgcagcactcgtgcgatccggtcacgagtggagcgcacgagctcattcgctgcttccgcctccccctcttccttgccggagcccgcgcctcctctcctcgccggcgccttcgcctgctcctgcgcccccttctccacgtcgcacccacggcctcgtgttgctgcactcgtgagatccggtcgcgagcgcccgacctaggcggctgcctcagtctctcctcgctncgtcgcatcaccaccgccngagacggaccnngagtgctctgcgagactccgcgccatagagctctcctacggcnggttcttttccgtccgtagctgggtcccctgaaccagccatgcgataaccaccgcctgacgggccctcccgtccaagaacccgtcccattcctccttcctccggcccgccccccctttgaagcggccccccaatttcggacctcccccccaactagccggc

SEQ ID NO: 71627 - DNA, 672 bp, Zea mays
  misc_feature: Ceres CLONE 1553394
  misc_feature: Encodes the peptide sequence at SEQ ID NO. 71628
  misc_feature (551)..(551): n is a, c, t, g, unknown, or other
  misc_feature (556)..(556): n is a, c, t, g, unknown, or other
  misc_feature (559)..(559): n is a, c, t, g, unknown, or other
  misc_feature (561)..(561): n is a, c, t, g, unknown, or other
  misc_feature (562)..(562): n is a, c, t, g, unknown, or other
  misc_feature (614)..(614): n is a, c, t, g, unknown, or other
  misc_feature (624)..(624): n is a, c, t, g, unknown, or other
  misc_feature (626)..(626): n is a, c, t, g, unknown, or other
  misc_feature (631)..(631): n is a, c, t, g, unknown, or other
ctccccgcggtggcggccgctctagaactagtggatcccccgggctgcaggaattcgtctcacccctagaaaaagagggaccggagcaaacgaggcggccgccggccggactcgacagcgcaggaagcgcacaatccaagagccccaatcccaagcccgcctcccattccccccgtcctgccccctccaaacacactccgcgcctccgagtcgggcgggccatcctcctcctctgatcctaccgcaaccgggatggcgcgtggcggcgagagaagatcggcgtcgtcgtcgtcggctgcggcggcggcgggggtggcttggggagtggccgtcgagggctctcgcagtagatgacagtctgataccccactgccttcactgagtgctagagcccctccttgtcaattcactgtctggtgctgaatcgagttcattgaagatgccaaggtccgaatcagacagtgatgatgttttcttcgatgcatttgaagatgttctatctgcaggggaaccttcgttttcagaagattgcagcacaagtgatgaagttncaggnccnanntgaatagagtatgagatttgggcaaacgaaccaattagtggtcaagaaggcncccaaaggtncntgaangggatgagactcgatgatttcgtgtctacgaggataggttc

SEQ ID NO: 71628 - protein, 40 aa, Zea mays
  misc_feature: Ceres CLONE 1553394
  misc_feature (38)..(38): Xaa is any aa, unknown, or other
MPRSESDSDDVFFDAFEDVLSAGEPSFSEDCSTSDEVXGP

SEQ ID NO: 71629 - DNA, 599 bp, Zea mays
  misc_feature: Ceres CLONE 1553406
  misc_feature: Encodes the peptide sequence at SEQ ID NO. 71630
  misc_feature (575)..(575): n is a, c, t, g, unknown, or other
ctccccgcggtggcggccgctctagaactagtggatcccccgggctgcaggaattcgtctcacccctagaaaaaccctctccacttccgtttccggatcccgtttccagctccgatccaacccagcatctgtaccgcgccgcgcgagcacgtccggcgccggtgcggcaggcgaaatccgagagcactcctcccccgctacgccgcaccgcccatggccgcagctagccgcagatagagagaggcgcaggcgagggcgtgcagatccagatccggtgggcgggaaggacttgatcgcccccaccaccatggccggcgcggtgtcggcgctcttcctgctggacatgaagggccgcgttctcgtctggcgcgactaccgcggcgatgtctccgcgctccaggacgagcgcttcttcaccaagctcctcggacaggaagggcgattcggaagtgcactccgcctgtggtctacgacggaccctggggtcaacttacatgttcatcccagcaaaacaatgggtttcctccttaacgggcggtttggcaaaaaaattttaacccggggggcacaaaaancccccccccctttttttttcccac

SEQ ID NO: 71630 - protein, 97 aa, Zea mays
  misc_feature: Ceres CLONE 1553406
  misc_feature (90)..(90): Xaa is any aa, unknown, or other
MAGAVSALFLLDMKGRVLVWRDYRGDVSALQDERFFTKLLGQEGRFGSALRLWSTTDPGVNLHVHPSKTMGFLLNGRFGKKILTRGAQKXPPPFFFP

SEQ ID NO: 71631 - DNA, 664 bp, Zea mays
  misc_feature: Ceres CLONE 1553408
  misc_feature: Encodes the peptide sequence at SEQ ID NO. 71632
  misc_feature (479)..(479): n is a, c, t, g, unknown, or other
  misc_feature (581)..(581): n is a, c, t, g, unknown, or other
  misc_feature (620)..(620): n is a, c, t, g, unknown, or other
  misc_feature (626)..(626): n is a, c, t, g, unknown, or other
tggcggccgctctagaactagtggatcccccgggctgcaggaattcgtctcacccctagaaaaaagtcccacaccacaccacgcagtgccgtgccgcactgctgtcctgcaatctcccataaactcactcgcctcgcctcgcctcgcctcgcccacccgcccgcctgtccctccccaaggccgcagctcactcgtgtcgtgcacccgtcccctcccacccgccaagaactagcattgccgccgccggtgccagggggcggaggagaggccgcggcggcgagggagcggcaccaggcgcagggggtcaggagagccgccggcaggatgttcgggcgggacccctggggcgggcctctggagatctccaacgccgactcggcgacagatgacgaccggagccgggacctggaccgggcggcgctgatgcggcagctggacgagacgcagcagagctggctccctggcgggcccggcgaccnagcggcaagaagaagaaggagtacgtcgaacctgggctgcgtcgtcgtcgaccgcaagatcttcatgtggaccgtcggcaccatcctcgggcctcggcgtcntcatcggcttcatcatgatgatcgtcaagctcgtcccgnaaaagngcccgccgcccgcgccggccgaacaatacacgcaggcg

SEQ ID NO: 71632 - protein, 113 aa, Zea mays
  misc_feature: Ceres CLONE 1553408
  misc_feature: SWISSPROT Homolog: EC 3.2.1.4 Cellulase
  misc_feature (52)..(52): Xaa is any aa, unknown, or other
  misc_feature (86)..(86): Xaa is any aa, unknown, or other
  misc_feature (99)..(99): Xaa is any aa, unknown, or other
  misc_feature (101)..(101): Xaa is any aa, unknown, or other
MFGRDPWGGPLEISNADSATDDDRSRDLDRAALMRQLDETQQSWLPGGPGDXAARRRRSTSNLGCVVVDRKIFMWTVGTILGPRRXHRLHHDDRQARPXKXPAARAGRTIHAG

SEQ ID NO: 71633 - DNA, 669 bp, Zea mays
  misc_feature: Ceres CLONE 1553409
  misc_feature: Encodes the peptide sequence at SEQ ID NO. 71634
tggagctccccgcggtggcggccgctctagaactagtggatcccccgggctgcaggaattcgtctcacccctagaaaaaattgttatcgcagggggcattaagctgcctgcctccgctgccggccgtgctacctaatcgccgcgcttgttttcccaccgcccgatggccgccatcacgccgccgacgcagtcggagccgtcgccgcagacggggcgcccggcctcgtctgccgccgccgcggccaagcgtggagggggcggggctggtgccgccggcgggccgctgatggggaagtacgagctggggcgcctcctggggcacggcaccttcgcgaaggtgtaccacgcgcggcacgtcgacacgggggacaacgttgccatcaaggtgctcgacaaggagaaggccgtgaagagcgggctcgtcccgcacatcaagcgcgagatcgctgtgctacgccgcgtgcgccacccgaacatcgtgcacctgttcgagggtatggccacaaagactaagatctacttcgtcatggagctcgtccgcggcggcgagctctttctcccgcggtctcaaagggccgactcagggaggacacccgcgcgccggcttacttccagcagcttcgtctccgccgggggggttttgccaagccccggggggggtctccaccc

SEQ ID NO: 71634 - protein, 168 aa, Zea mays
  misc_feature: Ceres CLONE 1553409
  misc_feature (45)..(167): Pfam Name: Pkinase_Tyr Pfam Description: Protein tyrosine kinase
  misc_feature: SWISSPROT Homolog: EC 2.7.11.1 Non-specific serine/threonine protein kinase
MAAITPPTQSEPSPQTGRPASSAAAAAKRGGGGAGAAGGPLMGKYELGRLLGHGTFAKVYHARHVDTGDNVAIKVLDKEKAVKSGLVPHIKREIAVLRRVRHPNIVHLFEGMATKTKIYFVMELVRGGELFLPRSQRADSGRTPARRLTSSSFVSAGGVLPSPGGGLH

SEQ ID NO: 71635 - DNA, 679 bp, Zea mays
  misc_feature: Ceres CLONE 1553410
  misc_feature: Translation starting site: 466
  misc_feature (214)..(214): n is a, c, t, g, unknown, or other
  misc_feature (284)..(284): n is a, c, t, g, unknown, or other
  misc_feature (296)..(296): n is a, c, t, g, unknown, or other
gtccccgcggtggcggccgctctagaactagtggatcccccgggctgcaggaattcgtctcacccctagaaaaaccgcatcgcctcgccgctgttccccgcaacctatcgacccaatctcgtccgacccggcgcgtcgtcccctccagatctccgtcgccctctccaggtagcagaaactgttctgctgcagtctgacaaagtggagggcttangagcttctgcttcttttatgtctgaacaatctttgcttttatttggattgttgggagagtactctcgtgncactaggaaaanggcacaggttccgtcccactgcatgcgtcaagagactgtctggttttcttgttctgatttgtcatttgctggtgctcaaagccggcttggttccctcgaaggatcagcatctactcttgattgtggactttgtcgcatctgatatcaacttcataaatctttatccaagatggcgctgcaaaacatgggtgcttcaaacagggatgatgccttcctacggtacaagatgcccagaatgattaccaagataggaagccggtggtaatggtataaagacaaatgttgtgaacattgtttgacatagcaaaagcactggccagggcagttccttacacaacaaattattttggatgggggcttggggcccactccaaatttgataa

SEQ ID NO: 71636 - DNA, 689 bp, Zea mays
  misc_feature: Ceres CLONE 1553411
  misc_feature: Encodes the peptide sequence at SEQ ID NO. 71637
  misc_feature (301)..(301): n is a, c, t, g, unknown, or other
  misc_feature (384)..(384): n is a, c, t, g, unknown, or other
  misc_feature (402)..(402): n is a, c, t, g, unknown, or other
  misc_feature (652)..(652): n is a, c, t, g, unknown, or other
ctccccgcggtggcggccgctctagaactagtggatcccccgggctgcaggaattcgtctcacccctagaaaacaccgcaatcttcaatctccccagcaatccctagcagaagccttccatcctcactcgctcgatggcccgcacgaagcagacggcgaggaagtccaccggcggcaaggcgccgaggaagcagctggcgactaaggcggcccgcaagtctgcccctgcgaccggcggagtgaagaagccccaccgcttccgccccggcaccgtcgcgctccgggagatcggcaagtaccngaagagcccggagctgctgatccgcaagctgccgttccagcgcctggtggggcccccccccccggggggggggggggggtacnctttccaaaactctcctntcccccccgctgcagggagggggctgaggcctaccttgtcgggctccttccaagaaccccaaccttggcgccatccacgccaaggggcggccccttcatggcccaggggcatccaggctggcccgcccgaatcccggggggagaagggcctaaacgggctttttttttcggccatccgggcgcccaatcagaaaagtggaaggatttgccggggggtcctgagtttgtggggttccccggccaaaacccncgggggggtggccggtcccccggcggggcccctagat

SEQ ID NO: 71637 - protein, 185 aa, Zea mays
  misc_feature: Ceres CLONE 1553411
  misc_feature (56)..(56): Xaa is any aa, unknown, or other
  misc_feature (84)..(84): Xaa is any aa, unknown, or other
  misc_feature (90)..(90): Xaa is any aa, unknown, or other
  misc_feature (173)..(173): Xaa is any aa, unknown, or other
MARTKQTARKSTGGKAPRKQLATKAARKSAPATGGVKKPHRFRPGTVALREIGKYXKSPELLIRKLPFQRLVGPPPPGGGGGYXFQNSPXPPAAGRGLRPTLSGSFQEPQPWRHPRQGAAPSWPRGIQAGPPESRGEKGLNGLFFSAIRAPNQKSGRICRGVLSLWGSPAKTXGGVAGPPAGPLD

SEQ ID NO: 71638 - DNA, 662 bp, Zea mays
  misc_feature: Ceres CLONE 1553412
  misc_feature: Encodes the peptide sequence at SEQ ID NO. 71639
  misc_feature (470)..(470): n is a, c, t, g, unknown, or other
  misc_feature (515)..(515): n is a, c, t, g, unknown, or other
ctcaccgcggtggcggccgctctagaactagtggatcccccgggctgcaggaattcgtctcacccctagaaaaacagagcagccacttggatccggtgctcagcggaacagctagctatagcctgtagctagcagctagcttcagtcacaggccggacggtcggctcacacacagctagccgccgccgccgctagcttagccaccagtagtccgatctgatctacaggcaaggggcaactagctagctagccgcgcgccggcgccatgatgaacctgaacctgaagcagcctctggtgctgcccgcgcaccacagcaatgtcgtcggctcgcgcctgtcgtcgtcgtcgccctcggcagccgccgccagcaggaggaccggcggcggcgtgtcctcccggtccggctcccggcggcacgtgcggctgccgaggatcagctgcagcgccaccgaggaggtcagcggcgccngtgtcgtccgtcaccgtggagaggatgctcacggtgacagcgtcnggttgaaggcgtcgccggccatccgggcagatgtacttccagcgcgccgtcgacgacatcggcgacctcctcgggaagacgctgctgctcgagctcgtcagctccgagctcgacgcaaagtcgggcgtggaaaaaccccgggtgacg

SEQ ID NO: 71639 - protein, 39 aa, Zea mays
  misc_feature: Ceres CLONE 1553412
MYFQRAVDDIGDLLGKTLLLELVSSELDAKSGVEKPRVT

SEQ ID NO: 71640 - DNA, 668 bp, Zea mays
  misc_feature: Ceres CLONE 1553416
  misc_feature: Encodes the peptide sequence at SEQ ID NO. 71641
  misc_feature (349)..(349): n is a, c, t, g, unknown, or other
  misc_feature (396)..(396): n is a, c, t, g, unknown, or other
  misc_feature (466)..(466): n is a, c, t, g, unknown, or other
  misc_feature (477)..(477): n is a, c, t, g, unknown, or other
  misc_feature (480)..(480): n is a, c, t, g, unknown, or other
  misc_feature (492)..(492): n is a, c, t, g, unknown, or other
gctccccgcggtggcggccgctctagaactagtggatcccccgggctgcaggaattcgtctcacccctagaaaatcccaatcccaagatgaatgctacgtaggtagacagtgttcttgtggtgacgtgacctccacagagtgcagagatgggagaagctgaagaagcgccaggagacagcaatggtgaggcactggagctcctcatgtccatggcgtcctcttcgctggcctgctctgtctcgcagttcccagccaagtggcagtccatcaaggacaagctccagctgctctgctgcagcctcaattcactctgcggcggcggcggtgaccacgacgacgacgacgacnaggagcatcctgtgttggctgagcttctgcggctggcttcagcaccngtgaggagcatcccagtcgttgcttctcagtgcagcgacggtcatacaaaggtggaaggcttcgtctgangagcgacctgnacnacctgagctgcnagctcgatgcgcacatgaagcagctcagggagatggccgtctcgtccggggcgccgtccccgtccaaggccattgtcgccgtcaggcccagcgcgggggcccaggtggggtgaaaaggcctctaccccaaggatctctttccaaggatacaggatcggcgccacgtccagagggaa

SEQ ID NO: 71641 - protein, 105 aa, Zea mays
  misc_feature: Ceres CLONE 1553416
  misc_feature (68)..(68): Xaa is any aa, unknown, or other
MGEAEEAPGDSNGEALELLMSMASSSLACSVSQFPAKWQSIKDKLQLLCCSLNSLCGGGGDHDDDDDXEHPVLAELLRLASAPVRSIPVVASQCSDGHTKVEGFV

SEQ ID NO: 71642 - DNA, 480 bp, Zea mays
  misc_feature: Ceres CLONE 1553417
  misc_feature (200)..(200): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
ctccccgcggtggcggccgctctagaactagtggatcccccgggctgcaggaattcgtctcacccctagaaaaacccctttttccccttcacagccccgtactactatccccgctaccgctagccgccgcgctgctcatctggtggcggctcgcctccctccccccatccgccgccgccgggctcctcctctagctcccntccttaccccgaagctttaagctcggtgctaccctggcctaaccttaatnnnncccctttggaaaaaaaaaaaaggaaaagttccgtcgtcgtcggggccttcgaatcccccgccccccctttcttttggaacccctctttcccaatggcccctttagaaccccgggccccgccccccgggggggaaaaaaaagaaaaaggggtgtttcggtgccccaaaaaaacccccccgggggaaaaaaaaaaaaagatttttgaaaaaaaatttccccggaaaacc

SEQ ID NO: 71643 - DNA, 616 bp, Zea mays
  misc_feature: Ceres CLONE 1553423
  misc_feature (100)..(100): n is a, c, t, g, unknown, or other
  misc_feature (101)..(101): n is a, c, t, g, unknown, or other
  misc_feature (352)..(352): n is a, c, t, g, unknown, or other
  misc_feature (445)..(445): n is a, c, t, g, unknown, or other
  misc_feature (508)..(508): n is a, c, t, g, unknown, or other
ctccccgcggtggcggccgctctagaactagtggatcccccgggctgcaggaattcgtctcacccctagaaaaatcaggcccacgctttgttaacaaagnnaaattccctcatagccgccgccgccgccgccgccgccgccgccgctcatctcgccgagaggtgacgggaccgaggaactcgccgagttctaagatagagaatcgcttttcacagcctggggtctgctgcgtaggtggtgttgaaggggagaagtttaagatctgttccacagatcacgcgtgcgcgctcgcgaatcggggggtccacacatagcttcgtcgttttgaatttgatgtactaatggagtctangggtgggcagaagtctagcagtagtcgttccatgatgtatgaagctccccttggctacagcatttgagacgttcgacctgccggaagccgcgngaaggtccagtctgctgcttactcaactgcgcaaggagccaccgggaatcccctttggctccntcggtcaagtagttaggatttcttttcggaaccttccgtttcttacaatccccctggcttggtggttccctgaaaatcgaccagttcccccattttttgtcccctgaa

SEQ ID NO: 71644 - DNA, 676 bp, Zea mays
  misc_feature: Ceres CLONE 1553425
  misc_feature: Translation starting site: 83
  misc_feature (417)..(417): n is a, c, t, g, unknown, or other
  misc_feature (418)..(418): n is a, c, t, g, unknown, or other
ctccccgcggtggcggccgctctagaactagtggatcccccgggctgcaggaattcgtctcacccctagaaaaagtactcatatggtggacatcagggtacaagcaaaaagattgaaattccaaatggaagggttggtgttattattggaaaagctggggaaactattaggtatatccaacttcaatcaggagcaaagattcaagttacgagagaccatgaagctgaacctggtgcactgacaaggcaagttgagctttctggcaatcctgagcagataagcaaagctgaacagttgatcaaagaagttatagcagaggctgatgctgggtcatccggtgctgtatctggtggccggaaatacaatgcaccacagccaggcgctgagacattccagatgaaaattgctaaatataanngtggatgattatgggaaaaggggtgggtgaaaccattaaagtctatgcaagccaaatctgggaccccgcattcagggttatccctttgcatcctgcctgcctggtgatactccaactgaaagaactgtgccatattgatggcactccaaaaccaatttgaacatgcaaacccacctggtggcttaaagttaccaattaaaaatcgtgccaggaaatccaaaggcctggggggcaattccccaccaggggttatcaccc

SEQ ID NO: 71645 - DNA, 1974 bp, Zea mays
  misc_feature: Ceres CLONE 1553426
  misc_feature: Encodes the peptide sequence at SEQ ID NO. 71646
gccgcgcatcgtgccgcggtgccgccgccgccgttgcctgaattggcaaaaccaacgagcagtcagagcggaagccgccgcggcgcccgccaccaaagccaatggagcccgcgctgcgcgagctgtgggcggagtcccgggacctgttgggcctcccttcctcttctcaggacgccaccgccgtgccgcgcgtcagcctgcccccgacgccgctcgcgttcctccgcgaccacgtctccccgggccgcccgctcctcgtctccgccgcggccactcgccactggcccgccgcgtcgctctggcccaccgcctcctacctcaccgacgcactccgctccaccgccgtctccctccacctcacccccgacgggcgcgccgatgcgcttgcctcgcacccgcacccacggcgacccgggtcctcgaggtgctttgcgtccgcgcacgtccgccgtgtcgacttccctaccgcggtccggcttatcaggggatccgacccggccgccggcctggtagcgtacgcgcagcagcaggacgactgcctccgcggggagtacgcggcggtcgccggtgacgtggacgcgcacgtgccgtgggccaccgaggcgctcggctgcctccccgaggccgtcaacctctggataggcaacgcccactccgtcacctccttccacaaggaccactacgacaacatttacgtcgttctgtccggcgagaagcacttcctcctgctgccccccaccgagcaccaccgtctctacgtccgcgactaccccgccgcccgctacgttgccacggagcagagctccgagggggggcgccagttgaggcttaagctggagatggaagtgcccgagaggatcgttccctggagcagcgtcgacccgtgcccggcgtcgcccgaggagttggccgtgcaggcgtcgtcgtttccgctctactttgacgggccggcgccgatacggtgcacggtccgggccggcgagatgctctacctgccaagcatgtggtttcaccatgtcagccagagtccagggccgaacgggctcaccattgccgtgaactactggtacgacatgcagtttgacatcaagtatgcttacttcaacttcttgaggtcgctggagatcaatggttgttcatcgggcaaacctgatgcttcggaaggtgatctagaggagaagaaagattgaggtggcggacagtgactttgattacccctggtttccgctgagcatcacgatgctgtgccgggctgggtttctcgcggccactgtctaacagagtaacagctcttcgagcataacgaggtgttgctagacacatggaaaccaattaatcggccatgtatgtttgcacaacgttgcaggtgccaattggcctatcagacccaatgtggttgcaatgcattgtcaaagtttggtggcattcacagagaacatgaattttgttttgaattcagtccatgggttcctgatcgtctttgtttctagcgatgattcttgatatgctggaggcctgatttatagcttgtgcaaatcagcatcattcactggaaggatggattgtcctcgtagaaatctgaatgccagataaagaactgcgtggcgtggataaagaactttatcatcatgggtgagacgctacctttaaaggttggataaaattgaggtcggacagcgattaatccataaggttggaacttgaaaaccaagatgaggctatctagtcaagggagtctccggcgtggaagaagtgggagagggggcagagtttcacttctgtccatgtgttgatggtcagacttcgttgttgttgtgagttgtgacttgtgagagccggcacccataccaatctggttcctgtgcttgttatagtgtgcctttgcttatttgggtttcttccgtacggaagtacgaattccttgtatctttttgttaacaggtctcagagccatttcaaaaaaaaaaaaaaaaa

SEQ ID NO: 71646 - protein, 362 aa, Zea mays
  misc_feature: Ceres CLONE 1553426
  misc_feature (8)..(235): SWISSPROT Homolog: EC 3.1.1.4 Phospholipase A(2)
  misc_feature (276)..(323): SWISSPROT Homolog: EC 1.14.11.16 Peptide-aspartate beta-dioxygenase
MEPALRELWAESRDLLGLPSSSQDATAVPRVSLPPTPLAFLRDHVSPGRPLLVSAAATRHWPAASLWPTASYLTDALRSTAVSLHLTPDGRADALASHPHPRRPGSSRCFASAHVRRVDFPTAVRLIRGSDPAAGLVAYAQQQDDCLRGEYAAVAGDVDAHVPWATEALGCLPEAVNLWIGNAHSVTSFHKDHYDNIYVVLSGEKHFLLLPPTEHHRLYVRDYPAARYVATEQSSEGGRQLRLKLEMEVPERIVPWSSVDPCPASPEELAVQASSFPLYFDGPAPIRCTVRAGEMLYLPSMWFHHVSQSPGPNGLTIAVNYWYDMQFDIKYAYFNFLRSLEINGCSSGKPDASEGDLEEKKD

SEQ ID NO: 71647 - DNA, 679 bp, Zea mays
  misc_feature: Ceres CLONE 1553427
  misc_feature: Encodes the peptide sequence at SEQ ID NO. 71648
ctggagctccccgcggtggcggccgctctagaactagtggatcccccgggctgcaggaattcgtctcacccctagaaaaagttcatcagccggcgcctcttgcgtatccagtccgattctcagactaacttcccgttcagcgccacaacacgtcgcaatggctcgcgtaatctgagctccgaggccatcaatgcctccgcgaatgggcatctgtgggcacttcttttctgccgccactaggctcacaatgagcgagctccccttactgcgcagcagcttccgctctttgacgacggcaaacgctggcagcgaggacagggcccgttggacccctgcacgcgtctgcgccatcagtgctgccatccacgacgggtgcgtcaggctcgtcggaatacaaacctctgacgcctgggacctggtggagtcttacacgaaccggtgtcaatacttgcggatccgcgtagcggggagaagatctcaagcgcggatacatggtctctccccccgccgcctaaagcgcggcccccgttcggatttctcgatccaaagcaaccccggtggccaccggcggggggggttctacctccctcctagaacagggaaggttatgggggcttgggggcccgtccccggggagcggggttccccccgcctcagagaaaagatccggcccggcttc

SEQ ID NO: 71648 - protein, 159 aa, Zea mays
  misc_feature: Ceres CLONE 1553427
MGICGHFFSAATRLTMSELPLLRSSFRSLTTANAGSEDRARWTPARVCAISAAIHDGCVRLVGIQTSDAWDLVESYTNRCQYLRIRVAGRRSQARIHGLSPRRLKRGPRSDFSIQSNPGGHRRGGFYLPPRTGKVMGAWGPVPGERGSPRLREKIRPGF

SEQ ID NO: 71649 - DNA, 658 bp, Zea mays
  misc_feature: Ceres CLONE 1553429
  misc_feature: Encodes the peptide sequence at SEQ ID NO. 71650
  misc_feature (369)..(369): n is a, c, t, g, unknown, or other
ctggagctccccgcggtggcggccgctctagaactagtggatcccccgggctgcaggaattcgtctcacccctagaaaaaatccgcacaatcgaaagcaacagcagctgattattaaagccccgctttttcaaaagccgcaagggctatacccctagttgtaaattggcggaaaggaaattcgcctcctcttctccaattgcagctgcagttgcgtgctcgagaggggtgaagaacctagaagccctgccagcgcgcggcgccggcgccttgtttactctgcgacggcacactgattggattggtactgttcttctcctgatcaccacacatgagaagggtcatccatgactccggacatgacatgcanaatgaggcacttgatttggtctcatctgacgttaatttccccaagagccatttccaggactataggattggaccgaacatccaggtcattaatccggaggaaaaacctgaggctggtccctctcaaggaaaattgttgaaaaggaaaacagcggcggttgcttgaacaatcaaaaagcggcttttttgtgcgtgaatctcgagggaaaaaatttaaaaaaaggggtctatctgggccccttccaatgcttttcttgaaggagggccaaaccgggcaaaaaaagccggtt

SEQ ID NO: 71650 - protein, 67 aa, Zea mays
  misc_feature: Ceres CLONE 1553429
  misc_feature (13)..(13): Xaa is any aa, unknown, or other
MRRVIHDSGHDMXNEALDLVSSDVNFPKSHFQDYRIGPNIQVINPEEKPEAGPSQGKLLKRKTAAVA

SEQ ID NO: 71651 - DNA, 643 bp, Zea mays
  misc_feature: Ceres CLONE 1553431
  misc_feature: Translation starting site: 376
  misc_feature (473)..(473): n is a, c, t, g, unknown, or other
ctggagctccccgcggtggcggccgctctagaactagtggatcccccgggctgcaggaattcgtctcacccctagaaaaaagcatctccctccgagtccagggggcaggggcaccattaccgagtagtttaattagtgctagttgtattaccattgttagtgacttaattaccctcacgcgaagcaccttacctctgctagtcctcctacgtctcttctcttcgcttaatcttggtcggtgatttgattcttcacttcttgcgcgcattgcagagggtgctcggtctgcagctatcttaggttaaccagtcgtgtgtggtctatcgatttcgatatagtactactgctctgttataatcagcgggaaggaggaagatgacggtgacgccacggatcacggtgagcgacgggcggctgacggtgcgcggccggtgctcaccggcgtgccggaacacgtgtcggcggcgcacgcngccggggcggggctcgtcgacggggccttcgtcggcgcccacgccggcgaggccaagagccaccacgtcttcaccttcggcacgctccgggactgccggttccctgtgccctgtccgggttcaagctgtggtggatgacgcaaccgaatgggcgtcttccggccgccact

SEQ ID NO: 71652 - DNA, 687 bp, Zea mays
  misc_feature: Ceres CLONE 1553432
catagctggagctccccgcggtggcggccgctctagaactagtggatcccccgggctgcaggaattcgtctcacccctagaaaaagagcactgtgaatctgaggagggaaaatcacccaaaatcgagagcagatttttttcccgaagatgccgaagatcacctcgtcgccgtctcccaccatctccgccatgaatcccctcctcccctcctcctttcccaaatcaccccacccgccggacccaaaccctagctccccgaatcctagcccctgcagctacctcctccacgcggacgccgacgacgaggcgctgattcaaatccctggtcagaaccctagcctggtgggcgcatccgcctccttcgcgctgctgccatctatcgacccggctccacacgtctcgtcgcagttctacaccttcagcgccgcctcctacgagctcatgctacgctgcatccgcgcgggccgctccgcctcctccgacgaggtccgcggcgccacgtcgctctccgtgctcgccttctggggggcgggcttggaaagatcgaaacgaggacacggcctacctcccccggggggaaccgcatcccggaacaagctccccgcgtcgggcgaacggccgggcactttcacttaaggtccaacgccggcgcaaggcggttctccaaggtcggggatgggggaggga

SEQ ID NO: 71653 - DNA, 673 bp, Zea mays
  misc_feature: Ceres CLONE 1553435
  misc_feature: Encodes the peptide sequence at SEQ ID NO. 71654
  misc_feature (502)..(502): n is a, c, t, g, unknown, or other
  misc_feature (519)..(519): n is a, c, t, g, unknown, or other
ctccccgcggtggcggccgctctagaactagtggatcccccgggctgcaggaattcgtctcacccctagaaaaaagttcagttctccgatcctctaccgcagcagcgtaagcaaagtagaaggcaaggaccaatggcgccgccgcgggtctccttcctggagctctgcctctccttcctctgcttcgtggtcttctactacttccacatcagatccaagcggaagaaccctttcgtgccgctggactggccgctggtgggcatgctcccggccctcctcggcaacctccaccacctccacgactggatcacctccctcctggtcgccagccagctcagcttccttttcacaggcccgccgcgctccggcatgcagttcttcgtcaccgccgaccccgccaacgtccgccacgtcttcacctccaacttcgccaactaccccaagggccccgagttcgaagagatcttcgacgtcctcggcggcggcatcttcaacgccgacngcgaagtcgtggcgccngcagcgcgccaaggcgcagctgctcatgtccagcgccccgttccgagccctggtgtcgcggtacagcccgcgccaaggtgggacaccgccctgctcccgctgctctcgcacatggccgccaccggggaaggcgtccgacctcccaggacgtgtt

SEQ ID NO: 71654 - protein, 180 aa, Zea mays
  misc_feature: Ceres CLONE 1553435
  misc_feature (124)..(124): Xaa is any aa, unknown, or other
MAPPRVSFLELCLSFLCFVVFYYFHIRSKRKNPFVPLDWPLVGMLPALLGNLHHLHDWITSLLVASQLSFLFTGPPRSGMQFFVTADPANVRHVFTSNFANYPKGPEFEEIFDVLGGGIFNADXEVVAPAARQGAAAHVQRPVPSPGVAVQPAPRWDTALLPLLSHMAATGEGVRPPRTC

SEQ ID NO: 71655 - DNA, 655 bp, Zea mays
  misc_feature: Ceres CLONE 1553438
  misc_feature: Encodes the peptide sequence at SEQ ID NO. 71656
ctccccgcggtggcggccgctctagaactagtggatcccccgggctgcaggaattcgtctcacccctagaaaaaagacagggactctgacatcagatgatatggagttccaaggtattgttactttggaagatgacactgagttaatatctgatgcaaataagctgcccctccgaactcaagaagtactttccagttgtcatgcattggtatttgtcgacaacaagctggttggtgatcccctcgaaaaggctgctataaagggcatagactggatctacacatctgatgagaaggccatgtctaaaaggcctggtggtcaacctgtacagattgtgcacaggtaccattttgcttctcacttgaagagaatgtctgttattgtccgtattcaggaaaggttttacgctttcattaagggtgcacctgagactatccaagagaggttagttgatttacctgctgcatatgtggagacatataagaaatacacacggcagggttctcggggtctgggctctgcatacaaattgcttcctgagatgcctgttagtgaagctagaagtttggaaagggatcaagtagagagcgacctaccttttgctggctttgcggtcttcaactgccctataaggggggactctgggggctgtttt

SEQ ID NO: 71656 - protein, 185 aa, Zea mays
  misc_feature: Ceres CLONE 1553438
MEFQGIVTLEDDTELISDANKLPLRTQEVLSSCHALVFVDNKLVGDPLEKAAIKGIDWIYTSDEKAMSKRPGGQPVQIVHRYHFASHLKRMSVIVRIQERFYAFIKGAPETIQERLVDLPAAYVETYKKYTRQGSRGLGSAYKLLPEMPVSEARSLERDQVESDLPFAGFAVFNCPIRGDSGGCF

SEQ ID NO: 71657 - DNA, 860 bp, Zea mays
  misc_feature: Ceres CLONE 1553439-R
  misc_feature: Translation starting site: 344
  misc_feature (1)..(1): n is a, c, t, g, unknown, or other
naccggatgattgattgattgctgcagcttcattttgttgttcactcagctaaccacctactaagccttacaaggaaggctatgcatttctcatctatctatttgactactttagcatcagacttgcttgacgtagagcaagctgacgtttgttgggatcaaacacagaccatgtccaagtccaatacgcatgcagcagtctaataggtagacaccactccagtgatgctgttatgctggcatgctgccgactgccgtacgtcgcctagctagctaagcagttcctgcgctgccgccctccgcattctggccgcacctgaggtgtatctcgtagccgcaggcgatgcactggtacgcccagccgagtccctgctcctcgcactcgcagcagatgtacggccctcccccggacttctccgacacgatgctgagctcgtggcggtgtccccggtggcgcagcgaccgcgggtactccttggccgcctcgtcctccgcctcctgcagcagcctgatctgcgcgtccgtgaacgggaaggccatgtcgaagtagaggatcaccaggttccggccgttccgcgtcaccgtcctgccgttcggggccgaccaccaccagcgtgggggatctcccgcacgtcgaaagtacttctccagcgcgtcgcgaaggcgccgcgttcgtagggggagcgcccaagccaccggcatggtcgcccgccgggagcgccatgttaccccgttccctccctcccttgttccatggggggaacgttaccacataccttccgaaaatgtccttccctccctttgaccccctttgagaggctcgcctttttacaattgggcacgcccacagccttatcgtt

SEQ ID NO: 71658 - DNA, 678 bp, Zea mays
  misc_feature: Ceres CLONE 1553439
  misc_feature (592)..(592): n is a, c, t, g, unknown, or other
  misc_feature (593)..(593): n is a, c, t, g, unknown, or other
agctccccgcggtggcggccgctctagaactagtggatcccccgggctgcaggaattcgtctcacccctagaaaaaatcaggcatccatcggcgagagcgagagcgagagcgttcgcagcaagcctacctcaccttgcctgcctgtctgcctgtctgtctgtctccagagctgcgcttgtccggagacggagccgactgaacatggccggagatccgggggacgcgccggaggtgggaggcggcagcatacgctccgtgctcaccacggcctcgctcgtcgctccctccggggacgaggtaagaaccaagtctcttccagcttcagctcgtcttcattccttctgcatctgcttcggtggccactctactccgatcctctgtacgttctctgctagtagggatttggctcttgggtagatacagtaaggttcatcactcatctgctagctccttcagttttttttttttttggttttaaatttcgtacgtttgatctaaaacacacctaattaattaaactatctcaggaaggtttgcttcatatatactgatagaaaggatttggcacatgcaagagtgaagatgagcttnnataggggatcgatatataaaacacgcagataaacatgctaataggctaacgacatccatattttgtgtgtcatgcaagtatatat

SEQ ID NO: 71659 - DNA, 603 bp, Zea mays
  misc_feature: Ceres CLONE 1553442
  misc_feature (370)..(370): n is a, c, t, g, unknown, or other
  misc_feature (407)..(407): n is a, c, t, g, unknown, or other
ctccccgcggtggcggccgctctagaactagtggatcccccgggctgcaggaattcgtctcacccctagaaaaagcagaagccgcagccacgccccacgcccccacaccaagccgtatcgtcttctccctcttgtccggttcgggtggtccgcggtcggggtgagtgagtgagcagctttgcttctccatctccccattcccttccctccccagcccccccggcccggcggcggtacgtgaccctgacgccgcagcgctagctagctcgccggaacggcaggtggcgggcgcgcgacctgagagcacagcagcacccggaccggctcagggcaggcgaccggcagaaaaagatgggcggggagccaccanccttgttgggaaaaacggggcgggcgggcccggcccngggggggggggggggggaacccgccaaagaaaaaaaccgctctcccccccccccaaaggggccccgggttcccccccccccctggggggccccttagaaaaagggccccccccggggaaaaaaaattttttttaaaaaaccccccggggggtttttaaaaaagggggggggtgggagatataaaaaacccccccgc

SEQ ID NO: 71660 - DNA, 647 bp, Zea mays
  misc_feature: Ceres CLONE 1553444
agctccccgcggtggcggccgctctagaactagtggatcccccgggctgcaggaattcgtctcacccctagaaaacttagtagccagaggaaaagaaagcaaaagcgattcccgtagtagcggcgagcgaaatgggagcagcctaaaccgtgaaaacggggttgtgggagagcaatacaagcgttgtgctgctaggcgaagcggttgagtgccgcaccctagatggctaaagtccagtagccgaaagcatcactagcttacgctctgacccgagtagcatggggcacgtggaatcccgtgtgaatcagcaaggaccaccttgcaaggctaaatactcctgggtgaccgatagcgaagtagtaccgtgagggaaaggtgaaaagaacccccagtgggtagtgaaatagaacgtgaaaccgtgctgagctcccaagcagtgggaggggaaagtgatctctgaccgcgtgcctgttgaagaatgacgcggcgactcatagcgccttttgcctccgtctccgtcggggatgggttggccccttattccgcgcccttcaccgcccaaggggaaccagccctgaaccaatttcaggttcccttgcctcgccccgaaactccaaaaccccttatcccccttggaggtagggccc

SEQ ID NO: 71661 - DNA, 677 bp, Zea mays
  misc_feature: Ceres CLONE 1553449
  misc_feature: Encodes the peptide sequence at SEQ ID NO. 71662
  misc_feature (319)..(319): n is a, c, t, g, unknown, or other
  misc_feature (321)..(321): n is a, c, t, g, unknown, or other
  misc_feature (333)..(333): n is a, c, t, g, unknown, or other
  misc_feature (336)..(336): n is a, c, t, g, unknown, or other
  misc_feature (337)..(337): n is a, c, t, g, unknown, or other
  misc_feature (342)..(342): n is a, c, t, g, unknown, or other
  misc_feature (344)..(344): n is a, c, t, g, unknown, or other
  misc_feature (355)..(355): n is a, c, t, g, unknown, or other
  misc_feature (358)..(358): n is a, c, t, g, unknown, or other
  misc_feature (361)..(361): n is a, c, t, g, unknown, or other
  misc_feature (364)..(364): n is a, c, t, g, unknown, or other
  misc_feature (452)..(452): n is a, c, t, g, unknown, or other
gctccccgcggtggcggccgctctagaactagtggatcccccgggctgcaggaattcgtctcacccctagaaaaaagaaaaggaaggaagaagggcctcctgtctcacttccctcagtcctcgtccgtctctgctctccctcctctctctctctctacctagctagctagctagccttcctgtagcgcggcagatatggctgcctccaccacggcggcggcggcgctgctgctgctcctcctgtcgctcgccgcggcggcggacatgtcgatcgtgtcctacggggagcgcagcgacgaagaaggcgcgcggatgtacncngagtggatggcngcnncacgncngaccctacacnccntcngcnaagaagagcgggcgtacccagtgttccgggacaacctccgctacatcgacgcgcacaccgccgccggcgacggcggcgtccactcttnccgcctcgcctcaacggcttcggcgacctcactaacgacgaggacggcggcacctacctcggcgccaggaacaggccccaagagggagaaggagctcggccccaggttacacccccgccacaacaaggaacttgccgggagtccgtccaacgggaggccaaagggcccccctccccaaaggtcaaggacaagggcaactgccgggaactgttggggctttcccaa

SEQ ID NO: 71662 - protein, 160 aa, Zea mays
  misc_feature: Ceres CLONE 1553449
  misc_feature (42)..(42): Xaa is any aa, unknown, or other
  misc_feature (48)..(48): Xaa is any aa, unknown, or other
  misc_feature (50)..(50): Xaa is any aa, unknown, or other
  misc_feature (54)..(54): Xaa is any aa, unknown, or other
  misc_feature (55)..(55): Xaa is any aa, unknown, or other
  misc_feature (56)..(56): Xaa is any aa, unknown, or other
  misc_feature (57)..(57): Xaa is any aa, unknown, or other
  misc_feature (86)..(86): Xaa is any aa, unknown, or other
MAASTTAAAALLLLLLSLAAAADMSIVSYGERSDEEGARMYXEWMAAXRXTLHXXXXEERAYPVFRDNLRYIDAHTAAGDGGVHSXRLASTASATSLTTRTAAPTSAPGTGPKREKELGPRLHPRHNKELAGSPSNGRPKGPPPQRSRTRATAGNCWGFP

SEQ ID NO: 71663 - DNA, 698 bp, Zea mays
  misc_feature: Ceres CLONE 1553450
ctccccgcggtggcggccgctctagaactagtggatcccccgggctgcaggaattcgtctcacccctagaaaaaagaccaacccaacccaacccaacgctctcctcatcgcttcccttcctttccctctgcccaccaattgatagctcacctcacctcacctcacctcacctccgaacccgctgtttcgtgcaccgcacttcacaccccaccaaccttctcccccactgaaaactatctaccccaccccaaaccacccctacccgccgacgagcgcgatcgattgattcttttcccgccgggcggctgcagagggagcccacaagatccagctaccgccgcggctacgatgaggtcgctgctgccgcggagcgagctgcggcgatcgtcggcggcagcccgtggagtcatcggacaggcgaccccccggggggaaacggtcctgttggccaacggggggatggcctcgggcccctaaccccccccctcccccacctttttgggtcctggctggcaggcgactctagaaacctaatctcgcctcttacgggggattccactttttcagggggtcccaatttcttaagggaaatttccccaccaaccgggctttaacaggtccaaaaggcggccggcttcccgggggcggggggccttggccccccccccccccaagaaagaaccaccaacccccggttt

SEQ ID NO: 71664 - DNA, 681 bp, Zea mays
  misc_feature: Ceres CLONE 1553572
  misc_feature: Encodes the peptide sequence at SEQ ID NO. 71665
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (146)..(146): n is a, c, t, g, unknown, or other
  misc_feature (270)..(270): n is a, c, t, g, unknown, or other
  misc_feature (310)..(310): n is a, c, t, g, unknown, or other
  misc_feature (311)..(311): n is a, c, t, g, unknown, or other
  misc_feature (383)..(383): n is a, c, t, g, unknown, or other
  misc_feature (397)..(397): n is a, c, t, g, unknown, or other
  misc_feature (398)..(398): n is a, c, t, g, unknown, or other
  misc_feature (406)..(406): n is a, c, t, g, unknown, or other
  misc_feature (409)..(409): n is a, c, t, g, unknown, or other
  misc_feature (416)..(416): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttttttggctattgggtaccgggccccccctcgnaccactgcagtggtaaaggctatggccgccgccagcatcaagctccttgctccccgaccaaaccctacctgtacccgccgccgccgccgcagcagccatgccgcccaaattggacccctctcangtggtggaggtcttcgtccgcgtgacgggaagcgaagtcnngcgcgcgtcctcgctggcccccaagatcggcccgctcggtctctccccgaagaagaatcgtgaagacatcgncaaagagaccgccnnaggactgnaanggccctnccccgtccacgtcaaagctcacccttgcaaaaccggcagcccaaggttttccgttcgtccccttccgccccgggggtttcgtatttaaggggcctcaaggaaaccccaaaaggggaccggaaaaaaaggggcaaaaaaattttagggccaggggggaaaaattagctccctcaaaaaaattttttaaaatatcccccaaaaacacattggaaaaaaagggccttggtgcaaaaaagttttttccccgggaaaccccaaaaaaaaa

SEQ ID NO: 71665 - protein, 86 aa, Zea mays
  misc_feature: Ceres CLONE 1553572
  misc_feature (12)..(70): Pfam Name: Ribosomal_L11_N Pfam Description: Ribosomal protein L11, N-terminal domain
  misc_feature (9)..(9): Xaa is any aa, unknown, or other
  misc_feature (23)..(23): Xaa is any aa, unknown, or other
  misc_feature (47)..(47): Xaa is any aa, unknown, or other
  misc_feature (52)..(52): Xaa is any aa, unknown, or other
  misc_feature (55)..(55): Xaa is any aa, unknown, or other
  misc_feature (56)..(56): Xaa is any aa, unknown, or other
  misc_feature (58)..(58): Xaa is any aa, unknown, or other
MPPKLDPSXVVEVFVRVTGSEVXRASSLAPKIGPLGLSPKKNREDIXKETAXGLXXPXPVHVKAHPCKTGSPRFSVRPLPPRGFRI

SEQ ID NO: 71666 - DNA, 659 bp, Zea mays
  misc_feature: Ceres CLONE 1553576
  misc_feature: Translation starting site: 403
cgattgggtccgggccccccctcgagccactgcagtggtaaatgtgctttcttttatgtgggttggcttctcctccccctccagttcgggttcgaggttcgtggagttctccggggtttcggtttcatggagtagagcttgtatcaagattgcagtttcatatgtttagtaccgctgcttcctcagctgactcccctgttccactgaccaccactccctccacatccccttcttcacctacggccacgtcctcgaggccaatatctatctctctgatccctataccgaaaggttccctccgattctgcttcatcaccttctccaccgtagacgctgatgcgaaacgccatccacgtgccctgaaccgcaaggagctggaccgccacaacatcaccgtcaaccatgcccagtcccacgactgacctggatgccgctgctgccgctacggtggtggccctgtatgcagcggctacacgctgtggcgggcgccgctgatggcgagccgcggctaccgcggtgacagggcggctacggaggcggcggtcgttaccgtgctggtgctggcatctctgcgctcgctacctcggctgcggctaccgcaactcccacagtaactggaggaactgagcggatgcgcccactcggccaatttctcctga

SEQ ID NO: 71667 - DNA, 627 bp, Zea mays
  misc_feature: Ceres CLONE 1553588
  misc_feature: Encodes the peptide sequence at SEQ ID NO. 71668
ccgattgggtaccgggccccccctcgagccctgcagtggtaaaggattctgattggcacccgtaaatcatctgctttgtctacctcagcaggtttgcaacatttacgcgatccattgcattgcgacttgcagctgcagagccggtgatggcggaccggcggagcaatggtggttcgccccctaactggagcttcgcgtctcaaagcagccactaccacttggcggcgatgagaggaagctacgcggcacagagcctctggcgcccgacgccgatgccggtccgtggcgccgccctgtcctcgacgccgcacgttgtggcctcggcgcccgccgagaagaacttcgccgccgacttcctgctgggcggggtgtcgtcggcggtgtccaagaccgtggcggcgcctatcgagcgcgtcaagatgctgctgcagaaccaggacgagctgatccggaccggcaggctgtccgagccgtacaggggcatcggcgactgcttcggccgcaccgtcagggacgagggcttcctgtcgctgtggcgcgggaacaacaccaacgtcatccgctacttccccacgcaggccctcaacttcgcgttcaaggactacttcaagggcctcttcaacttca

SEQ ID NO: 71668 - protein, 160 aa, Zea mays
  misc_feature: Ceres CLONE 1553588
  misc_feature (65)..(160): Pfam Name: Mito_carr Pfam Description: Mitochondrial carrier protein
MADRRSNGGSPPNWSFASQSSHYHLAAMRGSYAAQSLWRPTPMPVRGAALSSTPHVVASAPAEKNFAADFLLGGVSSAVSKTVAAPIERVKMLLQNQDELIRTGRLSEPYRGIGDCFGRTVRDEGFLSLWRGNNTNVIRYFPTQALNFAFKDYFKGLFNF

SEQ ID NO: 71669 - DNA, 597 bp, Zea mays
  misc_feature: Ceres CLONE 1553651
  misc_feature: Encodes the peptide sequence at SEQ ID NO. 71670
  misc_feature (366)..(366): n is a, c, t, g, unknown, or other
  misc_feature (374)..(374): n is a, c, t, g, unknown, or other
cgattgggtaccgggccccccctcgagccctgcagtggtaaagggtacatctcctaaataatcctcagccggtacttctgctagtccgtgccatgcttatactggtgatcaagatgcctatgtctccaccaccgtcgctcagctgcttgcctctgtgttggctcgccggacctactgtttgcgctgtgcttaaggtcctactcaccggtcttctcgtcgacagcgccagtcgtgtctcccaccacgccgacactttttctccatcgctcgactccgtgctcagcgctctcaccatcaccgcgtctctcctcgccggtgttcgccggacatacgctcaacctcgccaccgtgggacttacctctccntcaaaccngtgttcgccgcagcctagccatcgtctacctctatgctcagcacgaaaccgctcgccctacagccctcgtcgcgtccaccgtccttgcaggccactggagctcccacccaaccttcggggaaaaggcccacccggtcccccccttttttttaatgtggggaccccccgggaaaaaaaaaatttttcttggggggggggccccccccgcgaaaaaaaaaaagtt

SEQ ID NO: 71670 - protein, 99 aa, Zea mays
  misc_feature: Ceres CLONE 1553651
  misc_feature (92)..(92): Xaa is any aa, unknown, or other
MLILVIKMPMSPPPSLSCLPLCWLAGPTVCAVLKVLLTGLLVDSASRVSHHADTFSPSLDSVLSALTITASLLAGVRRTYAQPRHRGTYLSXKPVFAAA

SEQ ID NO: 71671 - DNA, 650 bp, Zea mays
  misc_feature: Ceres CLONE 1553658
  misc_feature: Encodes the peptide sequence at SEQ ID NO. 71672
ccgggccccccctcgagccactgcagtggtaaaggaatcctcctcctcctttcccctcgccgatcccaggtcccaatcttttccttctccgccctcgccgccggccaacatgatgcacatgaccttctactggggcaagtccgccacgatcctattcgacggctggcgcacctccacgtggctcggctaccttctctccctcgtggccctgctcctcgccgccgccttttaccagtacctcgaggccttgcgggtccgcgtgaagctcatcgcggaaggatccgccaagccagcctcctccatccctccacccgccagctccgacccgcggacgccgctcctcgcgcccgccttcgccgggcgctggccgccgcgtgtggccgtggccgcgatgttcggggtcaaactcggcctcggctacctcctcatgctctccatcatgtcgttcaacggcggcgtgttcatcgccgtcgtcgtgggcctcgcgctcgggtacctcgcgttccgcaacagcgacggggagggattctttgttgttgaaaacccctggccctgggcctaaaggggggcgggcttcccggattgccttgtcccccaggtttgcccttgcttgtgaaagtttgaaaaaaaccccggggtttttaaaaaaa

SEQ ID NO: 71672 - protein, 150 aa, Zea mays
  misc_feature: Ceres CLONE 1553658
  misc_feature (2)..(139): Pfam Name: Ctr Pfam Description: Ctr copper transporter family
MMHMTFYWGKSATILFDGWRTSTWLGYLLSLVALLLAAAFYQYLEALRVRVKLIAEGSAKPASSIPPPASSDPRTPLLAPAFAGRWPPRVAVAAMFGVKLGLGYLLMLSIMSFNGGVFIAVVVGLALGYLAFRNSDGEGFFVVENPWPWA

SEQ ID NO: 71673 - DNA, 647 bp, Zea mays
  misc_feature: Ceres CLONE 1553676
  misc_feature: Encodes the peptide sequence at SEQ ID NO. 71674
  misc_feature (464)..(464): n is a, c, t, g, unknown, or other
acgattgggtaccgggccccccctcgagccactgcagtggtaaaggcgtgttttctttgctggagtcaagcttcgcgacatttctcggggcttcttcgcggttgttgccgtgttttctgtctttctgactccgctattcttggtccggatctttgcagtggaggccccgctgaagagatcgtttcagaatatgcaccagggctatcccaaagaaacactggtgcgtttccttaaggctagagagtggaatgtagcaaaggctcataaaatgattgtagaatgtttgaattggaggattcaaaatgaaattgatagtgtgctggaggtgagtcatcctgtcttgaatttaatccttccagatattactgtatatgttatcagaaagctaacgaaggttcccttaaagttctacgattctggtcttctcctaaccatttctcattttgattgtttattttattatngcagcaataccactctcaataatctgccctattgtgtgtgtttgtatagcaaaatttgatttttcttttctgatcatgtttgcactgtccatctgcagatgcttataggtccagtagatttatacaggtcaattcgtgatcccaacttattgccctgtcaggatacccaaggaggtctcccct

SEQ ID NO: 71674 - protein, 110 aa, Zea mays
  misc_feature: Ceres CLONE 1553676
  misc_feature (92)..(92): Xaa is any aa, unknown, or other
MHQGYPKETLVRFLKAREWNVAKAHKMIVECLNWRIQNEIDSVLEVSHPVLNLILPDITVYVIRKLTKVPLKFYDSGLLLTISHFDCLFYYXSNTTLNNLPYCVCLYSKI

SEQ ID NO: 71675 - DNA, 650 bp, Zea mays
  misc_feature: Ceres CLONE 1553681
  misc_feature: Encodes the peptide sequence at SEQ ID NO. 71676
  misc_feature (650)..(650): n is a, c, t, g, unknown, or other
cgattgggtaccgggccccccctcgagccactgcagtggtaaaggttgccgcaccgccgctgtagactgaagggaaagaggaggaagaattcgagtccaagtcttggagctctcgctttaggcggccagggtggaactgccccttgcccgtggttggtgaggcgattcgtggtcgagagcttccgtttctcttcggaggtgaagtggatctgacctactgtaggggaaagagcaaagtacattatcttgtacaaatgtgcattacgctacctttatcataaaccaaatcatctctgtttctgggaacagcaaccagtaatttcccatgcaacctcttggttgatggatgttcttcctgttgggtcagaaagagaaagtcaaacagatagtcaccctttactcatggagcatgcgattggcatcccaaggcatgatgttgcttctacttcgacacctcatcgagacaataatgatggcatggatcaactgccccgtgattcagaaagttcttctggaacaactgatgcatcttactctccgaatgctcctctagcaaggagagatgataatcgccttcggcgtcagcaaagtctaaattctggcttctggatatcaattgaactagctgtaaatcttagccagattatagn

SEQ ID NO: 71676 - protein, 102 aa, Zea mays
  misc_feature: Ceres CLONE 1553681
MDVLPVGSERESQTDSHPLLMEHAIGIPRHDVASTSTPHRDNNDGMDQLPRDSESSSGTTDASYSPNAPLARRDDNRLRRQQSLNSGFWISIELAVNLSQII

SEQ ID NO: 71677 - DNA, 632 bp, Zea mays
  misc_feature: Ceres CLONE 1553700
  misc_feature: Encodes the peptide sequence at SEQ ID NO. 71678
cgattgggtaccgggccccccctcgagccctgcagtggtaaaggggcgctctcatcctgcgcgcgatgacggcaacggggacacccgacgaggatgacggcagcaagaagctccaggcgttcatcctcacgctgctgctggtgctctccaccgccgtgactcccatcctctcgctgtcagtgccagacgacgaggtagcctgcgactgcgataaacccaaggcgcccaagccgtcgcacccgcccaagaccaagccctcccacccgtcgccgtcgccgaagcccaagaatcccaagccacccaagggcagcaccgggtacccagcgccggggcaccaaccgcccaagagcccctcctaccccccggtcgtcggccctcccaagggccccgtcacgcgcccgccagtcatgcgtccgccggtcgtcggtcctcccaagggccccgtcacgcgcccgccggtcacgcgtccgccggttgtcggaccaccggtgacctacccgccgatcaccggcccttcgacgacgccgcctgttgtcggaccaccggggacctacccggcgatcaccggccctccaacaaccccgcctggtggcggcccaccggtgaacctcccccccgatcactggccccgc

SEQ ID NO: 71678 - protein, 189 aa, Zea mays
  misc_feature: Ceres CLONE 1553700
MTATGTPDEDDGSKKLQAFILTLLLVLSTAVTPILSLSVPDDEVACDCDKPKAPKPSHPPKTKPSHPSPSPKPKNPKPPKGSTGYPAPGHQPPKSPSYPPVVGPPKGPVTRPPVMRPPVVGPPKGPVTRPPVTRPPVVGPPVTYPPITGPSTTPPVVGPPGTYPAITGPPTTPPGGGPPVNLPPDHWPR

SEQ ID NO: 71679 - DNA, 645 bp, Zea mays
  misc_feature: Ceres CLONE 1553701
  misc_feature: Encodes the peptide sequence at SEQ ID NO. 71680
  misc_feature (409)..(409): n is a, c, t, g, unknown, or other
cgattgggtaccgggccccccctcgagccactgcagtggtaaaggtagcgcaccaatcccatcctccacccaatcgaaggacctagcgagcggcagcggcggcggcgatcggagaagatggtgcgcaaggcgaaggttgagttcgacgagcagccgccggataacttcgacccgaagaacccgtatgccgacccggtggcgatgctcgagtaccgggaacacctggtgcgagagaagtggatccatatcgagaccgccaagatcatccgggagcgcctccgctggtgctaccgcatcgagggcatcaaccaccaccagaagtgccgccacctcgtcgaccaatacctagaggctacccgcggcgtgggttggggcaaggatgcccccgccgctgaaactcacgagcccnagaagaccgtcaagggcgagtagcggcgctgctgccttgcttctcgtgctgctggtcctggattgagagagcagtgggatcagttcgttgggatgtccccccgcttcagggagagaccgagagggactcccagcagcggtgcggctttcaaaggcagcccgaaggtttcctggacccccgccggtaaagttcctttgggggggaaaaaacccttgggtggggcccccagggccccc

SEQ ID NO: 71680 - protein, 104 aa, Zea mays
  misc_feature: Ceres CLONE 1553701
  misc_feature (98)..(98): Xaa is any aa, unknown, or other
MVRKAKVEFDEQPPDNFDPKNPYADPVAMLEYREHLVREKWIHIETAKIIRERLRWCYRIEGINHHQKCRHLVDQYLEATRGVGWGKDAPAAETHEPXKTVKGE

SEQ ID NO: 71681 - DNA, 659 bp, Zea mays
  misc_feature: Ceres CLONE 1553702
  misc_feature (16)..(16): n is a, c, t, g, unknown, or other
  misc_feature (20)..(20): n is a, c, t, g, unknown, or other
  misc_feature (504)..(504): n is a, c, t, g, unknown, or other
cgattgagtactgggntctnactcagacgatatgtaccggataaggtgcagccgtatggctgaacggcgggtgatcgactacttccagagtggccgccaacgaggtgcgactaacagcttttgctccctttagagacggttaattagcgcccttgtctgtctaatggacataggctgatccgtgtgtcgaaattgttatccgctcagaattcgacaccgcataagagaccgacgcatagaaaatacaggctgtcttgccaaatgagtcagctaactcaacttaatagttttgcgctcactgccctcttcccagtctggaaacctgacgtgatagctacattaatgaatcgcccaccgcgcgaggataggcggattgcgtattgggaggttttccgcttcctcgctcaatgattcactgcgctcggtcgttcggctgcagcaagcgttatcagctctctctaaggcggtaatacggttatccacagaatcctggtataacgcagngaataaacatgtgtagcaaaaggtcagcaaaaaggcccggacccgtaaaaaggcccccgttgcgtggcgttttctccataaggctcccgccccccgtagaccagcactcaaaaaaattcgaacgctcaacattcataaggtggacgaaacccccg

SEQ ID NO: 71682 - DNA, 646 bp, Zea mays
  misc_feature: Ceres CLONE 1553706
  misc_feature: Encodes the peptide sequence at SEQ ID NO. 71683
  misc_feature (547)..(547): n is a, c, t, g, unknown, or other
  misc_feature (617)..(617): n is a, c, t, g, unknown, or other
cgattgggtccgggccccccctcgagccactgcagtggtaaagggtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacggaggcggtggcggctacngcggtcggcgcgagggtggcggtggcggctaccgcggcggtggcggcggcggctggagggactgatgtgntggcccatcctggcttcggccgagttatc

SEQ ID NO: 71683 - protein, 159 aa, Zea mays
  misc_feature: Ceres CLONE 1553706
  misc_feature (10)..(81): Pfam Name: RRM_1 Pfam Description: RNA recognition motif. (a.k.a. RRM, RBD, or RNP domain)
  misc_feature (48)..(153): Pfam Name: GRP Pfam Description: Glycine rich protein family
  misc_feature: SWISSPROT Homolog: EC 5.2.1.8 Peptidylprolyl isomerase
  misc_feature (139)..(139): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGGYGGGRRDGGYGGGGGYGGRREGGGGGYGGGGGYXGRREGGGGGYRGGGGGGWRD

SEQ ID NO: 71684 - DNA, 667 bp, Zea mays
  misc_feature: Ceres CLONE 1553709
  misc_feature: Encodes the peptide sequence at SEQ ID NO. 71685
cgattgggtaccgggccccccctcgagccactgcagtggtaaaggtgaccctcttcactcgcttgaccctcctcttcactcgcttctcccagaagtcacgcaccaaacaccaccaccaaagaaggcgagaacgtactccgtccctcccctcccctcccctccccttcccctcgaggctccaggaccgtctcctcgcctgctcatccgccgctgcttcccttctctgggctcggagaaccggagagaagcgcgcgcggccatggcgtccagcgcctctcggttcatcaagtgcgtcacggtcggcgacggtgccgtgggcaagacatgtatgctcatctgctacaccagcaacaagttccccactgactacatacctacggtgttcgacaatttcagtgcaaatgtagttgtggatggcaccactgtgaatttgggcctttgggataccgctgggcaggaagattacaaccgcctggagcctctaagctaccgaggtgcagatgttttcgtggctgcattcccatttgggagccgagctagctttgaaattttcctaaagaattggataccggaacttcaaatttttggccccgggggggcccttgtttttggcagggccaaattgggttttccgggaaaaacaaccttccttgggggaaccccctgg

SEQ ID NO: 71685 - protein, 136 aa, Zea mays
  misc_feature: Ceres CLONE 1553709
  misc_feature (10)..(131): Pfam Name: Ras Pfam Description: Ras family
MASSASRFIKCVTVGDGAVGKTCMLICYTSNKFPTDYIPTVFDNFSANVVVDGTTVNLGLWDTAGQEDYNRLEPLSYRGADVFVAAFPFGSRASFEIFLKNWIPELQIFGPGGALVFGRAKLGFPGKTTFLGGTPW

SEQ ID NO: 71686 - DNA, 628 bp, Zea mays
  misc_feature: Ceres CLONE 1553730
  misc_feature: Encodes the peptide sequence at SEQ ID NO. 71687
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
ccgattgggtaccgggccccccctcgagccctgcagtggtaaagggcaagctcgaccaccaacccagctcgctcgtcccagctgatcaggtcgggcacctagtagcgacctgctcgatcatcagtgtagagtgtcggtaggtgtctgtctctcttggtggctggttgcaacggtcatggcgacgtcgtctcgtcgggtgcccttgctgctgctgtgcctgggcgtgctggtgtcctgctccttcgcggcgggcagcttggaccaggagctggacatcacgtggggcgacgggcggggcaaggtccttgacaacgggcggctgctgacgctgtcgctggaccgcacgtccggctccgggttccagtcccggcacgagtacctgttcggcaagatcgacatgcagctgcggctggtgccgggcaactccgccggcaccgtcaccgcctactacctgtcgtcgcagggcggcgcgcacgacgagatcgacttcgagttcctgggcaacgtgtccggcgagccctacacgctgcacaccaacgtgttcacgcgggggcaggggcagcgggagcagcagttccgccttctggttcgacccccaccggccgaaattttttccnnnaaaacctta

SEQ ID NO: 71687 - protein, 151 aa, Zea mays
  misc_feature: Ceres CLONE 1553730
  misc_feature (28)..(149): Pfam Name: Glyco_hydro_16 Pfam Description: Glycosyl hydrolases family 16
  misc_feature: SWISSPROT Homolog: EC 2.4.1.207 Xyloglucan:xyloglucosyl transferase
  misc_feature (148)..(148): Xaa is any aa, unknown, or other
MATSSRRVPLLLLCLGVLVSCSFAAGSLDQELDITWGDGRGKVLDNGRLLTLSLDRTSGSGFQSRHEYLFGKIDMQLRLVPGNSAGTVTAYYLSSQGGAHDEIDFEFLGNVSGEPYTLHTNVFTRGQGQREQQFRLLVRPPPAEIFSXKTL

SEQ ID NO: 71688 - DNA, 674 bp, Zea mays
  misc_feature: Ceres CLONE 1553736
  misc_feature (206)..(206): n is a, c, t, g, unknown, or other
  misc_feature (207)..(207): n is a, c, t, g, unknown, or other
  misc_feature (242)..(242): n is a, c, t, g, unknown, or other
  misc_feature (293)..(293): n is a, c, t, g, unknown, or other
  misc_feature (298)..(298): n is a, c, t, g, unknown, or other
  misc_feature (363)..(363): n is a, c, t, g, unknown, or other
  misc_feature (365)..(365): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (370)..(370): n is a, c, t, g, unknown, or other
  misc_feature (373)..(373): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (522)..(522): n is a, c, t, g, unknown, or other
  misc_feature (523)..(523): n is a, c, t, g, unknown, or other
  misc_feature (524)..(524): n is a, c, t, g, unknown, or other
  misc_feature (525)..(525): n is a, c, t, g, unknown, or other
  misc_feature (526)..(526): n is a, c, t, g, unknown, or other
  misc_feature (527)..(527): n is a, c, t, g, unknown, or other
  misc_feature (528)..(528): n is a, c, t, g, unknown, or other
  misc_feature (529)..(529): n is a, c, t, g, unknown, or other
  misc_feature (550)..(550): n is a, c, t, g, unknown, or other
ggagctccccgcggtggcggccgctctagaatagtggatcccccgggctgcaggaattcgtctcacccctagaaaaaaacccctcacactcccatccagccgccaccaggtgcagagtctttcgtcatctcttctccggcgaagaacccccagtcgcccaccagatcacttgttaaactttgttgaggggtgatggcggtttcttnntcgcaaacccttcaaacttcccgaggcagggcttnaaaaagcttgatgagtaccttctcactcgcagctacatcactggctaccangcttncaagggatgacttgggttggcctacacctttccttttttttgggggggggcccccccccccccgncnnnnanaanannnnnnnatttttttcccccccccccaccacgggggggggagaaaacaaccaattgaggggcccccccgcggggggggggaaaaaaaaaaataatattttctcccaaaaaagagccccccccgggggggggggggagaggggaggggnnnnnnnnaaggaggcagcagaggagggnaatgttttttttgcggccccccccatcccccaaggggtggtgtgtgggaaaaaaaaacccccccccccccttttttttttttttgggtgggggagaaaaaacacgcacaaacatttttggtttt

SEQ ID NO: 71689 - DNA, 627 bp, Zea mays
  misc_feature: Ceres CLONE 1553740
  misc_feature: Translation starting site: 414
cgcggtggcggccgctctagaactagtggatcccccgggctgcaggaattcgtctcacccctagaaaaaacgtgctcgatcttcatctcgactgtcgatcaccgggaagctacgctacgacgaagcatgacgttcgtcacctccctcgtccaggtcgcacccctgagaacatcctcgtcctattccttccttggccactctaccctgctcggccgcactgataccacgtagcagaagatgaccatgcacagggccgaggccaacggacgagtggctcccaggacattctctcccccgtctacctcgacggaaacctgccgggtgacaatgctttcgacccgttgggcctgtacgaggacccggagaacgtgacgtggtcgctgcacgccgagctggatgacgtccagtggacgatgaatggcgtcgtcggccatgctgatcacggatgtgctgaccaacggctggatgacctacgcgtcgtagtgctacgaggtcgggaagtcgtagtacttatagacgtcgtcgacgctgttctggatagagatcatcctgcttcgctacgttcagatgcggaggatgctggacatcaagaactgggcagcgtgaaccaggacttgtcattcagac

SEQ ID NO: 71690 - DNA, 860 bp, Zea mays
  misc_feature: Ceres CLONE 1553741
  misc_feature: Encodes the peptide sequence at SEQ ID NO. 71691
  misc_feature (9)..(9): n is a, c, t, g, unknown, or other
  misc_feature (11)..(11): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
ttttttttncnttttgaaaaagtatactcattccaacacnnnnnnnncctttctaacaatacccgcggtggcggccgctctataactagtggatcccccgggctgcaggaaattcgtctcacccctagaaaaaaacacactttacttgacaagggaatataaccaaatagacaccttatcaagtccaagcacacctggaagcaggatgaatatggatgtggataacgaaaattatcaacgtacggttacgttggccgatggtcccgatccacaaagtactctgacgagttcataggctgcaatacaaatatccaggtgtcctggtctccgaatattttgatctcccagacacgccttggaataattccttaaatccatgtaaaaagtaataggctataagaagttaaatcaaatcagattagccacccccccccccaaggtggggagggggaggagggcgaaaaccatgcaaaattttttatatccccccccacccctatcaatatggctacatatttactcccgacccccctcatatcaaccccacctcaaaccatcaacatcctccacaattttagaaccacaccctctattacatcaatccttggggtattcacccaactatataatcaccagcacaactacacacacctatccgatactacccgccccttctctgtccatcccaatagaccaccccatcaaccagcacaaaaccaacaagggacaaggacctccgatgtcagtttatcaaaacacacccccccccgcagagaactcacaaaggcggtgtagacgaacacccttatgaagtaaatcaccaaaaaacaacgaatgttccgacacccacacaccttata

SEQ ID NO: 71691 - protein, 29 aa, Zea mays
  misc_feature: Ceres CLONE 1553741
MNMDVDNENYQRTVTLADGPDPQSTLTSS

SEQ ID NO: 71692 - DNA, 663 bp, Zea mays
  misc_feature: Ceres CLONE 1553742
  misc_feature: Encodes the peptide sequence at SEQ ID NO. 71693
tggagctccccgcggtggcggccgctctagaactagtggatcccccgggctgcaggaattcgtctcacccctagaaaaaggatgtggacgaacgaacgtcatatcacatggacgtccatttcttgccactacttgctcggttgttcttttatctcggaacgcggtaggggttgcggattgggagcaaaggaggagagggagtgctgggccgccgccggctgcgaacgcggaggaggcagcttccaccaatcagtgcaccctcatcctcaaaggctgttccaacagcatggaaaaaatctacgccatcaaaactcctcataagaaaagaaaatcacagtatgagctgagcaatccaaagttgccgccacttaaatgcaagtttggcaaaaggttatcttgccacagcgttgagtctgcaaccacagaaagtttgggatacgattgcattttcatgaacaagacctctgggacggacatggtcagcatacccgaagtattggactcctgtgagagcactataagactatttggtgggtgcatcgaactagtggactcaaaaactggaattcaggaacagtctttgagaaaacaattgagatccggacatctgcattgagtcgctcgagcaacacttttcatcagaggctttatcgtcttcccatc

SEQ ID NO: 71693 - protein, 204 aa, Zea mays
  misc_feature: Ceres CLONE 1553742
GAPRGGGRSRTSGSPGLQEFVSPLEKGCGRTNVISHGRPFLATTCSVVLLSRNAVGVADWEQRRRGSAGPPPAANAEEAASTNQCTLILKGCSNSMEKIYAIKTPHKKRKSQYELSNPKLPPLKCKFGKRLSCHSVESATTESLGYDCIFMNKTSGTDMVSIPEVLDSCESTIRLFGGCIELVDSKTGIQEQSLRKQLRSGHLH

SEQ ID NO: 71694 - DNA, 636 bp, Zea mays
  misc_feature: Ceres CLONE 1553747
  misc_feature: Translation starting site: 106
agtggatcccccgggctgcaggaattcgtctcacccctagaaaaaaccagcggcatctatagcaaccggtccaacactttcacgctcaggcgctcagctctagcaatggctgcctccaccatggcgatctcctccacggcgatggccggtacccccatcaaggtgggctccttcggcgagggccgcatcaccatgcgcaagaccgtgggcaagcccaaggtggcggcgtccggcagcccctggtacggccccgaccgcgtcaagtacctcggccccttctccggcgagcccccgagctacctcaccggcgagttcccccggcgactacggctgggacaccgccgggctgtccgccgaccccgagaccttcgccaagaaccgcgagctggaggtgatccactcccgctgggccatgctcggcgcgctcggctgcgtcttccccgagctgctctccccaaaccggcgtcaagttcggcgaaggccgtctgggttcaaggccgggtccccatatctttccccgaggggcgggctggaactaaccttggcaaacccccccccctgattcccccctccaaaaacaatccccccccccatctggggccccgccccagcctcgtggcctccctgggccgcccg

SEQ ID NO: 71695 - DNA, 631 bp, Zea mays
  misc_feature: Ceres CLONE 1553748
tggcggccgctctagaactagtggatcccccgggctgcaggaattcgtctcacccctagaaaaaagtgtgaaaaaataacactgaaagataaatccttgggggattgcaagctttcgctgtgcggttgcggtcgctccccttcccgactccggccagaagcagcgaccgtgccggcagtcggttactccactcggcggcggcccatcctttcctgttttctcctccagtcctacaaatacaggacacaacaggcttgctcttgtgatactctattaaggtacggcgtgaagatgagagtcctcttcatctgtttttcgctaatatagattaaagaatgttttgcttgaggaactactggtcgcctgcatttgcttcagtaaaggaggggcctgttcgacatcatataaagtttaattgtgtagtggtttgtggtgccaggggtccaagaccgagatatccccgtgtatggaaaactcgtaagaaaattgggactatttccaagtcacagaagcttgttgaatgtattaaaggtctgtctaatgtaaaggaggaagtttatggagcacttgactcttttgttgcatgggaactggagtttcccttgatagtagtaaagaagcactgaagaaa

SEQ ID NO: 71696 - DNA, 686 bp, Zea mays
  misc_feature: Ceres CLONE 1553750
  misc_feature: Encodes the peptide sequence at SEQ ID NO. 71697
ggcggccgctctagaactagtggatcccccgggctgcaggaattcgtctcacccctagaaaaagggttctacttctagcccgggccgactccactccaatccaatcctggggcgagcgactgcctccttccctcgatctattccccatcttgtcctccctttgctaaaaataacgaggcagaggcatcttcgatttgacgtgcgcttcctcttcctcgctcgctctcggtcgcagtgatggctgatgtcgacgagtaccgttgcttcattgggaacctgtcctggtcaacgactgatgaaagccctcaggatgcgtttcacaaattcggcaacctcactgaggcaaaaggtggttcttgacaaatttttcaggacgttctcgtggttttcggcttttgtaactttttgatgaagaaccaagccctgggaggatggctattgagggaatagaatgggactgggactttggaccgggaggaaaattccactggttgaaaaaagctccacccacaaagggaccttgggtaaaaaacccttaaatgggtgacccgtgaattataaaaccgccgaggggtgggattcttctttttataaaccgtggggccctgaaactaatggggggggggggcctggccacccacaaaaagaggctgggtctggggctagcgctcttccgttaacactaa

SEQ ID NO: 71697 - protein, 40 aa, Zea mays
  misc_feature: Ceres CLONE 1553750
MADVDEYRCFIGNLSWSTTDESPQDAFHKFGNLTEAKGGS

SEQ ID NO: 71698 - DNA, 835 bp, Zea mays
  misc_feature: Ceres CLONE 1553751
  misc_feature: Encodes the peptide sequence at SEQ ID NO. 71699
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (16)..(16): n is a, c, t, g, unknown, or other
  misc_feature (19)..(19): n is a, c, t, g, unknown, or other
  misc_feature (20)..(20): n is a, c, t, g, unknown, or other
  misc_feature (24)..(24): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (705)..(705): n is a, c, t, g, unknown, or other
nnnttttttttgggtnttnntatnaataannnnnnnnngttaannnnnggagtcccgattccccgtggtggcggccgctctatactagtggatcccccgggctgcaggaattcgtctcacccctagaaaaaggattcccccgaaaccctcccccaaaaccccagagcggagaagagcgcaagatgttcggcttcgggcaccacggccaccacggccagaacccgccggcgcacggcggcgtgcaccagcccaccttcaagatcttctgcaaggccgacgaggggtactgcctcaccgtccgggacggcaacgcggtggtggccccccccaaccctctctacaagcaccagcactggtacaaggcacatgccttttttgctcctttgtcgagggacgagggagggggaatccttgttttccccccccccccagggggggggggggggggggtcacccctccaccccccttcccttggtgccccccccccccccccccccgagacccccgcggccccccgccccccctccgcggacgccaacagccgtcgcgaacgcgcccgtgctctccacgcaatggatcactttggccgtacgtatggcctctgtgggggagcttcgcgtgcgcgcggttcatcaagcgatagatgcgtcgggttcccgcgtgcgcaggccgtcgggatgtgagggcacaccttgtccgcacanaagagcttcctacccgccctggtcgcgcgttatccggcccatatcccacggggcggtttttaagtttgcggcggcgccatacgacgcgcaccacactgaacctgccgcgcgcccaccctatcgtccccca

SEQ ID NO: 71699 - protein, 153 aa, Zea mays
  misc_feature: Ceres CLONE 1553751
MFGFGHHGHHGQNPPAHGGVHQPTFKIFCKADEGYCLTVRDGNAVVAPPNPLYKHQHWYKAHAFFAPLSRDEGGGILVFPPPPGGGGGGVTPPPPFPWCPPPPPPRDPRGPPPPLRGRQQPSRTRPCSPRNGSLWPYVWPLWGSFACARFIKR

SEQ ID NO: 71700 - DNA, 674 bp, Zea mays
  misc_feature: Ceres CLONE 1553752
  misc_feature: Encodes the peptide sequence at SEQ ID NO. 71701
ggatcccccgggctgcaggaattcgtctcacccctagaaaaaagaccccatccatcgattggaacccagatccgcaggccgcagcacaagagggtgggatcggatcggatcggagcagagcaaaggggacaaccgaccagaatccgccggcgaccaccatgggctccgcgagccgtgccgtctcgtgcctgtgctgcccctgcaagtgcctggcgtgcgggctcctgagctgcctgtgcagcatcctcttctcgctcgccgtcgtcctgggcgtcttctccctcttcctctatttcttcttcaagccgcacatgatttgtgggacccccccaactcggtcgttggtctcctaattccctgctggtcggcgttttcttttgcttgccttctaactttacaggtcatcatgaacgggtgcgctaactccccccaccggtgtgggggtttttttttaagacactattttccagacggctggacccttgttttctctcctccgttttttattgttaaacctcctgttcttgctcctttttttttacggcttctctaggctttccccctctttttcactccccgggtttacgcggagcctgcccttttctgtgcgggggcagaagttccccccccctcccaattaccaccccgtgatctatttctatcaggtcattttt

SEQ ID NO: 71701 - protein, 64 aa, Zea mays
  misc_feature: Ceres CLONE 1553752
MGSASRAVSCLCCPCKCLACGLLSCLCSILFSLAVVLGVFSLFLYFFFKPHMICGTPPTRSLVS

SEQ ID NO: 71702 - DNA, 619 bp, Zea mays
  misc_feature: Ceres CLONE 1553754
  misc_feature: Encodes the peptide sequence at SEQ ID NO. 71703
  misc_feature (332)..(332): n is a, c, t, g, unknown, or other
gcggtggcggccgctctagaactagtggatcccccgggctgcaggaattcgtctcacccctagaaaaaaaacgccacttgttctccctccctctctgcctgaccagctaggatcaccgtacgcttcagtggtgatggcgtcctcaagcgggctgatgagctgcagcgccgtgggcgtgcccagcctgctggcgccgtcgtcgcggtccggccgcctggtgtcgttctgcaccaacgccaccgcctctggccgcttcaccatgtccacgtagtggatgcctggccagccacgccctgcccacctcgacgggttcctcatcccgggggacttcngacttccatccggtgggcccctcccgaccccttcccggaaaaactttccagacgggttcaggcattcaaagggtgtccctttgcccctggcccttgccttgccgtcccccaggaatcccagggggcccaaaaagcctctttgccccttggggaaaaattgggttttaaaagcccccagggaaaagggggagggcccccccccccggggggggaaagcccccgttacaattggggccccccccaggggccctggggggtaaaaactttttccaaaacccctccccggg

SEQ ID NO: 71703 - protein, 45 aa, Zea mays
  misc_feature: Ceres CLONE 1553754
MASSSGLMSCSAVGVPSLLAPSSRSGRLVSFCTNATASGRFTMST

SEQ ID NO: 71704 - DNA, 878 bp, Zea mays
  misc_feature: Ceres CLONE 1553761
  misc_feature: Encodes the peptide sequence at SEQ ID NO. 71705
  misc_feature (1)..(1): n is a, c, t, g, unknown, or other
  misc_feature (9)..(9): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (29)..(29): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (466)..(466): n is a, c, t, g, unknown, or other
  misc_feature (618)..(618): n is a, c, t, g, unknown, or other
naaaaaaantggggaaannntaaatnttntttnnnnnngggggcaaccnnnagacacacagaatactcaatcggagttccgcaactctatactagtggataccccgggctgcaggaattcctctcacccctagaaaaaagcgccaaccccggaaaggcggaaacccatcgcaactaatccccaaccccaaacctccaatccacccatcccctcctcatccactccgggcggccatggcctgctccttcgccgccgcgaccgtcgtctcttccgcccccaccccggccgccaggcccctcgccgttgccccgcagtccgtctctgtctcccgctccgcggttgtccaccgccgccagggagctgcggtctcggtcacctccttatattgcgcggggttaacaaagttaggaggcccgtgttttttttttccccccccccccccggggggggggggggggggggacanacaccccccaccaactcccccaaatcctaaagtttcgtgtgttttgaaccacaaaaatatttaatccaaacacctgaaaacgttttgtcggggagttgaccattccggatgacacacaaaaaaggcattccaccacaccagatttggtctgnaatgccttaatggggaaatttcttcctgtaattcgctacagtcccaaaaaccgtcaaagattatgattgcacttctagggtttagcgccgttataaacgagaaacagtgggatcacactttcgaacacaccagatcccgcccactcgtagaggactgaataaatcatccacacaggagagttatgcccacgccattacgcccccccgtagttcccttgtacccgatgacccgtacgggtgtcacacatcgagcgaacatg

SEQ ID NO: 71705 - protein, 98 aa, Zea mays
  misc_feature: Ceres CLONE 1553761
  misc_feature (78)..(78): Xaa is any aa, unknown, or other
MACSFAAATVVSSAPTPAARPLAVAPQSVSVSRSAVVHRRQGAAVSVTSLYCAGLTKLGGPCFFFPPPPPGGGGGGDXHPPPTPPNPKVSCVLNHKNI

SEQ ID NO: 71706 - DNA, 693 bp, Zea mays
  misc_feature: Ceres CLONE 1553768
  misc_feature (505)..(505): n is a, c, t, g, unknown, or other
  misc_feature (506)..(506): n is a, c, t, g, unknown, or other
cgcggtggcggccgctctagaactagtggatcccccgggctgcaggaattcgtctcacccctagaaaaacccccttccccgcttcgacaagtctcgtcccccgcccccttattccattacgagcaactccgccgccgccgccgtaaagccatctcccccatccgccgccgccgccaccgctgctggtgggacgggccgtgcgcccgttccagcgaaaaggatcagcgggtcggacgacccccggcgaggtcgggccccggggggatcgagatggtgctggggggagctttacggccatccccgcccttactttcctcgggcctgaagggggacctttacggccttggggctcttgtttctcgccccccccccccctttgccgggcgggggggcacccctaggaatccgggggaactttcgttttaaaaggggggccgcctctggggtattggtctttttaaaaggcaaaaaccccccccactccccccccccacaaaattttccnnaataaacacaaacactaaagcggtggcgggcgtgaaaaccctcaggaaacacccgaacccctccaccgcgggcttggcaaccgcaattaaaagcccccttcaccgggaaaaaacctcccctcctgtttttttagtaccccccccaaaaaaggacttcccctttcccaatctatttcgttaacttttg

SEQ ID NO: 71707 - DNA, 633 bp, Zea mays
  misc_feature: Ceres CLONE 1553769
  misc_feature: Translation starting site: 236
cgctctagaactagtggatcccccgggctgcaggaattcgtctcacccctagaaaaaccccctccgcctcctgctctctctcgcctctggttggcagagctctcttgaagcctcgagactcgtctcgccgctgctccctcagctctgccgctgcgtgcctccgttagctgttgcattgcagcgcagccccgcgagccttgagctgctagctcgcccttcaccacagtcctcagacatggagttcgaagaccgctgccacaaggtccaggagcccaagttcgactgcctgctcttcgacctcgacgacaccctgtatccgctgagcgccgggatcgcaggccatgtcaagaagaacattgaagattacatggttgagaagctgggtattgacaagaacaagatcgaaaacctggggcaatctgctggaaaaaaactacggcaccacgatggctggactcagggccactcgctacagcttcgattaacaagaaaacccccccttcgtccagggaagggtgccgaacaaaaaattcaacctggaccctttctcaagccatttcccagaaaccgggcacccccaaattctatttccccaccggggaactggcccaccccgggaaaacccttaaaaag

SEQ ID NO: 71708 - DNA, 635 bp, Zea mays
  misc_feature: Ceres CLONE 1553770
  misc_feature (390)..(390): n is a, c, t, g, unknown, or other
caccgcggtggcggccgctctagaactagtggatcccccgggctgcaggaattcgtctcacccctagaaaaaaggaggagcagaagaagcgcggtttgctgacgtctccatcccatcatgtattatcctcagcctaccgtctccttggcggcggcggttgccctcctccgcccctcactccgccgccactctcaaagggcgtcatcccttctccgctcctccacgccgcctccatgggttagtgcgaggaggaggacggccgtctccgacgacttcttcaccgtcgagttggacgctactggagtggaaccgtgaccggattccatcgacgacgggctcccctctccttgttacgcacctctcggggggggggcggaggctgccgtccancacctcaagtacgccagcacgctggaacgcctcggcctaggggacctctcctcccccgaatcccgcgcgcggcgcgttgaactggggctgggctggagggaccctggacaagactggcgcgcaacctccgacccccgggctcgtctccgtcgaaaagaacaggccccccggccccctgcgcctggacggaatcttgggccacctccttaacccccgggtggtttagggggggtggaaacaccccc

SEQ ID NO: 71709 - DNA, 615 bp, Zea mays
  misc_feature: Ceres CLONE 1553771
  misc_feature: Translation starting site: 226
acccgcggtggcggccgctctagaactagtggatcccccgggctgcaggaattcgtctcacccctagaaaaagcctcggcctctgctcccggctcccccacggtgctccagccgctagcctgcgattccgcgagtacgccaccaccaccgagcctggactaccgccgccgcccttcggccgatatcttcagcggggaacagcgcccgccagatcccgcccctgcgatggagtccgtggcgaacccgagtgcatacccgctggctgatgggcacctgacgaggggcatcctcgatatcatgccagcaggccgcctactacaagcagcttaccaagggagcgaatgaagcgactagaaccctgagtaggggcatatcggagtttgtactgatgggtgcggacacctagcctctagagatcctgcgccaactctccttgttagctgaggataagaacgtgccgtatgtgtttgttccatcggagcatgctcgtagccgtgcttgtggtgtgacaagagctgttatcgcttgctcaaagccctggtgatgatggtagcccacctgaaactaccgaattgagggcctcaagggactccctttgaaaatctttcctggtcc

SEQ ID NO: 71710 - DNA, 609 bp, Zea mays
  misc_feature: Ceres CLONE 1553772
  misc_feature: Encodes the peptide sequence at SEQ ID NO. 71711
ggagctccccgcggtggcggccgctctagaactagtggatcccccgggctgcaggaattcgtctcacccctagaaaaaagggcagagggagagggagggcacaccatggccgtggggggccttctgcggggcctcgtttcgccccccgcctggctgccctgccatgagctcttcgcctcctggcaccactggcttccctccctcccgcgcctccgcccgcccgcatccgacggcttcaagcttctcttggtgctgctgctcttctccgccgctctagccgaggtccgctacatcgcctcctcctcatggcgcccacgcttcgtccaggcgaccgagccgtcgcgataaagtacatactcgctcggaggcatctattgggatataggtttttcaagaccgactgcttgcaaattatgtgtcaataagagttggctttattagaaggattgccaccccggaaacttctttaggtcccaaaagggcgcttatttggaatgggggtccccctaaggggaattttccccgcccccacgtctttggtcaccaagggaaaaccaggggtgggtttggggaaaacactcctaaaccccggggttgggaacatgtgcc

SEQ ID NO: 71711 - protein, 80 aa, Zea mays
  misc_feature: Ceres CLONE 1553772
MAVGGLLRGLVSPPAWLPCHELFASWHHWLPSLPRLRPPASDGFKLLLVLLLFSAALAEVRYIASSSWRPRFVQATEPSR

SEQ ID NO: 71712 - DNA, 637 bp, Zea mays
  misc_feature: Ceres CLONE 1553775
  misc_feature: Encodes the peptide sequence at SEQ ID NO. 71713
ggagctccccgcggtggcggccgctctagaactagtggatcccccgggctgcaggaattcgtctcacccctagaaaaaggatgcgatcataccagcactaaagcactggatcccatcagaactccgaagttaagcgtgcttgggcgagagtagtactaggatgggaattgctagtacgatttcttctctcctccaaaccggccaagccaccaaccagcgccccccaccgccgcctttttatttcatccacgctgctcgtgctcgctgcctgcttctcgcgcgatcgtctcggcctctcgggattctagagtggcggccggctctccgcctgttcttgtcgtcgctgctcctttcccaggatgtcggaacgttctgagagcgcaactgaaaagattatgagcagcatcatggataccattgctgacaaccttcctaagcagaagtctgggaaatttgatccaggttcagtctctgacaaagtgaagaataagctgtttggtcgtcagaagaccttgcatggagttctgggtggtggaaaacctgctgatgtgctgttatggaggacaaaaaatatcatcgagtgttctggctcttgcacagctatttgggttttctttgagtggctcgactaccacta

SEQ ID NO: 71713 - protein, 92 aa, Zea mays
  misc_feature: Ceres CLONE 1553775
MSERSESATEKIMSSIMDTIADNLPKQKSGKFDPGSVSDKVKNKLFGRQKTLHGVLGGGKPADVLLWRTKNIIECSGSCTAIWVFFEWLDYH

SEQ ID NO: 71714 - DNA, 574 bp, Zea mays
  misc_feature: Ceres CLONE 1553778
  misc_feature: Encodes the peptide sequence at SEQ ID NO. 71715
  misc_feature (445)..(445): n is a, c, t, g, unknown, or other
cgcggtggcggccgctctagaactagtggatcccccgggctgcaggaattcgtctcacccctagaaaaaagagagcacatagagtggagtggtggacagaccatggagctctgcgtctctacacccccatcctccgtccgcgccaccgccgcgcccatatccttcgccccgccccgacgtggcgcgtctgcctccaccgccgttccgccccaccgccgcatcccaactcgaggctggcgctgcgccagcgcggccgtgcctggcccggtgccctccgaagagccggcatccgcctcctacgccgtcgtcgtctcggacaagcccgatacgcctgccgacgacaaggccgaggaggttagcgccgcgcctagtggctccgcggaagcgcctatggcagagctagtgccgtcagaggcgtccccgtccccagatgatggcggcctgnatgagatttctaaggcagtgaacatttgagtgtctccaacttttatcctcactggatttggtgcttttattgctttatggatcctatcttctggttggtgctgcagttgattcagtccccctgctccca

SEQ ID NO: 71715 - protein, 123 aa, Zea mays
  misc_feature: Ceres CLONE 1553778
  misc_feature: SWISSPROT Homolog: EC 2.4.1.21 Starch synthase
  misc_feature (115)..(115): Xaa is any aa, unknown, or other
MELCVSTPPSSVRATAAPISFAPPRRGASASTAVPPHRRIPTRGWRCASAAVPGPVPSEEPASASYAVVVSDKPDTPADDKAEEVSAAPSGSAEAPMAELVPSEASPSPDDGGLXEISKAVNI

SEQ ID NO: 71716 - DNA, 632 bp, Zea mays
  misc_feature: Ceres CLONE 1553779
ggagctccccgcggtggcggccgctctagaatagtggatcccccgggctgcaggaattcgtctcacccctagaaaaagactctcacgcacttcgctcttccgaagagcgcactacaccccagaggccggaaccgcaagttcagattccctatgcactgccacctcaccgacgcgctcactcgcagcccatcccgcgtcctcacaggccagggacagctagcaccggcggcatccagccatgtgcggcagtcccatcttgtccgacatcatatctgcgccgccgcctctgcttgtcacagcggaccacctctgcgacgacagcaagaagtcgataacgtctgtagcattcacgatcatcaccttcatgtacaggagcacgactacgattctaggacgacttctacgagtcgaggtggatttcgcgagtacgactcgagttcatgatcaccctagctcagccttttggagcgcccagagagcgctcctcgaggtggactacagggtgctgcacctggtgctcatagtcctggtgcaaatcaaatcaaacgagagtaacaacctgttccgggtttctcctctgggccatgggggatcatggcctgctaagatcaaaaactctccctagggtcgtg

SEQ ID NO: 71717 - DNA, 642 bp, Zea mays
  misc_feature: Ceres CLONE 1553782
  misc_feature: Encodes the peptide sequence at SEQ ID NO. 71718
  misc_feature (604)..(604): n is a, c, t, g, unknown, or other
  misc_feature (630)..(630): n is a, c, t, g, unknown, or other
  misc_feature (642)..(642): n is a, c, t, g, unknown, or other
tccccgcggtggcggccgctctagaactagtggatcccccgggctgcaggaattcgtctcacccctagaaaaagccaagaccctcccccgtttacaagccagaaggcaagctataggcgaaacttcgggggtcgtcgagggttctcgaccctcccttcccctctctcgcccgctcgctccctcaccgccggcgttctcgccgccagctacggacggggcacactgcgcagggtcccagccccgcctctcacccgaacgtcttcgctcccctcaccgggtaggcgtcgcgctctactggcaccaccccggccctcgcgctctactggcaccggaccggcgcggggtggcgcggagacctgtcccggccaggagaccgttccgtgctataccggtgaagatgctctttgcatagctcaagctccaaactgatggattctgatgacaagaagtttggaaatgggccaagggagctcactggtgctgttgatttgatcaaccactacaaactgctgccacaccatgatttcttttgcaaagaacctttgccactggcaatatcagatacacattatctttcacatattgtgggagacactgcaattcnaaaacgagaaagaatggagttggatncacttgttcagn

SEQ ID NO: 71718 - protein, 71 aa, Zea mays
  misc_feature: Ceres CLONE 1553782
  misc_feature (59)..(59): Xaa is any aa, unknown, or other
  misc_feature (68)..(68): Xaa is any aa, unknown, or other
MDSDDKKFGNGPRELTGAVDLINHYKLLPHHDFFCKEPLPLAISDTHYLSHIVGDTAIXKRERMELDXLVQ

SEQ ID NO: 71719 - DNA, 668 bp, Zea mays
  misc_feature: Ceres CLONE 1553783
  misc_feature: Encodes the peptide sequence at SEQ ID NO. 71720
ggagctccccgcggtggcggccgctctagaactagtggatcccccgggctgcaggaattcttctcacccctagaaaaaactcccccacaccacactcgagagccatctcccagcacacgagcgcgatggcttccaccaccaccaccaccttcctcgccatcttgctagtcgtggcagcttcggcggcgccggcacggtcctgctcaccgcgcgacatccacgcgctgctgagcgtgaagcaggcgctgggcaacccggcgtcgctgtcgacgtggacgccggcgtcgcccaactgctgcgcgtgggaccacctccgatgcaacgacgccgggcgcgtgaacaacgtcttcatcgacggcgcggacgacgtgcgcggccagatcccgtcggcggtgggcgggctgacggagctcatgtcgctgacgctgttccggctgccggggctgacgggcgccatcccggcctgcctcacggcgctgtcgaacctccagttcctcaccatctcccacaccaacgtgtccggcgccatcccggaagtccctgggcgcggctgcccgggcctcaacttccggggacctggtccagcaaccgggttgacggggcggcattcccggcgggcgtttcgcccaacctggcccagccctccgggccggctgggaccctccgga

SEQ ID NO: 71720 - protein, 181 aa, Zea mays
  misc_feature: Ceres CLONE 1553783
  misc_feature (27)..(66): Pfam Name: LRRNT_2 Pfam Description: Leucine rich repeat N-terminal domain
  misc_feature: SWISSPROT Homolog: EC 2.7.11.1 Non-specific serine/threonine protein kinase
MASTTTTTFLAILLVVAASAAPARSCSPRDIHALLSVKQALGNPASLSTWTPASPNCCAWDHLRCNDAGRVNNVFIDGADDVRGQIPSAVGGLTELMSLTLFRLPGLTGAIPACLTALSNLQFLTISHTNVSGAIPEVPGRGCPGLNFRGPGPATGLTGRHSRRAFRPTWPSPPGRLGPSG

SEQ ID NO: 71721 - DNA, 670 bp, Zea mays
  misc_feature: Ceres CLONE 1553784
  misc_feature: Encodes the peptide sequence at SEQ ID NO. 71722
ggagctccccgcggtggcggccgctctagactagtggatcccccgggctgcaggaattcgtctcacccctagaaaaaaacctgtggacgcgagtgagtgaacaccagccgtattgtcccgaccccgaccgatcctcgcctgctgcagccatggcgacctccgcggcgctctctaccgccgccaatcccacccagctctgccggtcccgcgcttcgctgggcaagccggtgaaggggcttggcctgagcatgggccgcgagcgcgcccagcggagcattgtgtgccaggcggcgagcagcatctccgccgaccgcgtccccgacatggagaagcggaagctgatgaacctcctcctcctccgccccatctcgttgcccaccgtcggcatggtcgtcccctacggcgccttcttcgtccctgccgggtccgggaacgccggcggcgggacctacccaaaggaaaagcttgggcaacgacatcccagggggaggcgtgggctcaacaccgcacgggccccacgacccgaaccctcccccaaggggttctaagggggacccccccgaaccctggtggggggaacaaggaaaaaaattcttgccccccaaaaagattcaatgcccgtggggctttccccctccgcctgcgatagttgccttggaaacagcccacc

SEQ ID NO: 71722 - protein, 132 aa, Zea mays
  misc_feature: Ceres CLONE 1553784
  misc_feature (54)..(92): Pfam Name: CytB6-F_Fe-S Pfam Description: Cytochrome B6-F complex Fe-S subunit
  misc_feature: SWISSPROT Homolog: EC 1.10.99.1 Plastoquinol--plastocyanin reductase
MATSAALSTAANPTQLCRSRASLGKPVKGLGLSMGRERAQRSIVCQAASSISADRVPDMEKRKLMNLLLLRPISLPTVGMVVPYGAFFVPAGSGNAGGGTYPKEKLGQRHPRGRRGLNTARAPRPEPSPKGF

SEQ ID NO: 71723 - DNA, 633 bp, Zea mays
  misc_feature: Ceres CLONE 1553785
  misc_feature: Encodes the peptide sequence at SEQ ID NO. 71724
  misc_feature (349)..(349): n is a, c, t, g, unknown, or other
  misc_feature (582)..(582): n is a, c, t, g, unknown, or other
acccgcggtggcggccgctctagaactagtggatcccccgggctgcaggaattcgtctcacccctagaaaaactcgcttgagcatcgtgtgctcttctcttcctcttccagttggtattctttatctgaaagactgaaacatagtacagaggaggagaggagagcgagagctaagaagatgaccggcaaggtcctgcttgtggccgtcctcttggtgggcgtggcctctcgatgctcgggcagtaggggcctgcagggcgatcacgttgctgaacagaagttcggtggcggtggctatggaggtggcggtgggtacggaggctacggtggcggtggaagaggagtggcngtgggtatggcggtggcggcggcggcgcgggtacggaagcggtgcggctacacacccgctactctggcacgggcactgcgactactggaagagccaccggacgccatcatctcgtgcatcgggtcgctgggcaacatcctcggctccttccgcgacgtgtgcagccgcttccttcgggaggcagctgcaaacgctgcaagacgccctgtgcaacacccgccacgactgctacngcgacctgctccgcgagggggccgcggcctacctcaacttcatccgccgcg

SEQ ID NO: 71724 - protein, 151 aa, Zea mays
  misc_feature: Ceres CLONE 1553785
  misc_feature (135)..(135): Xaa is any aa, unknown, or other
MTGKVLLVAVLLVGVASRCSGSRGLQGDHVAEQKFGGGGYGGGGGYGGYGGGGRGVAVGMAVAAAARVRKRCGYTPATLARALRLLEEPPDAIISCIGSLGNILGSFRDVCSRFLREAAANAARRPVQHPPRLLXRPAPRGGRGLPQLHPP

SEQ ID NO: 71725 - DNA, 655 bp, Zea mays
  misc_feature: Ceres CLONE 1553791
  misc_feature (652)..(652): n is a, c, t, g, unknown, or other
cattgtgtacgggcccccctcgagcactgcagtggtaaggatgaggaataggagactagcaaactggtgattggcaatgtggaagaaaaaatactatatgcatgggatccatggggttggtttccgggggggcgtcctgggaatcagcccctgctggggctggttggtttggtgctcttttaaaaaacaaggggaaaggaaaattttttttccttgatgggggcaaggacggtagatctgaaagcagcatggcgtggaaatatttttcttgaaaacagtaggcacaggattaagtacaagaatactccattagaattttgagttgaagggtcttgaattttttacccaattgctggagcaaactcagggatctaacacggtttagtctaactacttagttaagagtattcaacataaagattctttggaatcacaataagctgacaaatgcatcatttctttatcaatttcaccatctcatctgcatagttccctttgtttttattctgttattcacatggtttttctagtgatgttattatcaaagcagttgacgatgcttacctgtttttccatgctaacgtggcttcgatattatcatgtttttttgagccctttgagaattgtagcccaccagcatgcctctttccanagt

SEQ ID NO: 71726 - DNA, 657 bp, Zea mays
  misc_feature: Ceres CLONE 1553793
  misc_feature: Encodes the peptide sequence at SEQ ID NO. 71727
gggtacggggcccccctcgagccctgcagtggtaaaggcgaacaacttcctgcttgcacgcaagccactccgaggccaagtctagggtttgggaatctgtgggaggggagaggggagcgcgctcagggtcagggaggcgaagatgatcgaggtggtgctgaacgaccgcctggggaagaaggtgcgggtgaagtgcaacgaggacgacaccatcggcgacctcaagaagctggtggcggcgcagacggggacgcgccccgagaagatccgcatccagaagtggtacaacatctacaaggaccacatcacgctcaaggactacgagatccacgacgggatggggctcgagctctactacaactaggcgccctgaccccaaccgtgccctgatgtaaggttaatccgaattctgaagtcatgggtgcgcttccagtcacagcgtctttagctaacaagctcgcatacatataggcaacttgagtgagctatgtagtacggatatggttgtgtggcaaactgccaatgactattgacatccttgcatgtattgacatgtgacaaggatcaacctgcaaaactggtgccctgctactcgcagaccttattatcttaaatgacgcaggtggtgtgtttttcacaaaaaagataccaaaccag

SEQ ID NO: 71727 - protein, 73 aa, Zea mays; identical to SEQ ID NO: 39404
  misc_feature: Ceres CLONE 1553793

SEQ ID NO: 71728 - DNA, 672 bp, Zea mays
  misc_feature: Ceres CLONE 1553794
  misc_feature: Encodes the peptide sequence at SEQ ID NO. 71729
  misc_feature (672)..(672): n is a, c, t, g, unknown, or other
caattgggtaccgggccccccctcgagccctgcagtggtatagggggccacaggccaccacctttccttccttgttccttccccaactccgcaggctgctcatcgccctctctccgcgcccccgatccagatccagatccaggggcttgtcatggcatccaaacgtatcctcaaggaattaaaggacttgcagaaggaccctccaacatcatgcagtgcacgtcctgctggtgaggatatgttccactggcaagcaaccatcatgggtcctcctgatagtccatatgctggaggtgttttcttggcgaacattcatttcccgccagactaccccttcgagcctccaaaggtatcttttaacaccaaggtcttccatccaaacatgcatagtaatggaagcatatgtctcgacattcttaaggagcagcggagccctgctttgacaatctcaaaggttttgctttctatctgctccctgcttactgatcccaacccagacgaccctcttgtccctgagattgctcacatgtacgacacggatcggcctaaatacgaggcgacagcccgcagctggacccagaagtacgccatgggatgaaatgttaggtgttactggctaaatgcagacgattgtggtgttgcccatgacactgctatcaaggtacgtatgtn

SEQ ID NO: 71729 - protein, 148 aa, Zea mays
  misc_feature: Ceres CLONE 1553794
  misc_feature (5)..(142): Pfam Name: UQ_con Pfam Description: Ubiquitin-conjugating enzyme
  misc_feature: SWISSPROT Homolog: EC 6.3.2.19 Ubiquitin--protein ligase
MASKRILKELKDLQKDPPTSCSARPAGEDMFHWQATIMGPPDSPYAGGVFLANIHFPPDYPFEPPKVSFNTKVFHPNMHSNGSICLDILKEQRSPALTISKVLLSICSLLTDPNPDDPLVPEIAHMYDTDRPKYEATARSWTQKYAMG

SEQ ID NO: 71730 - DNA, 675 bp, Zea mays
  misc_feature: Ceres CLONE 1553801
  misc_feature: Encodes the peptide sequence at SEQ ID NO. 71731
  misc_feature (1)..(1): n is a, c, t, g, unknown, or other
  misc_feature (538)..(538): n is a, c, t, g, unknown, or other
  misc_feature (553)..(553): n is a, c, t, g, unknown, or other
  misc_feature (559)..(559): n is a, c, t, g, unknown, or other
ncgattgggtaccgggccccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaagcggcggctacggcggtggcgggcgccgtgatggcggcggcggctacggcggtggcggcggcggctacggtggcggcggtggctacngtggtggtggtggcngctacngcggtggcaaccgtggcggcggctacggcaactccgacgggaactgggagaactgagcggtgggggcccgcgcggccaagttatcctgtttcgctaccgtgatgtttaccctagtc

SEQ ID NO: 71731 - protein, 156 aa, Zea mays
  misc_feature: Ceres CLONE 1553801
  misc_feature (10)..(81): Pfam Name: RRM_1 Pfam Description: RNA recognition motif. (a.k.a. RRM, RBD, or RNP domain)
  misc_feature (48)..(151): Pfam Name: GRP Pfam Description: Glycine rich protein family
  misc_feature: SWISSPROT Homolog: EC 5.2.1.8 Peptidylprolyl isomerase
  misc_feature (132)..(132): Xaa is any aa, unknown, or other
  misc_feature (137)..(137): Xaa is any aa, unknown, or other
  misc_feature (139)..(139): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGSGGYGGGGRRDGGGGYGGGGGGYGGGGGYXGGGGXYXGGNRGGGYGNSDGNWEN

SEQ ID NO: 71732 - DNA, 653 bp, Zea mays
  misc_feature: Ceres CLONE 1553802
  misc_feature: Encodes the peptide sequence at SEQ ID NO. 71733
ccgattgggtaccgggccccccctcgagccctgcagtggtaaaggagcagatccatcgtcctcattattattctcactggtcgatctgctaacacaaacagcagcagctcctcctcactagctagccttctctatttttgctactgcaagtgtccaagtctgcgacgacgtccgagatgtcgacggtgagccgtgcatcccttgaccagaagcttgccctcgccaagcgctgctcccgagaggcgactcttgccggagctaaggcggcagcagtggcgactatcgcctccgcgattcccaccctcgcgagcgtgcggatgctgccgtgggccaaggccaacatcaaccccaccggccaggcgctcatcgtctccacggtggccgggatggcctacttcatcgccgccgacaagaagatcctgtcgctggcgaggcgccactcgttcgaggaagctccggagcacctcaagaacacctccttccagggcaccggacgcccccacccggctttcttcaggccatgatgagatcagatatatatatgacacatccgtcgacctcatcagtcatagagcccagccagccagtcagtcagtcagcacaagcacaagcaccagagatgatgccatccatgtctgcatgtatgcatttat

SEQ ID NO: 71733 - protein, 115 aa, Zea mays
  misc_feature: Ceres CLONE 1553802
  misc_feature (11)..(89): Pfam Name: ENOD93 Pfam Description: Early nodulin 93 ENOD93 protein
MSTVSRASLDQKLALAKRCSREATLAGAKAAAVATIASAIPTLASVRMLPWAKANINPTGQALIVSTVAGMAYFIAADKKILSLARRHSFEEAPEHLKNTSFQGTGRPHPAFFRP

SEQ ID NO: 71734 - DNA, 630 bp, Zea mays
  misc_feature: Ceres CLONE 1553806
  misc_feature: Encodes the peptide sequence at SEQ ID NO. 71735
cgattgggtaccgggccccccctcgagccactgcagtggtaaaggtgtaatccagccgtttcccctttccccagagattcgcatattctcgcgatgggagcggaggaagcagagggtactcccccgccgctgcccgccaccggcgagcccgcaaccacggcaagggcgcagccaatatctgcagcacaattcctctcctggaagcagcgcaaggatgcagaggtagccgtaaggaaagctgaagcagctcacaagcgagctgatgatatcgcttcaggagcggtgcagatgaacggccgcgagctgttccaacaagagccctgggtgtttgacaaccacatttactgagatcgtgtcgggctactgttcctgcattagtccaagctccagcggaggtttcattttgtactgctatatcagctttgcggagctgtggattttatttcaccgtttataagattattctctcaataggtatttgaacttgtttcaaatacattttgccaaatctctgtgcagtcaccgaatgatatctactgtcgctattctttttctaaaactcttacaaacaaagagtgttggtcggagaaaaaaaaaaaacattcagtagctctggaaattcctgcatcc

SEQ ID NO: 71735 - protein, 84 aa, Zea mays
  misc_feature: Ceres CLONE 1553806
MGAEEAEGTPPPLPATGEPATTARAQPISAAQFLSWKQRKDAEVAVRKAEAAHKRADDIASGAVQMNGRELFQQEPWVFDNHIY

SEQ ID NO: 71736 - DNA, 681 bp, Zea mays
  misc_feature: Ceres CLONE 1553809
  misc_feature: Encodes the peptide sequence at SEQ ID NO. 71737
acgattgggtaccgggccccccctcgagccctgcagtggtaaaggtatatttcatcaaacacgttcctgttaaagacacgcttattaccattattactcactcgaccatggccccgaaatctgctggactctacttgtgaccgatggatgcgttcgttccccgacaggaggactacagagacaaggacgcgctgggaatactcaagtgcaggcacgacttccacgccggctgcatcaagaagtggctgcagacgaagaactcgtgcccagtgtgcaaagcggccgcggcctagtagggagggacacgccagaggaggaggagcaagcgactgttgcgctcgatccgattcatttttaggctcaggtcaagatgtgtatgccgtctattctttttttttttcccgtcctcctagccagggcagccgtgtaaatagatgttcttatgggattaactattatctcttgggttacattggcccagattcttttgttgtatttagcaataacaacccacttgtggaaggtactgatcgtcaagttgttatacattacagtctcatgtcggggttttcggatccgccgacactttgcgaggtatacctcttttggacggtgaagtttggtacacggaaaaaaaaaaaaaaaaccagagctctgggaattcctgcagcccgggggatc

SEQ ID NO: 71737 - protein, 49 aa, Zea mays
  misc_feature: Ceres CLONE 1553809
  misc_feature (12)..(44): Pfam Name: zf-C3HC4 Pfam Description: Zinc finger, C3HC4 type (RING finger)
  misc_feature: The sequence is a functional homolog of SEQ ID NO 406 in the 10/666,642 US patent application
  misc_feature: The sequence is a functional homolog of SEQ ID NO 90 in the 10/666,642 US patent application
MDAFVPRQEDYRDKDALGILKCRHDFHAGCIKKWLQTKNSCPVCKAAAA

SEQ ID NO: 71738 - DNA, 487 bp, Zea mays
  misc_feature: Ceres CLONE 1553813
  misc_feature (359)..(359): n is a, c, t, g, unknown, or other
  misc_feature (372)..(372): n is a, c, t, g, unknown, or other
  misc_feature (373)..(373): n is a, c, t, g, unknown, or other
  misc_feature (459)..(459): n is a, c, t, g, unknown, or other
cgattgggtccgggcccccctcgagccactgcagtggtaaagggtgctctctcagaggtgggctggcttctcctccccctcttaccaagtcctcttcgggttagggttacttagggttttgtggaggggcgatggcggcgctgatgtgataccgtgctcgtcgcggcttgcctggcacagcacgagtcgctgagatgctttcgctctacgcgagatctcgactcaggtcatcccgacggaaacggggagtctcgcgctcggcttgttacttttcctcgaaacctcctgctaaccctttcaaaaaatgaaccgaagggactcccggcctaaaattcccttttacagggccctcccctttntttggccttggcnnttttgtgtaaggggggggtccccgggggggggtttttttggggggcgcgcccccccccccgggtttttttgggggggggggggggnttaaaaggggttccccccccaggggggg

SEQ ID NO: 71739 - DNA, 658 bp, Zea mays
  misc_feature: Ceres CLONE 1553815
  misc_feature: Encodes the peptide sequence at SEQ ID NO. 71740
  misc_feature (562)..(562): n is a, c, t, g, unknown, or other
caattgggtacgggcccccctcgagcactgcagtggtaaaggggtgggacggcgagaccgtggtgtatgcgcaccgcacgcgggagctagtgcgactgccgcggggcgtcgcgctgcccgtgacgctaggcccactccagtatgaggtgttccatgtgtgcccgctccgcgccgtcgtgccgggggtctcgttcgcgcccgtcgggctgctcgacatgttcaacgccgggggcgccgttgaggagtgcgacgtgatcagcgatgacggcggcaaggccatggctctcagggttcgcgggtgcggtcggttcggcgcttactgctcgcgggagccggcgaggtgcctattggactcggcggaagtggagttcagctacgatgccgacaccgggctcgtgtccgtcgacctgcccgtgccggagcaggagctataccggtggacgctggagattatggtctaggccgtgacgctgtgcgccgacgccaacgcttgccttcgcgtctgagccattctgagccggacgacactgtcatttgctatgtgcacgagagatagatgtanttgtggtgttgtataaattagtatggagagcctgctcggtcggccagtggatgagcgcgctgcccaccgagcgcgtgccgtcgaaacgcagcgggc

SEQ ID NO: 71740 - protein, 152 aa, Zea mays
  misc_feature: Ceres CLONE 1553815
  misc_feature: SWISSPROT Homolog: EC 2.4.1.67 Galactinol--raffinose galactosyltransferase
IGYGPPSSTAVVKGWDGETVVYAHRTRELVRLPRGVALPVTLGPLQYEVFHVCPLRAVVPGVSFAPVGLLDMFNAGGAVEECDVISDDGGKAMALRVRGCGRFGAYCSREPARCLLDSAEVEFSYDADTGLVSVDLPVPEQELYRWTLEIMV

SEQ ID NO: 71741 - DNA, 680 bp, Zea mays
  misc_feature: Ceres CLONE 1553827
  misc_feature: Encodes the peptide sequence at SEQ ID NO. 71742
  misc_feature (409)..(409): n is a, c, t, g, unknown, or other
  misc_feature (427)..(427): n is a, c, t, g, unknown, or other
  misc_feature (626)..(626): n is a, c, t, g, unknown, or other
cgattgggtccgggccccccctcgagccctgcagtggtaaagggtgctttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccctccaaggcctgaacagccaggagcttgaagggcgccacatcaccgtcaacgagagcccaatccccccgccngccctggaggcagccgcngtggggtacagtggtgggcgtggaagagggcggcttcccccctttggcgggggcccccccttcgcgggtgaggcggtgcgctccgcgggggggggcggtcactgggggggggcggggctcctacggggggtggggggggggcggggttcccggggggggggaaaaccgtggcggcggggctacgggcaacttcccaaangggggaaactggagggggaaaaaattattacttcggggggggggcgcccccccc

SEQ ID NO: 71742 - protein, 179 aa, Zea mays
  misc_feature: Ceres CLONE 1553827
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (162)..(162): Xaa is any aa, unknown, or other
MAASDVEYRCFVGGLAWATDDHSLHNAFSTYGEVLESKIILDRETQRSRGFGFVTFSTEEAMRNALQGLNSQELEGRHITVNESPIPPPALEAAAVGYSGGRGRGRLPPFGGGPPFAGEAVRSAGGGGHWGGAGLLRGVGGGRGSRGGGKPWRRGYGQLPKXGKLEGEKIITSGGGRPP

SEQ ID NO: 71743 - DNA, 651 bp, Zea mays
  misc_feature: Ceres CLONE 1553837
  misc_feature: Translation starting site: 127
  misc_feature: SWISSPROT Homolog: EC 1.11.1.6 Catalase
  misc_feature (1)..(1): n is a, c, t, g, unknown, or other
ncgattgggtccgggccccccctcgagccctgcagtggtaaaggcgtttcgatctctcccatccgagtgtctcctcctcctccgccgccgccgccgccgcttccctcgtctccgcccgccgaagccatgccgtcgcacaagaccttccggatcaagaagaagctggccaagaagatgcgccagaaccgccccatcccctactggatccgcatgcgcaccgacaacaccatcaggtacaacgccaagcgcaggcactggcgtcgcaccaaactcggattctgagcggtggaagaaatgctggctaaagacgcctagagggtatagggctctgcaagctaggaagctcttgtttaattttttttgcttgtgttatttgtcattgtagtaccatgttttgtctgatggttaaagaaccgcctttatgctatggtgaatttatttaaccttgcagcgccttaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacat

SEQ ID NO: 71744 - DNA, 521 bp, Zea mays
  misc_feature: Ceres CLONE 1553845
  misc_feature: Translation starting site: 85
  misc_feature (21)..(21): n is a, c, t, g, unknown, or other
  misc_feature (189)..(189): n is a, c, t, g, unknown, or other
  misc_feature (190)..(190): n is a, c, t, g, unknown, or other
  misc_feature (192)..(192): n is a, c, t, g, unknown, or other
  misc_feature (193)..(193): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (213)..(213): n is a, c, t, g, unknown, or other
  misc_feature (216)..(216): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (238)..(238): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (253)..(253): n is a, c, t, g, unknown, or other
  misc_feature (256)..(256): n is a, c, t, g, unknown, or other
  misc_feature (257)..(257): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (274)..(274): n is a, c, t, g, unknown, or other
  misc_feature (275)..(275): n is a, c, t, g, unknown, or other
  misc_feature (276)..(276): n is a, c, t, g, unknown, or other
  misc_feature (278)..(278): n is a, c, t, g, unknown, or other
  misc_feature (279)..(279): n is a, c, t, g, unknown, or other
  misc_feature (300)..(300): n is a, c, t, g, unknown, or other
  misc_feature (301)..(301): n is a, c, t, g, unknown, or other
  misc_feature (302)..(302): n is a, c, t, g, unknown, or other
  misc_feature (306)..(306): n is a, c, t, g, unknown, or other
  misc_feature (307)..(307): n is a, c, t, g, unknown, or other
  misc_feature (308)..(308): n is a, c, t, g, unknown, or other
  misc_feature (316)..(316): n is a, c, t, g, unknown, or other
  misc_feature (318)..(318): n is a, c, t, g, unknown, or other
  misc_feature (319)..(319): n is a, c, t, g, unknown, or other
  misc_feature (320)..(320): n is a, c, t, g, unknown, or other
  misc_feature (321)..(321): n is a, c, t, g, unknown, or other
  misc_feature (322)..(322): n is a, c, t, g, unknown, or other
  misc_feature (323)..(323): n is a, c, t, g, unknown, or other
  misc_feature (330)..(330): n is a, c, t, g, unknown, or other
  misc_feature (331)..(331): n is a, c, t, g, unknown, or other
  misc_feature (333)..(333): n is a, c, t, g, unknown, or other
  misc_feature (335)..(335): n is a, c, t, g, unknown, or other
  misc_feature (336)..(336): n is a, c, t, g, unknown, or other
  misc_feature (337)..(337): n is a, c, t, g, unknown, or other
  misc_feature (338)..(338): n is a, c, t, g, unknown, or other
  misc_feature (349)..(349): n is a, c, t, g, unknown, or other
  misc_feature (350)..(350): n is a, c, t, g, unknown, or other
  misc_feature (351)..(351): n is a, c, t, g, unknown, or other
  misc_feature (374)..(374): n is a, c, t, g, unknown, or other
  misc_feature (375)..(375): n is a, c, t, g, unknown, or other
  misc_feature (406)..(406): n is a, c, t, g, unknown, or other
  misc_feature (413)..(413): n is a, c, t, g, unknown, or other
  misc_feature (414)..(414): n is a, c, t, g, unknown, or other
  misc_feature (440)..(440): n is a, c, t, g, unknown, or other
cgattgggtaccgggcttctntcgagcactgcagtggtaaaggctgccctcgtcccgatctccgacccaaatacccgatccaccatggccggaataaggcttacgcccgaggaacccgagatgcccgttggcacgccaccccgcccccagctcccacccttcgtcgccgcggcagggcgggtggcggcnnanntctggaaatggcnnnnnacnacnaannnnnnnnnncnnnnnnnancnnngnnnannnaanaannaaaaaaannnaaaaaannnannaaaaaaaaaaaaaaaaaaaannnaaannnacaaaaanannnnnnaaaaaannanannnnaaaaaaaaaannnaaaaaaaaaaaaaaaaaaacaannccacaccccaacccccccaaaaaaaaacaanaaaaaanncccccccgcaaaaaaaaaacaccccncccccccggggaccccggggggggccccccgggggggcgcccgagggggggggaggggagaaaagagacaggggcgcgggg

SEQ ID NO: 71745 - DNA, 631 bp, Zea mays
  misc_feature: Ceres CLONE 1553857
  misc_feature: Encodes the peptide sequence at SEQ ID NO. 71746
cgattgggtacgggccccccctcgagccctgcagtggtaaaggagagtcctcgcaccgcacgcaagtacgctgtacgcaggcagcgcagcctcgagccgtcgccatggcgagcaagcacctcgtcctcgccgcatgcctcctcctccttctcctcctgcccaccgcctcggttgccaccgacgtcgactactgcagtaagaaggactacccggtgaaggtgagcggggtgcagatcgtgcccgatccggtcgaacccggcaagcctgccactttcaagatctccgcttctactgataaaaccatcgagaaggggaagctggtcatcgacgtaaagtatttcttcttctacgtgcactcggagacccgcgacatctgcggagagacttcctgcccagcgaccggcgacttcgtgctgtcccaccagcagacgctgccaggcttcactccgccgggctcctacacgatctacatgaagattgtcggggacgacaacgaggagctgagctgcatctcgttcggggttcagcatcggccttcgtcgcgtccagctgaaacgcgtcccgagcccggggcaccgaaaggcagcccacccccatggatggtaatttacctggaaacgcaacccctcgg

SEQ ID NO: 71746 - protein, 175 aa, Zea mays
  misc_feature: Ceres CLONE 1553857
  misc_feature (23)..(142): Pfam Name: E1_DerP2_DerF2 Pfam Description: ML domain
MASKHLVLAACLLLLLLLPTASVATDVDYCSKKDYPVKVSGVQIVPDPVEPGKPATFKISASTDKTIEKGKLVIDVKYFFFYVHSETRDICGETSCPATGDFVLSHQQTLPGFTPPGSYTIYMKIVGDDNEELSCISFGVQHRPSSRPAETRPEPGAPKGSPPPWMVIYLETQPL

SEQ ID NO: 71747 - DNA, 636 bp, Zea mays
  misc_feature: Ceres CLONE 1553858
  misc_feature: Encodes the peptide sequence at SEQ ID NO. 71748
cgattgggtaccgggccccccctcgagccactgcagtggtaaagggagagaaggcgcgcgcctggacctcatcggtgtttgcttccgcagttccgccgtcggcaaggaaggaaaaagagagcagagaaccctagctagagtttggcgagtggtgcggaggcgcggctgctcctgctcgtcgcgacgtcgaatttcagcgccgcccgcgcgatccttggtctcttcgcccgtgaggagaggcgcgacaatggctgggaaaggcgggccgaccaacctggagaaggagcagatgtttgggatggcggagaaggagatggagtacagggttgatcttttcaacaggcttacaaagacctgttttgagaagtgcgttgaaaaaaggtataaagaagctgagctcaatatgggtgagaacagttgcattgatcgatgtgtttcaaagtattggcaggtgactaatttagtaggtcagatgcttgggaaccagcctcagatgtgaaccgagatgcactagttccattttgtagcacaatcctattgctctgtttattctttttggatggtattagaatcccgccacctgctattaagtacaccaatacagcaccagacttgttactgcgtggatcgctctga

SEQ ID NO: 71748 - protein, 83 aa, Zea mays
  misc_feature: Ceres CLONE 1553858
  misc_feature (14)..(80): Pfam Name: zf-Tim10_DDP Pfam Description: Tim10/DDP family zinc finger
MAGKGGPTNLEKEQMFGMAEKEMEYRVDLFNRLTKTCFEKCVEKRYKEAELNMGENSCIDRCVSKYWQVTNLVGQMLGNQPQM

SEQ ID NO: 71749 - DNA, 540 bp, Zea mays
  misc_feature: Ceres CLONE 1553865
  misc_feature: Encodes the peptide sequence at SEQ ID NO. 71750
tgggtccgggccccccctcgagccctgcagtggtaaagggttcccacacccctcaccgcgtccgcctcccctatcatctagggtttctagggttttccaggaggaggaaatggcgtctgatagggtgctcgggactgtgaagtggttcaacggaaccaagggcttcggtttcatcacccccgacgacgggagtgaggatctcttcgtccaccagtcctccatcaagtccgacggctaccgcagcctaaacgacggcgatgccgtcgaatacaccgtcggcagcggcaacgacggccgcgccaaggccctggatgtcaccgcgcccggcggcggcccgctttgccgcggggacgtcccgacggcggcacgggcgggggcccggggatacgggggcggcaaccccgaatacgggggggcggggacccggcttccggggaagaggaacccgggtacgggggggggaacctgggttacggggaagggggaacccggggtatggggggggggggaaaccgtggttttcggggggaggggggcccc

SEQ ID NO: 71750 - protein, 143 aa, Zea mays
  misc_feature: Ceres CLONE 1553865
  misc_feature (5)..(72): Pfam Name: CSD Pfam Description: 'Cold-shock' DNA-binding domain
MASDRVLGTVKWFNGTKGFGFITPDDGSEDLFVHQSSIKSDGYRSLNDGDAVEYTVGSGNDGRAKALDVTAPGGGPLCRGDVPTAARAGARGYGGGNPEYGGAGTRLPGKRNPGTGGGTWVTGKGEPGVWGGGETVVFGGRGA

SEQ ID NO: 71751 - DNA, 610 bp, Zea mays
  misc_feature: Ceres CLONE 1553872
  misc_feature: Encodes the peptide sequence at SEQ ID NO. 71752
cgattgggtaccgggcccccctcgagccactgcagtggtaaagggaaccataccagagcggcagagccttcccctccgctccccagtcccacccgcaccctagccctcagcaaacgctaaccgctcgtcgccatgaaggacacctcgttcaaggccaccggcgccaagcgcaagaaggtcggcggcgccaagcgcgggctcacccccttcttcgcgtttttggctgagtttaggccgcaatacctggagaagcaccctgagctcaagggcgtaaaggaggtgagcaaggcggctggggagaagtggcgctctatgtcggatgaggagaaggcgaagtatggcagtagcaagaagcaggatggcaaagcaagcaagaaggagcacactagctccaagaacgccaaagctgatattcgggagggagatgaagcagaacgttctacaagtcaaaaatctgaggttgaagatgatgagcatgatggtaatgaggatgaaggatgagtaactagtacgaatggggaaccagcatcgttgccatttgaagtgtttgctggctttacttagttttacaatatgccggaaactttttggatggtaaaaggctgaaaag

SEQ ID NO: 71752 - protein, 122 aa, Zea mays
  misc_feature: Ceres CLONE 1553872
  misc_feature (19)..(88): Pfam Name: HMG_box Pfam Description: HMG (high mobility group) box
MKDTSFKATGAKRKKVGGAKRGLTPFFAFLAEFRPQYLEKHPELKGVKEVSKAAGEKWRSMSDEEKAKYGSSKKQDGKASKKEHTSSKNAKADIREGDEAERSTSQKSEVEDDEHDGNEDEG

SEQ ID NO: 71753 - DNA, 637 bp, Zea mays
  misc_feature: Ceres CLONE 1553876
  misc_feature: Encodes the peptide sequence at SEQ ID NO. 71754
  misc_feature (589)..(589): n is a, c, t, g, unknown, or other
  misc_feature (637)..(637): n is a, c, t, g, unknown, or other
cgattgggtaccgggccccccctcgagccctgcagtggtaaagggatccccgcatcgaatccggcggatcgggagcgggagagaccacccaaatcgcgtcgcgtcgagaggtgcgcgcgggggaaccgagccgactgatggagtcgacggcggcgcccgccgcctgcgagatcgcgcgcctgccggatgacctcctgtcggcggcgctcggccggacggggccgctggacgcctgccgcgccgccgcggtctcgccggcctttcgcgccgcggccgacgccgacgccgtctggtccagcttcctgccgcccgacctgcccccgctcgccgatggggagctccccgccgacgcgacggccaccaagaagcagctcttcatgcgcctctccgaccccgccagacccgtcctcctcgccgacggcctcacgagcatgtggctggacagggtcaccgtcgccaagtgttacatgctgtccgccaggaagctgaccatcatatggggtgatacgccgcagtactggcactggatccccctcaccgactccaggttctcagaatgcgcagaacttcagcacgtttgctggctggnaatccccgcgcagataccctgcgacatgctgtcccggacaccacttan

SEQ ID NO: 71754 - protein, 166 aa, Zea mays
  misc_feature: Ceres CLONE 1553876
  misc_feature (10)..(57): Pfam Name: F-box Pfam Description: F-box domain
  misc_feature (151)..(151): Xaa is any aa, unknown, or other
MESTAAPAACEIARLPDDLLSAALGRTGPLDACRAAAVSPAFRAAADADAVWSSFLPPDLPPLADGELPADATATKKQLFMRLSDPARPVLLADGLTSMWLDRVTVAKCYMLSARKLTIIWGDTPQYWHWIPLTDSRFSECAELQHVCWLXIPAQIPCDMLSRTPL

SEQ ID NO: 71755 - DNA, 580 bp, Zea mays
  misc_feature: Ceres CLONE 1553877
  misc_feature: Encodes the peptide sequence at SEQ ID NO. 71756
  misc_feature (25)..(25): n is a, c, t, g, unknown, or other
  misc_feature (405)..(405): n is a, c, t, g, unknown, or other
cgattgggtaccgggccccccctcngagccactgcagtggtaaagggtgggtctggctatggctctggctctggctctggctcgggatatggatcaggtgaaggatacggacaaggtggtgctcatggaggaggctatggaagcggtggtggcggtggaggtggcggtggtcaaggtggtggtggctctggctatgggtctggatccggctccggttatggaggtggcaacgacaacggacattactaggctctttttcagagctaggaacatgttatacaaatatgtcaccagacatgagtaggtcttgctgcatgggatgctagttgtgtccatcgtgtgtgtacaccgcagggctgtatttgtcctgtaactgcttgctgcttacatactggcacaactaantgataataaaaatcatctatggaattatagtatgaaaaaaaaaaaaaaaaaaccggagctctgggaaattcctgcagcccggggggatcccactattttttaaaagcggcccccccccccggggggagacccccccccttttttggtcccccctttaggggggggggtttatttt

SEQ ID NO: 71756 - protein, 82 aa, Zea mays
  misc_feature: Ceres CLONE 1553877
  misc_feature (9)..(9): Xaa is any aa, unknown, or other
RLGTGPPLXATAVVKGGSGYGSGSGSGSGYGSGEGYGQGGAHGGGYGSGGGGGGGGGQGGGGSGYGSGSGSGYGGGNDNGHY

SEQ ID NO: 71757 - DNA, 636 bp, Zea mays
  misc_feature: Ceres CLONE 1553885
cgattgggtacgggcccccccctcaagccttgcatgggtaaaggtcttctctccgcctcgcgcacccggttccgcgtgcctttccccacctactctcgcggctctcgccagccagtctagggtttcggtcccagcgtgcttatccaacacccgccggccttgtccaatcaaggagggaatgccaagccacctgaatgcgcccaaggccgacaagatggagtacgactagacggatcttgcatatctgcggaataagaaagatgatgaaaaagcactgaaagagcttaaggccaacgcacagaatggcgcgattgagggctcgggtctgaacaaaagtggaaagaaatgagactggtcacccgtctccaatacctagaggatgataaggcagctgtctatctgtgttgcgcttcactaagtgtgattgtaacactgatacctcttgtgttctatgatcctcgatgttgcaataggttgcttgatcacaagatgtatcaacctcccatctgctagctatgatacagatggtcccctgataataatgatgacatattcagtgaaaaacagaaaaaatagccacagctctggcaatgcctgcagcccgggggatacactacttctagagcggccgcaacc

SEQ ID NO: 71758 - DNA, 628 bp, Zea mays
  misc_feature: Ceres CLONE 1553889
  misc_feature: Encodes the peptide sequence at SEQ ID NO. 71759
  misc_feature (623)..(623): n is a, c, t, g, unknown, or other
cgattgggtaccgggccccccctcgagcactgcagtggtaaaggggtggccgacctcctcgcgctcacgctcgccgaggcggggcccgcgctcgcctgctccggcgagggcgccgccgtcgccgcccacctcgacgccggcgtcgcgctcctcgacgcctgcaacgccatcgccgcgcggctcgacggcctccgcaggcgccgtctcctcgccagcctcgcgctccacctcctcctctcctccacctcgccgtccgggcggacgcgcgcgcgcgcggcgctcgcggaccgcgaccccccggcccctccgccgctcccttggctcccgttcgagcagccccgcgggcagctcacggccgccgcgcgcgtcctcgccgccgtggacgccgtctcctcgctcgcggcggcggccgcggctaccgtcctcgccggaggacctgccaccttcccctgggtctccggcagcggcggcgacctcccctgggcggagccgttcaacgcgctgtccggccagctcgcggcgctcggcgccggcgaggtgcgcgccgtcgacgaggccgtccgggaggctcgcgtcggcgctggactccggggaccgacaacgaggggggccgttgcgcgccncggcg

SEQ ID NO: 71759 - protein, 209 aa, Zea mays
  misc_feature: Ceres CLONE 1553889
  misc_feature (208)..(208): Xaa is any aa, unknown, or other
RLGTGPPLEHCSGKGVADLLALTLAEAGPALACSGEGAAVAAHLDAGVALLDACNAIAARLDGLRRRRLLASLALHLLLSSTSPSGRTRARAALADRDPPAPPPLPWLPFEQPRGQLTAAARVLAAVDAVSSLAAAAAATVLAGGPATFPWVSGSGGDLPWAEPFNALSGQLAALGAGEVRAVDEAVREARVGAGLRGPTTRGAVARXG

SEQ ID NO: 71760 - DNA, 589 bp, Zea mays
  misc_feature: Ceres CLONE 1553892
  misc_feature (142)..(142): n is a, c, t, g, unknown, or other
  misc_feature (143)..(143): n is a, c, t, g, unknown, or other
  misc_feature (163)..(163): n is a, c, t, g, unknown, or other
  misc_feature (169)..(169): n is a, c, t, g, unknown, or other
  misc_feature (170)..(170): n is a, c, t, g, unknown, or other
  misc_feature (446)..(446): n is a, c, t, g, unknown, or other
cgattgggtaccgggccccccctcgagccactgcagtggtaaaggcagctttaccatctttttgttcctcgcgccgccgccgccgccgtgacggaaggaagaggaggagcaaggagcacgacgcgatgggccactccaacgnntttggaactcgcaccctaangaactnnacggccctggctcccgcgtctgccgggtctgcgcgaaccctcacggtctgatcaggaagtacgggctcatgtgctgcaggcagtgctttcgcagcaacgccaaggacattggtttcatcaagtaccgttgaagaggccactgtgctgctgcggagaacttcctacatcaaagaaatgggtccttcattagaaggcctaatttatgcgcttttagctttttggtcagaacttgagactcatgtgttaaactcgacttgttaaagttttgatggctancttgtgcttgttggaccagctataatcagaagattgaattttctcactcatgatgtttgttcctaaaaaaaaaaaaaaaaaaccgaagctctgggaaattcctggagccccgggggatccccttatttctaaaccggcccccc

SEQ ID NO: 71761 - DNA, 856 bp, Zea mays
  misc_feature: Ceres CLONE 1553898
  misc_feature: Encodes the peptide sequence at SEQ ID NO. 71762
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (488)..(488): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttcgtattgggtaccgggccccccctcgagccactgcagtggtaaagggtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaagggcaangcacagaaaaggcgccgatgggggggctcggggtctgaaaaaaaagtgggaaagaaaatggagactgggtcaacccccgtctcccattacccttagagggatgaataaagggcagcctggtcctaaccctggggtttggcccttcccccaaaaggggtggaatttggaaaacacgggggaacccccccctggggggttccggggggcccccccccaatttttttcccaaattgggggttccccctttaaaaacaaaaaaaaaaaattttttttaaacccccccccacatttttgggtgggggtttttataaaaaacaaaaaaatgggccgccccccgctgtaaattataagaggggggggcccccttt

SEQ ID NO: 71762 - protein, 76 aa, Zea mays
  misc_feature: Ceres CLONE 1553898
  misc_feature (1)..(64): Pfam Name: TMA7 Pfam Description: Translation machinery associated TMA7
  misc_feature (45)..(45): Xaa is any aa, unknown, or other
MSKQGGKAKPLKAPKADKKEYDETDLAYLQKKKDEEKALKELKGXAQKRRRWGGSGSEKKVGKKMETGSTPVSHYP

SEQ ID NO: 71763 - DNA, 615 bp, Zea mays
  misc_feature: Ceres CLONE 1553916
  misc_feature: Encodes the peptide sequence at SEQ ID NO. 71764
  misc_feature (502)..(502): n is a, c, t, g, unknown, or other
  misc_feature (563)..(563): n is a, c, t, g, unknown, or other
  misc_feature (564)..(564): n is a, c, t, g, unknown, or other
  misc_feature (579)..(579): n is a, c, t, g, unknown, or other
  misc_feature (582)..(582): n is a, c, t, g, unknown, or other
  misc_feature (585)..(585): n is a, c, t, g, unknown, or other
  misc_feature (590)..(590): n is a, c, t, g, unknown, or other
cgattgggtaccgggccccccctcgagcccgcagtggtaaaggttcccacacccctcaccgcgtccgcctcccctatcatctagggtttctagggttttccaggaggaggaaatggcgtctgatagggtgctcgggactgtgaagtggttcaacggaaccaagggcttcggtttcatcacccccgacgacgggagtgaggatctcttcgtccaccagtcctccatcaagtccgacggctaccgcagcctaaacgacggcgatgccgtcgaatacaccgtcggcagcggcaacgacggccgcgccaaggccctggatgtcaccgcgcccggcggcggcccgcttgccggcggggaacgtcccgacggcggcaacggcggtgggcgcggcggatacggcggcggcgaccgcggatacggcggcggcggtgaccgcggctacggtggaggaggcgaccgcggctacggcggcggcgaccgtggttacggtggaggtggcgaccgncgctacggcggcggcggcgaccgtggctacgggggaagcggcggctacggcggcgggtacnngtgaaggtggcggcngcngcngcccnctgctgcttcaagtgccgcgaggaa

SEQ ID NO: 71764 - protein, 150 aa, Zea mays
  misc_feature: Ceres CLONE 1553916
  misc_feature (5)..(72): Pfam Name: CSD Pfam Description: 'Cold-shock' DNA-binding domain
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGDRGYGGGGDRGYGGGDRGYGGGGDRRYGGGGDRGYGGSGGYGGGY

SEQ ID NO: 71765 - DNA, 644 bp, Zea mays
  misc_feature: Ceres CLONE 1553919
ccaattgggtacctggccccccctcgagccctgcagtggtaaaggcgagggttctcttctacccgacactgctgtacaacgtggtgcggagcaaggtccaggccgagttccggtggtgggacgaggtcgatccgttcgttttgctcggagcggttccattccgcagcgatgtaacacgcttacagaagcttgggatatgtggtgtgataaccttaaatgaaccatttgagactttggtaccatcatctatgtataaggcaagtgacattcacgtgggatcgatcaccttgttattcctacaagagattatatgtttgctccttcacttgtggatattaatcaagctactgatttcattcatagaaatgcgtcttgtgggaaaataacatatattcactgcaaagctggaaggggccggagtacaacagtcgtcttgtgctatctggtcaaatacaagaatatgacacctgctgcagctttcgagcatgtacggtctaaaagggctcgagtgctgttgacacattcgcaatggaaggctgttcaagaattcagcaagaagaacacggaccgtcctgctctcacgagcggtcccgcaacagcatctccagcacgggacgcggcaccggtaacagtagcggatctga

SEQ ID NO: 71766 - DNA, 668 bp, Zea mays
  misc_feature: Ceres CLONE 1553920
  misc_feature: Encodes the peptide sequence at SEQ ID NO. 71767
caattgggtaccgggccccccctcgagccctgcagtggtaaaggatgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacagtggcggcggtggctacggtgcgtggtggtggcggctacggcggtggcaccgtggcggggctcggcactccgagggactgagactgacgtggcgccgcattctgtccacggagtactatcagagttctctcgccgtgtgtgcatcggtt

SEQ ID NO: 71767 - protein, 175 aa, Zea mays
  misc_feature: Ceres CLONE 1553920
  misc_feature (10)..(81): Pfam Name: RRM_1 Pfam Description: RNA recognition motif. (a.k.a. RRM, RBD, or RNP domain)
  misc_feature (48)..(129): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYSGGGGYGAWWWRLRRWHRGGARHSEGLRLTWRRILSTEYYQSSLAVCASV

SEQ ID NO: 71768 - DNA, 633 bp, Zea mays
  misc_feature: Ceres CLONE 1553921
cgattgggtacgggccccccctcgagccactgcagtggtaaaggaaagcctgcgggcctggcgctctgcctctccctctcggtcagttgtctctctctcactctctcttgtgtcccatttctaaccctagccgccaagcttgagctcccaagtcccaaactgcccgtctgccctccagccgtgcagggcttcaggccatccgggctccggcttccggcatccatcaggcgtcctcataagatggtgtagggcagcgagcgccgagcagagcagcaaggcagagcagcgagcagccgagcagcgaggcagcgggcgtcctcagaatccgggctgccgagccgccgagcagagcagccgagagcagcgaggcagcgagaacggcccacgagaaggcccgtgcgggtgcggtcgccctgggccgaacaaccccggaccgccgtccgctgcttcctactcttcaccgcttcaccccgcgtgcgcgctttctctgttgctctgctacaactgcggcgccgccgccgccgccgccctacgccatttgccgagcccttcatcgctcttctcgccggcgacgagcacccaccacaacaagtctttcacccacagaaggcaaagatgatcaagaggcgctac

SEQ ID NO: 71769 - DNA, 668 bp, Zea mays
  misc_feature: Ceres CLONE 1553924
cgattgggtacgggccccccctcgagcactgcagtggtaaaggtgtactccaacgagaagagcggcggcgcgtgcggacaatgagcacgctgatgaggagctgtgccaagccactatgggtatctcgtgtgactctatgcacaagcgcctggccaccggtggaaagcataaggcctgtgaggaagaagcaaaagtatgatcttggtcgccagccagcctacaccatagttgtcaagcaataagacagtgaggagggtccctgttcatggaggtaatgtgaaatggacggctcttcgccttgatactggtaactactcatggggaagtgaagctgttacccacaagacccgtatcctcgacgtggtctacaatgcatcaaacaatgagcttgtgaggacacaaacccttgtgaagagtgccattgtgcaagttgatgctgccccattcaagcattggtacctcactcactatggagttgacattggtaggaagaacataacccctgctgacaagaaggataatgctgagggacaagaggttgatgcagcatctgaggaaacgaaaaagagctaccatgtcacgaggaagcttgataagcgcatggagggacgtacccttgacccacacattgacgagcaatttggcactggactgttgctggcatgcat

SEQ ID NO: 71770 - DNA, 495 bp, Zea mays
  misc_feature: Ceres CLONE 1553925
  misc_feature: Encodes the peptide sequence at SEQ ID NO. 71771
cgattgggtaccgggccccccctcgagccctgcagctgatgacgaggctgcacctcgcgaggacccgatcgtcggcgacggcggacgtgccgcggggccacctggcggtgtacgtgggcgaggggcggaagcggctggtcatcccgacggcgtgcctcaggcacccgggcctcgtcacgctgctcagcgggtgagacgatttcgctcgacacgctgcgcggctcacatccctgcgctcgagacgagtcgctcactcgtcgggccgcgccgcgccgggacaccccacctcctgacatccggctgtcccccgcccataattcagtccgccggcccaagaataattccgttcatttccccccgcttggaaaaattttttttctttttgggggggggccccaacccacaaagaattgggttttttcttccccccccgttaaaattttggtttggggggtaagaaaaaaacctcccttcccccaaaaaaaaaaaaaaaaa

SEQ ID NO: 71771 - protein, 63 aa, Zea mays
  misc_feature: Ceres CLONE 1553925
  misc_feature (1)..(62): Pfam Name: Auxin_inducible Pfam Description: Auxin responsive protein
IGYRAPPRALQLMTRLHLARTRSSATADVPRGHLAVYVGEGRKRLVIPTACLRHPGLVTLLSG

SEQ ID NO: 71772 - DNA, 656 bp, Zea mays
  misc_feature: Ceres CLONE 1553930
  misc_feature: Encodes the peptide sequence at SEQ ID NO. 71773
cgattgggtactgggccccccctcgagcactgcagtggtaaaggtgcttgtgcacaaactgcggctgctgtagatacgctcgccggcactccaacgtgcaagacctctcttgctcacgccatcgcccctgaatatgggtagcgccgccgcctctcctgagccgtctgggaatctgacgctggactagctcaagcgcgtggcggcgcaccgcgcggcggagttcgtggagcccggcatgacgctgggtctgggcactggttccacggacgcgcacgcgctggaccgcctgggctacctcctccgcgagggcgcatctgaccggggtagccggcgttcccacctccctcaagacggatgcccacacctcccgcgatcgggatcccgatgcttccgctctacgccgcctatggcgacaacatccgcctctccatctacggtgaccgacgaggtctacacgtacctcatcctcctcaagggacgcggcgggtcgatgctcccggagaactggatcgacggcgcccgcgatgcgttcgtcgtcatcgacgacgactccatactcatgcccaggctcggctgctgagtcgccgtacacgtcgaggtcatgcccttatgcgcacccgattcagtcggcctgatacgcaaggtgctcgatcgag

SEQ ID NO: 71773 - protein, 114 aa, Zea mays
  misc_feature: Ceres CLONE 1553930
  misc_feature: SWISSPROT Homolog: EC 5.3.1.6 Ribose-5-phosphate isomerase
MTLGLGTGSTDAHALDRLGYLLREGASDRGSRRSHLPQDGCPHLPRSGSRCFRSTPPMATTSASPSTVTDEVYTYLILLKGRGGSMLPENWIDGARDAFVVIDDDSILMPRLGC

SEQ ID NO: 71774 - DNA, 695 bp, Zea mays
  misc_feature: Ceres CLONE 1553941
  misc_feature: Encodes the peptide sequence at SEQ ID NO. 71775
cgattgggtaccgggccccccctcgagccactgcagtggtaaaggtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggccgtggctacagcggcggtcgcggcggcggcggctatggtggcgggcgccgtgacggcggttatggcggcggtggcggctacagcggtccgccccagggtggtgggcggcgctacggagggggtggcggctaccgcggtccgcccgagggtggggggtggcggctaccggcgccggcggcggccggttggaagagatttattgttggggcccatcctcggcttccggccgaagttatctttatctttccttaaggatccggggttacccgttcccctttctggcc

SEQ ID NO: 71775 - protein, 176 aa, Zea mays
  misc_feature: Ceres CLONE 1553941
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGRGYSGGRGGGGYGGGRRDGGYGGGGGYSGPPQGGGRRYGGGGGYRGPPEGGGWRLPAPAAAGWKRFIVGAHPRLPAEVIFIFP

SEQ ID NO: 71776 - DNA, 717 bp, Zea mays
  misc_feature: Ceres CLONE 1553955
  misc_feature: Encodes the peptide sequence at SEQ ID NO. 71777
cgattgggtacgggccccccctcgagccctgcagtggtaaaggtctctgcgccgccatctgcgccgcgccgccgctggcgctggcgcgctggggcctgctcgacggcgtcaaggcaacggctcacccggggttcgtggacaagttcccggcagaggtggccgccgtggacgcgaacgtggtggtcgacggcagggtcgtgacggggcgtggccccgcggcggccatggagttcgctctcgctctcgtggaccagctctacggcaagggcaaggtcgacgagatcgccaaacccatgatggtcaggtacgaaccagggtacgccttcgaggaactgaacccggttcagtggcggtgcagcggcacgcccagggtcctgataccagtggccaacggcagcgaggagatggaggtgctcgtgaccgtcgacgtgctgcgccgggccaaggcggacgtcctggtggcgtcggccgaggaggtcgtcttcttctcgcgccacggcaccaggatcgtcgcccgacccgctgctgcgccaaccccccgggccaaacatttaaccttcttcgtcttacccggggggaatgccgggggcgtgaaaacaaaccttcggccaaacaaggggggaggctccctggcgcctgtcctgaaaaagaacactcgccgccggccggggcagaggccgtttccaggcgcccccattttggcggcccccccccccg

SEQ ID NO: 71777 - protein, 238 aa, Zea mays
  misc_feature: Ceres CLONE 1553955
IGYGPPLEPCSGKGLCAAICAAPPLALARWGLLDGVKATAHPGFVDKFPAEVAAVDANVVVDGRVVTGRGPAAAMEFALALVDQLYGKGKVDEIAKPMMVRYEPGYAFEELNPVQWRCSGTPRVLIPVANGSEEMEVLVTVDVLRRAKADVLVASAEEVVFFSRHGTRIVARPAAAPTPRAKHLTFFVLPGGNAGGVKTNLRPNKGGGSLAPVLKKNTRRRPGQRPFPGAPILAAPPP

SEQ ID NO: 71778 - DNA, 689 bp, Zea mays
  misc_feature: Ceres CLONE 1553959
  misc_feature: Translation starting site: 331
  misc_feature (645)..(645): n is a, c, t, g, unknown, or other
  misc_feature (650)..(650): n is a, c, t, g, unknown, or other
  misc_feature (653)..(653): n is a, c, t, g, unknown, or other
  misc_feature (677)..(677): n is a, c, t, g, unknown, or other
cgattgagtaccgggcccccctcgagccctgcagtggtaaaggtgctttcctataggtgggttggcttctcctcaccctcaggttagggttcgggttcgtgaggttctccggggctcggtttctatgagtgagcatgatcatagatggcggagtccgatgttgtattacagctccttcatcggcggcctctcctggggcaaagacaacaactccctccacaacgccttcaacacctaccggcaggccctcaactccaacattatcctcaatctggagacgcacgaggtaccccggctatcagcttattcacattctccacggagaacgcgatgcctaacgccatcaaatgcataaaacgcaacgagctggaccgccggaacatctccatgaacgaggcccaatccccctccagccgcgcaggatgccgcaagcggctactgtggtggtcgtggacgcagcagctaccgttgtggcagggcgctcttggatggcagaggactctacagatggtggccgcagtatctacggtgatcaacggtggcatacaagtgatctgcggatgggatgcatacagaacgtgtgcaagcctctgaacgatcatgcgtatcggcatagctcacgaacgtaggatagcatgggatgcnaaacntgnaggactggtggaggcgaccccggnagactgagacac

SEQ ID NO: 71779 - DNA, 713 bp, Zea mays
  misc_feature: Ceres CLONE 1553968
  misc_feature: Translation starting site: 129
  misc_feature (134)..(134): n is a, c, t, g, unknown, or other
  misc_feature (135)..(135): n is a, c, t, g, unknown, or other
  misc_feature (153)..(153): n is a, c, t, g, unknown, or other
  misc_feature (154)..(154): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (170)..(170): n is a, c, t, g, unknown, or other
  misc_feature (171)..(171): n is a, c, t, g, unknown, or other
  misc_feature (175)..(175): n is a, c, t, g, unknown, or other
  misc_feature (178)..(178): n is a, c, t, g, unknown, or other
  misc_feature (181)..(181): n is a, c, t, g, unknown, or other
  misc_feature (182)..(182): n is a, c, t, g, unknown, or other
  misc_feature (184)..(184): n is a, c, t, g, unknown, or other
  misc_feature (186)..(186): n is a, c, t, g, unknown, or other
  misc_feature (188)..(188): n is a, c, t, g, unknown, or other
  misc_feature (190)..(190): n is a, c, t, g, unknown, or other
  misc_feature (191)..(191): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (206)..(206): n is a, c, t, g, unknown, or other
  misc_feature (207)..(207): n is a, c, t, g, unknown, or other
  misc_feature (219)..(219): n is a, c, t, g, unknown, or other
  misc_feature (221)..(221): n is a, c, t, g, unknown, or other
  misc_feature (245)..(245): n is a, c, t, g, unknown, or other
  misc_feature (246)..(246): n is a, c, t, g, unknown, or other
  misc_feature (258)..(258): n is a, c, t, g, unknown, or other
  misc_feature (259)..(259): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (305)..(305): n is a, c, t, g, unknown, or other
  misc_feature (310)..(310): n is a, c, t, g, unknown, or other
  misc_feature (315)..(315): n is a, c, t, g, unknown, or other
  misc_feature (370)..(370): n is a, c, t, g, unknown, or other
  misc_feature (513)..(513): n is a, c, t, g, unknown, or other
  misc_feature (567)..(567): n is a, c, t, g, unknown, or other
  misc_feature (593)..(593): n is a, c, t, g, unknown, or other
  misc_feature (594)..(594): n is a, c, t, g, unknown, or other
  misc_feature (627)..(627): n is a, c, t, g, unknown, or other
  misc_feature (635)..(635): n is a, c, t, g, unknown, or other
  misc_feature (636)..(636): n is a, c, t, g, unknown, or other
  misc_feature (652)..(652): n is a, c, t, g, unknown, or other
  misc_feature (670)..(670): n is a, c, t, g, unknown, or other
  misc_feature (671)..(671): n is a, c, t, g, unknown, or other
  misc_feature (677)..(677): n is a, c, t, g, unknown, or other
  misc_feature (705)..(705): n is a, c, t, g, unknown, or other
cgaattgggtaccgggccccccctcgagccactgcagtggtaaaggggttggcttctcctccccctccggttcgggttcgggttcgtgaggttctccggggttcggtttcgtgggtgagcggatcgagatggcnnggcgtcggatgttgagtnnaccgctgnnncttcgnntcgnagncgnngncncntnncgnnncctgggccanncggacgaccacngntccctccacaacgcccttcagcanncctacggcgagnngtcctcgnnnagtcccaagaatttattcccctccgatcggggaagnaccgncaagnaagggtcccccggcgggcttttcgcggcctttcggtccaaccctttccctcccancgggaaaagggaggggcggatatgcccgggaaaaccccccccattttccggaaggggggcccattgtggaaaaccccggggccaaaaaggggaaagaccctttggggaaaacggggcccccccccccaaaaccatattccacncccccgggtccaaaaaaccgaaaggggggcccccccccaagttttccccccccncccgccgggggggccggggccccccnnttgtttgggtaaaaagagaggcccgggggcgcncggccggnncggggcccggggggcnttttaaatcccccggggnntgaggnggttgggtgggccccccccccccctgtntgagaaaa

SEQ ID NO: 71780 - DNA, 643 bp, Zea mays
  misc_feature: Ceres CLONE 1553975
  misc_feature: Encodes the peptide sequence at SEQ ID NO. 71781
ccgattgggtaccgggccccccctcgagccctgcagtggtaaagggcccgtgtccagaagacgcctcagccaccgcaaaatccccaaatccgcggcggagaggggagagccggagacaggggcgcagccagagagatcggagaaggggaagaagatggtgcgggtggcgacctacttcgcgatgaccttcggggcgttcctcttctggcagtccatggacagggtccacgtctggatcgcccttcaccaggacgagaagaaagaaaggatggaaagggagctggagataaagagaatgcaggcagagttactggcccaagctaaagagaacgaatcatgattgtcatttgtccaatggtttcaggcagttcctttatcgtatttcctctgctgtattttccatgcaatatcttgactgatgtatgctcatgctcaacacctccaataaagcgagacatgctatagcattgttgaatgcaagtgggtatgcagtaatgctcatgttgaattgatgtaacttagccgaactgaaagagcctgccccagcttgcttggaacagaggaatttgctgctgtttttgttctttttacggaacaacacaagtcaactctcaaaaaaaattgttttttagtctggttaaaa

SEQ ID NO: 71781 - protein, 61 aa, Zea mays
  misc_feature: Ceres CLONE 1553975
MVRVATYFAMTFGAFLFWQSMDRVHVWIALHQDEKKERMERELEIKRMQAELLAQAKENES

SEQ ID NO: 71782 - DNA, 669 bp, Zea mays
  misc_feature: Ceres CLONE 1553978
  misc_feature: Encodes the peptide sequence at SEQ ID NO. 71783
  misc_feature (1)..(1): n is a, c, t, g, unknown, or other
  misc_feature (554)..(554): n is a, c, t, g, unknown, or other
ncgattgggtaccgggccccccctcgagccctgcagtggtaaagggttcccacacccctcaccgcgtccgcctcccctatcatctagggtttctagggttttccaggaggaggaaatggcgtctgatagggtgctcgggactgtgaagtggttcaacggaaccaagggcttcggtttcatcacccccgacgacgggagtgaggatctcttcgtccaccagtcctccatcaagtccgacggctaccgcagcctaaacgacggcgatgccgtcgaatacaccgtcggcagcggcaacgacggccgcgccaaggccctggatgtcaccgcgcccggcggcggcccgcttgccggcggggaacgtcccgacggcggcaacggcggtgggcgcggcggatacggcggcggcgaccgcggatacggcggcggcggtgaccgcggctacgggggaggaggcgaccgcggctacggcggcggcgaccgtggttacggtggaggtggcgaccgcggctacggcggcggcggcgaccgtggctacgggggaggcggcggctacngcggcgggtacggtggtaagtggcggcggcggcggccgcggctgcttcaagtgcggcgaggagggccacatggcaagggactgctcccagggcggcggctacgggagggggaggc

SEQ ID NO: 71783 - protein, 184 aa, Zea mays
  misc_feature: Ceres CLONE 1553978
  misc_feature (5)..(72): Pfam Name: CSD Pfam Description: 'Cold-shock' DNA-binding domain
  misc_feature (147)..(147): Xaa is any aa, unknown, or other
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGDRGYGGGGDRGYGGGDRGYGGGGDRGYGGGGDRGYGGGGGYXGGYGGKWRRRRPRLLQVRRGGPHGKGLLPGRRLREGE

SEQ ID NO: 71784 - DNA, 735 bp, Zea mays
  misc_feature: Ceres CLONE 1553979
  misc_feature: Encodes the peptide sequence at SEQ ID NO. 71785
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (624)..(624): n is a, c, t, g, unknown, or other
  misc_feature (712)..(712): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnttttttttgcgattgagtacgggccccccctcgagccctgcagtggtaaaggtgttttcttagaggtgggttggcttctcctccccctccggttcgggttcgggttcgtgaggttctccggggttcgggttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagatcatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggtgggtacggtggtggccgtggaggcggcggctacggcggtggcgggcgccgtgatggcggtggcggctacggcggtggcggcggctacggtggcggcggcggctacnagtggtggtggcggcgagctacggcgagtggcaatccgtgagcggcgagctacgagcaatctccgacgaggaatctggaggaaactgntagcggtgggagcccgtcgtcgg

SEQ ID NO: 71785 - protein, 143 aa, Zea mays
  misc_feature: Ceres CLONE 1553979
  misc_feature (10)..(81): Pfam Name: RRM_1 Pfam Description: RNA recognition motif. (a.k.a. RRM, RBD, or RNP domain)
  misc_feature (48)..(128): Pfam Name: GRP Pfam Description: Glycine rich protein family
  misc_feature: SWISSPROT Homolog: EC 5.2.1.8 Peptidylprolyl isomerase
  misc_feature (131)..(131): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGYGGGGGYXWWWRRATASGNP

SEQ ID NO: 71786 - DNA, 668 bp, Zea mays
  misc_feature: Ceres CLONE 1553980
  misc_feature: Encodes the peptide sequence at SEQ ID NO. 71787
cgattgggaccgggcccccctcgagccctgcagtggtaaagggaggacagcgctttcctgtccgactcccagacgtcgtctgctgcgtactccgcctccagtttggtctgtttcttgcaagttgctcttgcggtagttcccccaactgtcaccatgcacaacgaggagggtaagactgtggacctctatgttcccaggaagtgctcggccacaaacaggatcatcactgccaaggaccatgcctctgtccagatcaacattggccacttggatgcgaatggcctgtatgatggtcacttcacaacatttgctctctctgggtttgtccgtgctcaaggcgatgcagacagctccttggacaggctgtggcagaagaagaaggctgatatcaagcagtagattttacatctagtttaccaagaattggacactgccttagctatgttttgaattcatgtcactatatgcaatgttgtgatttcagctggtaccttaaatctgaagatttactatctttgttgggttccttctgagattgatgtgtggagatcgcttaattcacttgtacaaccgcatttagtatcagtgagatgattttggattctaaaaaaaaaaaaaaaaccagagctctgggaattcctgcaggccgggagatccactaatactag

SEQ ID NO: 71787 - protein, 81 aa, Zea mays
  misc_feature: Ceres CLONE 1553980
  misc_feature (1)..(81): Pfam Name: Ribosomal_S21e Pfam Description: Ribosomal protein S21e
MHNEEGKTVDLYVPRKCSATNRIITAKDHASVQINIGHLDANGLYDGHFTTFALSGFVRAQGDADSSLDRLWQKKKADIKQ

SEQ ID NO: 71788 - DNA, 685 bp, Zea mays
  misc_feature: Ceres CLONE 1553981
  misc_feature: Encodes the peptide sequence at SEQ ID NO. 71789
  misc_feature (1)..(1): n is a, c, t, g, unknown, or other
  misc_feature (435)..(435): n is a, c, t, g, unknown, or other
ncaattgggtacggggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacngtggtggccgtggaggcggcggctaccgcggtggcgggcgccgtgatggcggcggcggctaccgcggtggcggcggcggctaccgtggcggcggtggctaccgtgggtggtggtggcggctacggcggtggcaaccgtgggcggcggctacggcaactccgacgggaactgggagaaactgagcggtgggggcccccgcggcccaagttatcctgttcgcctacccgggatgttttcccctaagtccaaa

SEQ ID NO: 71789 - protein, 157 aa, Zea mays
  misc_feature: Ceres CLONE 1553981
  misc_feature (10)..(81): Pfam Name: RRM_1 Pfam Description: RNA recognition motif. (a.k.a. RRM, RBD, or RNP domain)
  misc_feature (48)..(133): Pfam Name: GRP Pfam Description: Glycine rich protein family
  misc_feature: SWISSPROT Homolog: EC 5.2.1.8 Peptidylprolyl isomerase
  misc_feature (98)..(98): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYXGGRGGGGYRGGGRRDGGGGYRGGGGGYRGGGGYRGWWWRLRRWQPWAAATATPTGTGRN

SEQ ID NO: 71790 - DNA, 664 bp, Zea mays
  misc_feature: Ceres CLONE 1553982
  misc_feature: Encodes the peptide sequence at SEQ ID NO. 71791
cgaattgggtaccgggccccccctcgagccctgcagtggtaaagcgtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacagcggcggtcgcggcggcggcggctatggtggcgggcgccgtgacggcggttatggcggcggtggcggctacagcggtccgccccagggtggtggcggcggctacagaggcggtggcggctactgcgggccgccccaggggtggtgggtggcgggttacggccggcggccggccggcggccttgaaaggaactgaatgttgtggggccccatccctgggctttccggcccgaaatttatcttc

SEQ ID NO: 71791 - protein, 160 aa, Zea mays
  misc_feature: Ceres CLONE 1553982
  misc_feature (10)..(81): Pfam Name: RRM_1 Pfam Description: RNA recognition motif. (a.k.a. RRM, RBD, or RNP domain)
  misc_feature (48)..(153): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYSGGRGGGGYGGGRRDGGYGGGGGYSGPPQGGGGGYRGGGGYCGPPQGWWVAGYGRRPAGGLERN

SEQ ID NO: 71792 - DNA, 863 bp, Zea mays
  misc_feature: Ceres CLONE 1553986
  misc_feature: Encodes the peptide sequence at SEQ ID NO. 71793
  misc_feature (1)..(1): n is a, c, t, g, unknown, or other
  misc_feature (22)..(22): n is a, c, t, g, unknown, or other
  misc_feature (36)..(36): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (75)..(75): n is a, c, t, g, unknown, or other
ntttttttttttttttttcccnccccgcctcccccnaatannnnnttgaaannnnntcctaaagaagctcaaagngagggcgcgccgcctctatactagtggatcccccgggctgcaggaattcgtctcacccctagaaaaactgtcttcacttatccgaggttccgtgcagcagtggaaaagagcacattttagcagagcagcgagggtcggagaatcctccccaagcttcgaatcgctatgcagcccgtcaaggtgtacgccgaccggcggtcgcaaccctcccgagctgtcatcatcttctgcagggtgaaccagatccatttcgaggaggtcacggtggatctgttcaagtctcagaagttcacaccccgaattcaaaaaaatacaacccaaaggggacagggtacctggcaagttgtttgattttttcacccccccccccctgggggggagccgggggggattttttcccctacctcctcacccccttttttttttttgggacgtcccccgaaaaccaccagtcaatccctctcgtaaaccgtggggtcgcccccacaacccccccaaatgtgttccgccccaccctttgcgaacgcggccatacaatctacacaccaatttgcaacccgccggcacgaacactaacaacccatttttcccacagaccaccaccccgaaaagatgaggacttacccttaccattcggcacccaaccccccaccgagacctcctcaccttctatcctgtaattcctcacctgttacaaagtgtttggatatgcaccgccaccaccccaccgccggtattaccataaacacctctccaccgacggcactctacctaacatttcaccaacc

SEQ ID NO: 71793 - protein, 61 aa, Zea mays
  misc_feature: Ceres CLONE 1553986
  misc_feature: SWISSPROT Homolog: EC 2.5.1.18 Glutathione transferase
MQPVKVYADRRSQPSRAVIIFCRVNQIHFEEVTVDLFKSQKFTPRIQKNTTQRGQGTWQVV

SEQ ID NO: 71794 - DNA, 639 bp, Zea mays
  misc_feature: Ceres CLONE 1553987
  misc_feature: Encodes the peptide sequence at SEQ ID NO. 71795
cgcggtggcggccgctctagaactagtggatcccccgggctgcaggaattcgtctcacccctagaaaaaaatcagatctctccacccccagcccatccatggcgatcgtgtacgccctggtcgcgcggggtacggtggtgctggccgagttctccgtcgtctcgggcaacgccggcgccgtggcccgtcggatcctcgagaagctgccgcccgacgccgagtccaggctgtgcttctcgcacgaccggtacatcttccacgtcctccgatccgacgccgtcggtgtcaccttcctctgtatgggcaacgactccttcggaagaaggatcccctttctctacctggaggacatccgaatgaggttcatgacaaactagtgcagagtcgcccactctgcgctggcttacgccatgaacgatgagttctccagagtgctccatcagcgaatggagttcttctccagcaacccaagcgccgacacactgcagcgtctccgtggagaagtcagcgagatacacactgtcatggtcgacaacctacagaacattcttgacagaggcgatcgcatctcgctccttgtcgacgagacatctaccatggcagacagcgcctttcacttccgcaagcagtccaagaagc

SEQ ID NO: 71795 - protein, 92 aa, Zea mays
  misc_feature: Ceres CLONE 1553987
MAIVYALVARGTVVLAEFSVVSGNAGAVARRILEKLPPDAESRLCFSHDRYIFHVLRSDAVGVTFLCMGNDSFGRRIPFLYLEDIRMRFMTN

SEQ ID NO: 71796 - DNA, 707 bp, Zea mays
  misc_feature: Ceres CLONE 1553990
  misc_feature: Encodes the peptide sequence at SEQ ID NO. 71797
  misc_feature (707)..(707): n is a, c, t, g, unknown, or other
ggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacgggtccgaccgcgtcaaggaactcggccccttctccgggaaaccccgaagttaactcaccggggaatttcccaggcgaataacggttggcccccccccccggggggtggggggggacccaaaaaccttctaccaaaaaatggtggagattggggcagatcccccacccccccttgggcccatgccctacgcgctcattcagctagttatctttccccaaagcctatatcttactgaaatgagaaacaaagtccagacaagacaacgactagatctcaaggatgaacgctccacaaatcacatttacgggggtgcgcgctctgaacaaaacctcgcacaagccccccccattggaactccactcctccaacagcacccccctcccccaatcctaacaccatcctataaattaggtctccgtatgtggtgcattctcgaaacttgatcgaccn

SEQ ID NO: 71797 - protein, 64 aa, Zea mays
  misc_feature: Ceres CLONE 1553990
MAASTMAISSTAMAGTPIKVGSFGEGRITMRKTVGKPKVAASGSPWYGSDRVKELGPFSGKPRS

SEQ ID NO: 71798 - DNA, 652 bp, Zea mays
  misc_feature: Ceres CLONE 1554002
  misc_feature: Encodes the peptide sequence at SEQ ID NO. 71799
gctctagaactagtggatcccccgggctgcaggaattcgtctcacccctagaaaaagtgtcatcttattccgatcctagcccctcccatctccaattcctcgcttcctcctcccttctctagttctctgatcctcagcacttagcatcaagcttagcacaccggcgagatggcctccacctccaccttcctgtccaccctcgccagcaggtccgcggcagccgatagcctgcgcagcgccgtgccgtccttcgccaagatcgtcaggttcttgcccgcgcaggcgcagatcagccgcaggcggcgcgcggcggtgctgcccacgccgagggcggcggtgtcgggcaccgagaaggcgccgtcgagcaagcacgagcgcgtggtcagggtgcacagcacccaggagttcgacgacgcgctcaaggccgccaagaaccggctggtggtggtggagtttcgcggcaagcgaacacgaggacagcagcccgatctacccgaccatgggggaagcttagccggcacttgggggggaagtgggacttccttgcgtgggcctgggcccgacgaacaaatccggaaggcccccgaaggaaagctgtttccccccggggagggggggtacacaaaagggggccctccaatttaaaaatttt

SEQ ID NO: 71799 - protein, 158 aa, Zea mays
  misc_feature: Ceres CLONE 1554002
MASTSTFLSTLASRSAAADSLRSAVPSFAKIVRFLPAQAQISRRRRAAVLPTPRAAVSGTEKAPSSKHERVVRVHSTQEFDDALKAAKNRLVVVEFRGKRTRGQQPDLPDHGGSLAGTWGGSGTSLRGPGPDEQIRKAPEGKLFPPGEGGYTKGGPPI

SEQ ID NO: 71800 - DNA, 661 bp, Zea mays
  misc_feature: Ceres CLONE 1554007
  misc_feature (661)..(661): n is a, c, t, g, unknown, or other
ggtggcggccgctctagaactagtggatcccccgggctgcaggaattcgtctcacccctagaaaaaatcgaagggtcgacaatggttaccacgatcggtagtccatagcagcggcgggcgcaacttccacccggttttcttcccatatatctgtcaaatccttctccggttgccctccatcggcagcaatttccgccatagataccggcgatcgagggcctcagacaacccaatcgacggatcatcgcggcggcaggagagggcaaacccttttcttctcactactctacttgtctgcgcctgaatcccctccgcacgaagataagacatgggtcaagcactcggcttgattcaggtggatcaatcgaccggggccatcaaggaaactttttgggaggttgaataggtcctaaaacctggatgccacttcttgccctggcgcaagaggaacaaaattgctgggaatctggccccgccatgggccaaacctttgatgtcccccggcaaaaacaaaaaaaaaggaaaatgtcttcccccaaagtttgtgggcatccgggaaaaataccgggccccttggcccaaaaggcgctctctacaccatttaaacaggtttctctacccctaagggaaagcaaaactcagtccaaaaggattttttgan

SEQ ID NO: 71801 - DNA, 667 bp, Zea mays
  misc_feature: Ceres CLONE 1554008
  misc_feature: Translation starting site: 166
cgcggtggcggccgctctagaactagtggatcccccgggctgcaggaattcgtctcacccctagaaaaaagcgcacctcatctcgctccaagcacaccaccactccacagtgcacttcactctacagcaacgacagaaaagtgagcagcagcatcagctgctgccatggaggcgtggagatctctcctcgcgagcttcgtgctcgccgtgctggccgcgcaggccttggtggccgtggtcgagtccaggaccggccccgtggagcaggcgagccaaggtgacgacgtgaagaagccggactgcgtgccggggatggacccgcgctcgttcccagggaccggcggcggccacggcatcacgcccgtgacgccatcgcacggaggctccagctccccgacgccgtctcacggcggcggcggcgggtacgttccaacgccgtcgcatggggggacgctgcctttcccgtcccaggcggctccgggctccggctcctctccgacgtcgccctccacccgggggcgggctcgtacgggggatcccccttctactccccggaaggcggcccgtacggtggggtcctcctcccggtccaccccccaagcggggggggggcgccgaaacgggggggtcctcccgtcctaaccccccgacggggggggcgggcggc

SEQ ID NO: 71802 - DNA, 647 bp, Zea mays
  misc_feature: Ceres CLONE 1554009
  misc_feature: Encodes the peptide sequence at SEQ ID NO. 71803
  misc_feature (43)..(43): n is a, c, t, g, unknown, or other
  misc_feature (44)..(44): n is a, c, t, g, unknown, or other
tggcggccgctctagaactagtggatcccccgggctgcaggannattcgtctcacccctagaaaaactccctcccatttcatcccggcattttccttgcccaacgtgctctccctcccatttcctgcgaggtggttggtggcgatggccttcaagctgatcaccaagcccgcggcggcgtcgcccgctgctgcttactggggagatctcgcccgggggccgcagggtacgagccgcgttgctcttcggaccagcgcccaggaacaaggggctcccgcgcggccaacaacttccgcaacgcccatatctaaagttagagagggtttgatccaaattgacataattgacctttggataaccccccccaacaaggtgttgggtgtggaactaaaaaaaacaccccccctattttgggccttttttggaaaaagaagaaccagatttttgcctacaccccgcgtggaaaattaatggaaaacccaatggctttcccccccttggaaaggggttattgggaggaaaacttttgggttcgaacaaattaaagttagaaaaaaaacttgaaaaaaccctcctcgcgccccctggtgtgggaaaaaaaaaaaagacccccaattaaaaaccccccttttttttttttccacaagg

SEQ ID NO: 71803 - protein, 108 aa, Zea mays
  misc_feature: Ceres CLONE 1554009
MAFKLITKPAAASPAAAYWGDLARGPQGTSRVALRTSAQEQGAPARPTTSATPISKVREGLIQIDIIDLWITPPNKVLGVELKKTPPLFWAFFGKRRTRFLPTPRVEN

SEQ ID NO: 71804 - DNA, 623 bp, Zea mays
  misc_feature: Ceres CLONE 1554011
  misc_feature: Encodes the peptide sequence at SEQ ID NO. 71805
agtggatcccccgggctgcaggaattcgtctcacccctagaaaaatccaaagaattgaccacgacctgctaggctaggagctaaccaccagacccccggccatggcgctcgcgcccacttccgctggcgggctcaagaccccgttcctcggggtcaggtgcgtgctcgtcaataccgccgccaagcccgcgactcgccgcgcgctggtcgtcgccgccgcgggcgtcgccaagaagtcgtggatcccggccatcaagagcgacgccgagatcgtgaacccgccctggctcgacggctcgttccccgtcgacttctggttcgacccgctggggctgggcaaggacccggcgtttcctcaactggtaccggtaaggcgcaccctgattcatgggtggtggggcaattggcggacccgctggccatcttcttggggcaagggtgaagcggccatcccgtggtttcgaggcctgcgcggaactcaagggacctctgccccctttctcctcgggtccccttgctggaaaaactacctgctggctcaagggggttgcctgggataccaaaaggctgggggaacttcctctaaccgaaaactcctcaggccctggaatcaggcccaagcc

SEQ ID NO: 71805 - protein, 174 aa, Zea mays
  misc_feature: Ceres CLONE 1554011
MALAPTSAGGLKTPFLGVRCVLVNTAAKPATRRALVVAAAGVAKKSWIPAIKSDAEIVNPPWLDGSFPVDFWFDPLGLGKDPAFPQLVPVRRTLIHGWWGNWRTRWPSSWGKGEAAIPWFRGLRGTQGTSAPFLLGSPCWKNYLLAQGGCLGYQKAGGTSSNRKLLRPWNQAQA

SEQ ID NO: 71806 - DNA, 630 bp, Zea mays
  misc_feature: Ceres CLONE 1554015
  misc_feature: Encodes the peptide sequence at SEQ ID NO. 71807
  misc_feature (630)..(630): n is a, c, t, g, unknown, or other
ggcggccgctctagaactagtggatcccccgggctgcaggaattcgtctcacccctagaaaattactgtggactcgtccaatttgatacttgctgggcgtaatggaaaaatatacatcattgacattgcaacaagagaaatttcaaatgtatttcaccctacaagaagggcagatggagcaaaaatctcaagagaaccacctgtaacgaagatgttcctaagtgcagacgggcaatggctagctgcggttaactgctatggggatatttatgtatttaaccttgaggtgcaaagacaacactggttcatatcccgaatgaatggtggttctgttacatctggtggtttttgccctaagaacaacacacttatcataactacatctaaaaacgaggtgtatgtatttgatgtggaaacaaaacaactaggtgaatggtccaagcgatatacgcaccagttgcccagaagtttccaggaatttcctggagaggtcattggcctatcattttctccgcaaagctcgtcatcggttattgtatacagtaccagggctatgtgctacattgattttggattgccagtagttgaggatgttgacttgccaaatggatcagctggagctgcagagan

SEQ ID NO: 71807 - protein, 139 aa, Zea mays
  misc_feature: Ceres CLONE 1554015
MFLSADGQWLAAVNCYGDIYVFNLEVQRQHWFISRMNGGSVTSGGFCPKNNTLIITTSKNEVYVFDVETKQLGEWSKRYTHQLPRSFQEFPGEVIGLSFSPQSSSSVIVYSTRAMCYIDFGLPVVEDVDLPNGSAGAAE

SEQ ID NO: 71808 - DNA, 658 bp, Zea mays
  misc_feature: Ceres CLONE 1554022
  misc_feature: Encodes the peptide sequence at SEQ ID NO. 71809
gctctagaactagtggatcccccgggctgcaggaattcgtctcacccctagaaaaacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcgggtttcccttgcgaagtacactgcggtatttgtccccccccccccgcggggggggggggggggccttcccgccgggggttctctggcccatccctcatgtagggacttcgggaagctggacgggagccgcgcggaccgtggaattccgtgggacttgggagcaagggggcccgtctttctgggtggggatagacagggtcgttgtctaagggatcttggtggagagcactctgacgagcccgcctcaagagcggggtttctcccccaaagtccgccgatgcccccttgggcgcggttgactgttccagccggtgtttcctggcctgctttaaggcgactgggccttatatattt

SEQ ID NO: 71809 - protein, 62 aa, Zea mays
  misc_feature: Ceres CLONE 1554022
MATGGAAPTASDAGSKKKLLIFDSEEDLAGFPCEVHCGICPPPPAGGGGGPSRRGFSGPSLM

SEQ ID NO: 71810 - DNA, 686 bp, Zea mays
  misc_feature: Ceres CLONE 1554025
  misc_feature (224)..(224): n is a, c, t, g, unknown, or other
  misc_feature (230)..(230): n is a, c, t, g, unknown, or other
  misc_feature (349)..(349): n is a, c, t, g, unknown, or other
  misc_feature (354)..(354): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (399)..(399): n is a, c, t, g, unknown, or other
  misc_feature (403)..(403): n is a, c, t, g, unknown, or other
  misc_feature (408)..(408): n is a, c, t, g, unknown, or other
  misc_feature (409)..(409): n is a, c, t, g, unknown, or other
  misc_feature (411)..(411): n is a, c, t, g, unknown, or other
gcggtggcggccgctctaaaactagtggatcccccgggctgcaggaattcgtctcacccctagaaaaaacgatcacacaccactccacagcagtagcaagagggatagagcaaggccacacacacacacacaccactaggctatgttagccttttaatcgtcgtcgagaagcaagaagggcgcgcacgcaagcaggcaagcaagaaaagagccgatcgaccganagctancacgcgatggcgaggtcttccaaaatgatggtggcggcatttctgctggccttgggcctggccgtgtcaaccgcctattttagtaaaatcaaaaacccgacgaccggaaaatattttanctctncctaaccccaggggaaagaaaaggggnnnnnttnnnnnnnntttntttnttttnntnccccccaaaaaaaaaaaaaaaaccccccgccggcgggggggggggggcaagaaaattcccccggggcaaaatagcaccgcacacgatatacaccctatcccgagtattcaaaatcaacgacccccaaccaatgccccctccctccccagtatagatcaccgcgtctaaaaagcatatcaataactaaaacccaaccatcaccctccatccaatctcgtatcacttactacttacatcattactccttagataatcttttctaaagccactttaga

SEQ ID NO: 71811 - DNA, 640 bp, Zea mays
  misc_feature: Ceres CLONE 1554026
  misc_feature: Encodes the peptide sequence at SEQ ID NO. 71812
tggcggccgctctagaactagtggatcccccgggctgcaggaattcgtctcacccctagaaaaaactcctcgcctcggctttgttggaacgtaaaaaaaaaaaaaaatggcagctccctcgtcgtccctcaccccgccgccgccggcagcggctgtggcctccacaacgctgtccgggaacctcacggcctcctcgctcctgtctattacgccgccgcgaccgcgcctcgccgcctcgcaccgccgggcggtcgtggccgcggccgcgtcgccccgtcccccgccgacaccggagggcgacggcgacgagcaggaggtggagagggcgatggggatggacggtggcatccccgggacctcgggggagtttctgcgccgcgtctcctcccgcgcttacggcatgcggcgccacctcatggagtcgctcgactccctcgcctacgacgtactggagacaaacccatgaagagaagattctaagccagtctatgtgctagccacaagcgataaccacctatggacaatgaaaactcgcaggagccgcaatgaagtcgaaagggaacttggaaagctttttctcaacgaagggggttctggaggtggaactaaatcgaagtactctggcccccagtttaacatg

SEQ ID NO: 71812 - protein, 45 aa, Zea mays
  misc_feature: Ceres CLONE 1554026
MGMDGGIPGTSGEFLRRVSSRAYGMRRHLMESLDSLAYDVLETNP

SEQ ID NO: 71813 - DNA, 585 bp, Zea mays
  misc_feature: Ceres CLONE 1554028
  misc_feature: Encodes the peptide sequence at SEQ ID NO. 71814
  misc_feature (138)..(138): n is a, c, t, g, unknown, or other
  misc_feature (148)..(148): n is a, c, t, g, unknown, or other
  misc_feature (375)..(375): n is a, c, t, g, unknown, or other
tggcggccgctctagaactagtggatcccccgggctgcaggaattcgtctcacccctagaaaaaatccgcgtcactcaccagtctcctcccctaatcccactctgccgccgccagcttgcccaccatggcggccgccngcctccatgntcgttcctcctctcccacccccagtcgcgctctgccaccccaagccgccacctcccgctccgtccgggagcccgccgcgtcccggtgcgcccaccgaacgccgcccgccctttcccggcggtcaccaccaaacaacgggggcgcgggcgaataaaaaacatccgtcaaggaagccgccccgggctacccgggccccccaaaaatttggtcccccccccccccccccnttaagggggacgccggggggccctcacccccaaacatataacccccaaaaaaaggggcccactccctggaaaaaaaaaattgtaccccggcccccgggcctgtggggggccctccccaaaaagggaggagaaaaaaaaaaggaaagaggatacttttctcatattctatacttccgggcgggtcctaaacgggggtcagacccacctctt

SEQ ID NO: 71814 - protein, 147 aa, Zea mays
  misc_feature: Ceres CLONE 1554028
  misc_feature (2)..(2): Xaa is any aa, unknown, or other
MXVPPLPPPVALCHPKPPPPAPSGSPPRPGAPTERRPPFPGGHHQTTGARANKKHPSRKPPRATRAPQKFGPPPPPPLRGTPGGPHPQTYNPQKKGPTPWKKKIVPRPPGLWGALPKKGGEKKKERGYFSHILYFRAGPKRGSDPPL

SEQ ID NO: 71815 - DNA, 702 bp, Zea mays
  misc_feature: Ceres CLONE 1554030
  misc_feature: Encodes the peptide sequence at SEQ ID NO. 71816
  misc_feature (377)..(377): n is a, c, t, g, unknown, or other
  misc_feature (393)..(393): n is a, c, t, g, unknown, or other
tggcggccgctctagaactagtggatcccccgggctgcaggaattcgtctcacccctagaaaaaccctctcacctcgacgcgcctccaaaagttcggagccgccggcccgtccgcctccctctccgcctcccgtccccaaggccaatagttttcaagtggcaatggcggaccaggctaaccaacccactgtccttcataagctcggtggccagttccacctgcgctcgatcatctctgaaggtgtacgggcccgtaacaatatgcctttctgtctcatcagaggaaaggagatttgcccccaggatttacatgaaccagagccttttggggccctccaattttttttcccccccccctgcgggaagcaggggaggcnaaacccccctctcttncttaatgctcttgcctgaaaaaagaaaacaaaaaccttccttgcgccactttcgtggatggccccctttttccaccttgctgtatccacaaaattgccccttactccccacatttctctgtctaaaacctcttcatttaacaaactccccccggcccccacattcaatttcgggtcggtcaaaacccagaacccttccccccttctacggtatccactccgacaaactcacagcccattaggtactataaaagaagttgacaacgtaaataaggatagaggagtgtataactaacgacccaagatagaa

SEQ ID NO: 71816 - protein, 82 aa, Zea mays
  misc_feature: Ceres CLONE 1554030
  misc_feature (72)..(72): Xaa is any aa, unknown, or other
  misc_feature (77)..(77): Xaa is any aa, unknown, or other
MADQANQPTVLHKLGGQFHLRSIISEGVRARNNMPFCLIRGKEICPQDLHEPEPFGALQFFFPPPCGKQGRXNPPLXLNALA

SEQ ID NO: 71817 - DNA, 655 bp, Zea mays
  misc_feature: Ceres CLONE 1554039
  misc_feature: Encodes the peptide sequence at SEQ ID NO. 71818
caattgggtaccgggccccccctcgagccctgcagtggtaaagggagtacgtcagcaacgcggaggaagcgcgacacgggagggaggcatgtcgtcgtccaaggacgctcctctctgccctcgatcccagcatggcgctcagttgattgcaggagctcctcaactgcaccctgtcggacgtcgcgtccgagtgccccgccatctcgcgcctctgcctgcaccgcagcttctacagctaggaggaggatctccgcttctggtcggcacgtgctgcggcctccgccgctagatgtgaccaccaccgccctggaggatgcaggtcctcctactatgtgtgggagctagggaggggtcaacgtgttcagcctgacgcaccccgtcatcgacgccgatgtcctcgagtgtatgatctgcagtcgccctgtcatcctcggcttcttctatccggacctcgagaagtgcatgggcaacggacctacagccctaaggataatgagtaggagcagtactggtgggggcatgagaagcttcaatgggatcgttgacactccctactctcctttctcgaccgaggagaaccctgttagaggttgcatccctaatggtgtgactgactgcagctgctgctgcgcaaggggagattacagcaaccatg

SEQ ID NO: 71818 - protein, 83 aa, Zea mays
  misc_feature: Ceres CLONE 1554039
MICSRPVILGFFYPDLEKCMGNGPTALRIMSRSSTGGGMRSFNGIVDTPYSPFSTEENPVRGCIPNGVTDCSCCCARGDYSNH

SEQ ID NO: 71819 - DNA, 921 bp, Zea mays
  misc_feature: Ceres CLONE 1554041
  misc_feature: Translation starting site: 641
  misc_feature (16)..(16): n is a, c, t, g, unknown, or other
  misc_feature (69)..(69): n is a, c, t, g, unknown, or other
  misc_feature (70)..(70): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (844)..(844): n is a, c, t, g, unknown, or other
tactttttcctccccncctctttctcttattctcttatcactcccctgacagggggaaaaaaaaatgtnntnnnnnnnnnnnntttttnnnnnnnnggctaattgggtaccgggccccccctcgagccactgcagtggtaagggcataagccgcgcccgcctccgcacgccccgctccgatggcagccacggctgtgaccctgccctcctcgggcacgcccttcgccgtcgccacaaccgcctcttcatcatccgggccgccgctgcctgctcctgccctccgcggggtccccgcccaagactctcccgcgtccgtggcccctccgcccgccttccgagggggccccgcccaaaccccactgaggcggccaacctcccccctcggggatttttgctccccccaccccttccgaaagccccaagggggggaacccgggtccaaggggcctcccaccaaaccaaaaaagggggggcttggtttcccccccccccccccaaagaacgggggggggggggggggtgtttccccacactagggtttccccccaaaggattccggaaaaaaaacccgattgcgctcgaaaaacactggactctccccccgggggcccccccgcaaacccagaggtgtagaatatacatgccccccccccgagggggcccgtctaacgccccccccccccccatccaacacaggcacccccgcgtttcgccccgcaataaactcccaccggggaggtaacggatcgcccccccccccccaataaacaagctcctgtcgtatcacggaagtgtacctcttttgtctcccgcgtattaaaaccctcccccacaattatttgangctgtcgtttgtgtggggggtgcgcgaataacacacacacgtgagccgccgcttgactacatcccgccacccccccc

SEQ ID NO: 71820 - DNA, 634 bp, Zea mays
  misc_feature: Ceres CLONE 1554044
  misc_feature: Encodes the peptide sequence at SEQ ID NO. 71821
tcgagccctgcagtggtaaagggtgcgcgcggtgctagtgacggttgctctagatccgttcatcctggtggttttgtgaggtcgaaagcggcgagcgaattagaagatgctggacaagctgtgggacgacgtggtggccgggcctcgcccggagacgggcctcgagaagctccgcaaggccaccaccgcccgcccgctcgtcatcaacaaagacgcggacggcggcagctacaagcgggcgcagtcgatgccgtcgaccccgacgacgccggtgacgccgtcgtcgtcgtcgtcgtcgacgacgccgcgcggcggcggcaacgtgtggcgcagcgtctttcacccggggagcaacctggccacccaaggggcattggggcggcaaacttcttccaccgtgccgaggccaacttcccccaccgttctacgactggctctccagggaccgagaccaggaaggcacccccgctttaattcgggcgaaattgcaccgcacatggaaaaggccccgtggttggccgggcccttggggggtttttctaaaaacccccccccttgggccccctttattagcgctggtccctccccctttataatatcaccctggggggtttgtggggaaatgggcgggtcc

SEQ ID NO: 71821 - protein, 176 aa, Zea mays
  misc_feature: Ceres CLONE 1554044
  misc_feature (5)..(119): Pfam Name: Auxin_repressed Pfam Description: Dormancy/auxin associated protein
MLDKLWDDVVAGPRPETGLEKLRKATTARPLVINKDADGGSYKRAQSMPSTPTTPVTPSSSSSSTTPRGGGNVWRSVFHPGSNLATQGALGRQTSSTVPRPTSPTVLRLALQGPRPGRHPRFNSGEIAPHMEKAPWLAGPLGGFSKNPPPWAPFISAGPSPFIISPWGVCGEMGGS

SEQ ID NO: 71822 - DNA, 690 bp, Zea mays
  misc_feature: Ceres CLONE 1554047
  misc_feature: Translation starting site: 285
cgattgggtacgaggacccccctcgagccctgcagtggtaaaggaggctcaggctctactgctctagtaggaggaggagtgatgagctctgcagccagtgacccctgtcggcggcggtagcttaaattggccaccatgtcgccacgatccatcggactcctctgcaaataaagccatcgggggagtgactgactgagtcagtgagtgggtgtgaggagagctttgaggggaggggagctagctagctactgcctactggaggagggcttcctccgacgccggacatgggggaggtgaagcacctgtgcctggccaagttcaaggagggcgtcgtggtggacgacgtgctcaagggcatgaccgacctcgccgccgggatggacacggtcaagtctttcgagtggtaaacactacacagggccaggacgtgctgaaccaggagatgctgacgcagggcttcacgcacgtcttctcgctcaccttcgcctccgccgccgacctcgccgcctacatggcccacgacagccacaccgcgttcgccgccaccttcatggcccgccatcgacaagggtggctcgtcgttcaaccttccccccgtcgtcggttcgccaaagccctccgcccgttcgggcatggaccccgccttgcccggcttcttcgcaattccggcccgggcccaacttggttaca

SEQ ID NO: 71823 - DNA, 600 bp, Zea mays
  misc_feature: Ceres CLONE 1554049
  misc_feature: Encodes the peptide sequence at SEQ ID NO. 71824
cgattgggtaccgggccccccctcgagccactgcagtggtaaagggcgctttggattcgctcgatcggccatcatctgactgtgcaagcacgagagggggatacagcggattcataaaccgtcagagtgttaggacaagatggtggccaatggtgatgcacctgctagagggagcgcggcggcagccgcaagcctgcgtaggcgtaggaccacaagcggtgctgctgctggtggaggcggtgccagctcaatgctccaattctacactgatgaggctgccggccgcaaaatgtcaccaaacactgttctgatcatgagtattgggttcgtagccgtcgttgctgtgctccatgtattcgggaagctgtaccgcacctccaactaggttggcattgccatatccaagaaagctgagtccaccaagagaggattcctgtagaacaatttaaatggatagcaagtgactatcagactctgttgtagaagttattttatacacttgcaatgctgcgaggctattcataaaaaaaaaaaaaaaaacagagctctgggattcctgcaccccggggaatccctaggtctagagggccgccaccccgg

SEQ ID NO: 71824 - protein, 81 aa, Zea mays
  misc_feature: Ceres CLONE 1554049
  misc_feature (32)..(77): Pfam Name: Sec61_beta Pfam Description: Sec61beta family
MVANGDAPARGSAAAAASLRRRRTTSGAAAGGGGASSMLQFYTDEAAGRKMSPNTVLIMSIGFVAVVAVLHVFGKLYRTSN

SEQ ID NO: 71825 - DNA, 611 bp, Zea mays
  misc_feature: Ceres CLONE 1554054
cgattgggtacgggcccccctcgagccactgcagtggtaaaggtgaacgccaaacagtgtctcttttccgttccagacctgaagaaactccgaccggtgagcggcagggatctgtagccgcgtatggcgacgtcgaacaccgctcggatggaggaggcggcggtgactgcggagcacagtcagaagtggacatcatctccctgtctacctcactccaagagacggtcgccgagggccgccgcatctcgctggcaagcctgcccggacccacctgcattaagatcgttgactgttgttcccactcaagatcccccccccccttcgggtttggataagggttacccctcggatttttttcccgggggggaaggtcggggcccactttaaaaaaaataaaggttcccccgggaattctggttttttaacacaaaacccccttttttttcccatgtggaaaaattttttccccaaccccccccgagggggcaaaaaaacaagggcccccccccccacccccccgggggggtgttttcaaaaaaccaaaaaggggggggaaaaaaaaaaaaaaaggggggggccccccccccggggggggggggtttttttttttt

SEQ ID NO: 71826 - DNA, 608 bp, Zea mays
  misc_feature: Ceres CLONE 1554057
  misc_feature: Encodes the peptide sequence at SEQ ID NO. 71827
  misc_feature (319)..(319): n is a, c, t, g, unknown, or other
  misc_feature (320)..(320): n is a, c, t, g, unknown, or other
  misc_feature (404)..(404): n is a, c, t, g, unknown, or other
  misc_feature (405)..(405): n is a, c, t, g, unknown, or other
cgattgggtaccgggccccccctcgagccactgcagtggtaaaggaaacttaaaccacaacgcaatcaaccaccaaagcaatcgaaaagcaaccctgcaagtgcaggcaaagaggggcgctgaccaaacagaatccaatccaatgggcgatggcaccgtccgcagcatgcgtcgtctcgttccccgcccgcccggcggcgtccacgtgccgggccccgcgccgccgcgggcaccggggcggtccacgctgtcgcggggtcggcggagggagccaagtggtgggcgccgctgctggggtggtcggggtaagccgactacnntgaggcccggcgccggcgcaagatgaggcgcccgcgaagcagttcgtgggggtgatgacggaggaagaagccccgggagctgcnnggcgcgatggcccaaaccgaatctttcacgacgccatgtaccactcccgcatggggtgggggctggaaagctcctcccaaggtttggtgccccccccgccaacttccgggggggtttggccccccccccgtaacccgttttctttgtttgggcccccccggggtaaaaatgggaaaaattttccaaaacccgccaaaccgtgg

SEQ ID NO: 71827 - protein, 78 aa, Zea mays
  misc_feature: Ceres CLONE 1554057
  misc_feature (11)..(11): Xaa is any aa, unknown, or other
MTEEEAPGAAXRDGPNRIFHDAMYHSRMGWGLESSSQGLVPPPPTSGGVWPPPRNPFSLFGPPRGKNGKNFPKPAKPW

SEQ ID NO: 71828 - DNA, 815 bp, Zea mays
  misc_feature: Ceres CLONE 1554058
  misc_feature: Encodes the peptide sequence at SEQ ID NO. 71829
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnnnnnnnnnnnnnnnnnnnnnnnnntttttttnnnnnntttttctattgggtacgggccccccctcgagccctgcagtggtaaagggttattcctcgttgcgtgccctcgccgcagacctctgccatggcggaccagctcaccgacgagcagatcgcggagttcaaggaggccttcagcctcttcgataaggatggcgacggctgcatcactaccaaggagcttggaacggtgatgcgctcccttggccagaaccctaccgaggcagagctgcaggacatgatcaacgaggtcgatgcggatggcaatgggaccatcgacttcccggagttcctgaacctgatggcgaggaagatgaaggacacggactcagaggaggagctcaaggaggccttccgcgtcttcgacaaggaccagaacggtttcatctcggctgccgagctccgccatgtcatgaccaaccttggcgagaagctgacccgacgagaggtcgacgagatgatccgtgaggccgacgtcgacggcgacggccagatcaactacgaagagttcgtcaaggtttatgatggccaaagtgaggaagcggtcccccgtggaaattaagttatctatgggattgaaagcgaaatattccaggccacaccaggcttgtaccttttggccattggtccccttttggaa

SEQ ID NO: 71829 - protein, 158 aa, Zea mays
  misc_feature: Ceres CLONE 1554058
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature (121)..(149): Pfam Name: efhand Pfam Description: EF hand
  misc_feature: SWISSPROT Homolog: EC 2.7.11.1 Non-specific serine/threonine protein kinase
MADQLTDEQIAEFKEAFSLFDKDGDGCITTKELGTVMRSLGQNPTEAELQDMINEVDADGNGTIDFPEFLNLMARKMKDTDSEEELKEAFRVFDKDQNGFISAAELRHVMTNLGEKLTRREVDEMIREADVDGDGQINYEEFVKVYDGQSEEAVPRGN

SEQ ID NO: 71830 - DNA, 551 bp, Zea mays
  misc_feature: Ceres CLONE 1554059
  misc_feature: Encodes the peptide sequence at SEQ ID NO. 71831
  misc_feature (349)..(349): n is a, c, t, g, unknown, or other
  misc_feature (405)..(405): n is a, c, t, g, unknown, or other
  misc_feature (406)..(406): n is a, c, t, g, unknown, or other
  misc_feature (439)..(439): n is a, c, t, g, unknown, or other
  misc_feature (464)..(464): n is a, c, t, g, unknown, or other
cgattgggtaccgggccccccctcgagccactgcagtggtaaaggaggagatgcagaggccaggcaccccactctacaacatcaaggcttacctccctgtcatcgagtcctttgggttctccagccagctgagggctgcaacctctggtcaggcgttcccccaggctgtctttgaccattgggacatgatgggctctgatcctttggaggctggctcccaggctgctcagctggtgctggatatccgcaagaggaagggtctcaaggaacagatgatcccactttctgagtttgaggacaagctctaaatttgtggttgttggtgaaacaactgttacagctgcccggnttcaatccgccaatttggtttttactggaaaaaacaacaggggggggccccccctnnccccccaaaaacccgggagaacccccccctttntaaaaaaaaaggggggaaaaacacnccccccccgggggggttttttttttttttttttcccccggggggtgtttttctcccccccccctttttttttttttttttttttttt

SEQ ID NO: 71831 - protein, 101 aa, Zea mays
  misc_feature: Ceres CLONE 1554059
  misc_feature (4)..(70): Pfam Name: EFG_C Pfam Description: Elongation factor G C-terminus
IGYRAPPRATAVVKEEMQRPGTPLYNIKAYLPVIESFGFSSQLRAATSGQAFPQAVFDHWDMMGSDPLEAGSQAAQLVLDIRKRKGLKEQMIPLSEFEDKL

SEQ ID NO: 71832 - DNA, 717 bp, Zea mays
  misc_feature: Ceres CLONE 1554074
  misc_feature: Translation starting site: 141
  misc_feature (717)..(717): n is a, c, t, g, unknown, or other
cgattgggtaccgggccccccctcgagccctgcagtggtaaaggctattcgtgtcctggcatccgcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaaagctgcccttccagcgcctggtgcgcgagatcgcgcaagactttcagacagacctccggtttccagagccacgcccgtgctgggcgctccaggaagcccgccgaggcctaacctcgtcggggctctttgaaggacaccaaactctgggccatccacgcttaagggggtcacccatcatggccaagggaaattccggttgccccccccccattcgtgggggaggggggccgtaacccttctttttctcggggggaatcggaaaaaaagggtttatttcccaaaaacaaaaaaggggggtgttttaccggccccggggtgtcccgggaatccccgttaattttggggaaaccccggggggcgccggaaaaaaaaacccttttttn

SEQ ID NO: 71833 - DNA, 651 bp, Zea mays
  misc_feature: Ceres CLONE 1554081
  misc_feature: Encodes the peptide sequence at SEQ ID NO. 71834
cgattgggtacgggccccccctcgagccctgcagtggtaaagggtgctctctcagaggtgggctggcttctcctccccctcttacaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctactgcggcggtcgcggcggctgcggctatggtggcgggcgccgtgacggcggttatggcggcggtggcggctacggctgtcggcgcgagggtggttgcggcggctaccgatgcggtggcggctacagcggtcggcgctaaggtggtggtggcggctacggcggcggcggcggccgcttggagggactgatgtgtgggcccatcctggcttcggccgagttatcttacctatctat

SEQ ID NO: 71834 - protein, 141 aa, Zea mays
  misc_feature: Ceres CLONE 1554081
  misc_feature (10)..(81): Pfam Name: RRM_1 Pfam Description: RNA recognition motif. (a.k.a. RRM, RBD, or RNP domain)
  misc_feature (48)..(141): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYCGGRGGCGYGGGRRDGGYGGGGGYGCRREGGCGGYRCGGGYSGRR

SEQ ID NO: 71835 - DNA, 633 bp, Zea mays
  misc_feature: Ceres CLONE 1554089
  misc_feature: Encodes the peptide sequence at SEQ ID NO. 71836
cgattgggtaccgggccccccctcgagccactgctgtggtaaaggaggggccatcagatccaagaagagggaagagcaccaaggaccttcggcgcccgttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcagcagcagggtcaaaggactacgttcacgtgcgcatccagcagcgtaatggtcgcaagagcctgaccaccgtcagggattgaaagaagagttcactaccgcaagatcctccaaaatctcaagaagaagtttctgccccaatggaaacatgggcccggaccccaaaacttggaaagggtctttccccccccgggggattcaaagaaagaaaccccccaaatttccccccccccggccccgctttttttaaaaaaagggccccccccaaaatttctggggttttttagaaaaacccccggggtgccatttttaaaaaacaccccccttttgtgggggggggtttttttttttttaata

SEQ ID NO: 71836 - protein, 51 aa, Zea mays
  misc_feature: Ceres CLONE 1554089
MSDLDIQIPTAFDPFAEANAGDSGAAAGSKDYVHVRIQQRNGRKSLTTVRD

SEQ ID NO: 71837 - DNA, 674 bp, Zea mays
  misc_feature: Ceres CLONE 1554090
  misc_feature: Encodes the peptide sequence at SEQ ID NO. 71838
cgattgggtaccgggccccccctcgagccctgcagtggtaaaggaaccgccctcattccaaaccctagtcgtcgccagccttggagctatcgtacgcggtggctcctcctccactccccatcgactcctcctccatccccgacgcggcggcgccagcctgcaggcactggtgggagaagctgcaaacaatcttcaggagtacttcagaacaatgtcacggaggctgacattgaagaatttgaagctaaatatagagggtcagattctgagaaaacagacttgaaggaactctacacaaaatataagggcaacatgaacatgaataattatctcttatatcatattgtaaaatctgaaacagttctcctatagatggttagcttgcattttacgctacaattacctcagatcacttcttgttgtatcttacaccaatttacgaaatttcttgatgtgttttatgacaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgtttcctgtgtgaaaattgttatccgctcacaattccacacaacatacgagcccgaggcc

SEQ ID NO: 71838 - protein, 123 aa, Zea mays
  misc_feature: Ceres CLONE 1554090
RLGTGPPLEPCSGKGTALIPNPSRRQPWSYRTRWLLLHSPSTPPPSPTRRRQPAGTGGRSCKQSSGVLQNNVTEADIEEFEAKYRGSDSEKTDLKELYTKYKGNMNMNNYLLYHIVKSETVLL

SEQ ID NO: 71839 - DNA, 694 bp, Zea mays
  misc_feature: Ceres CLONE 1554092
  misc_feature: Encodes the peptide sequence at SEQ ID NO. 71840
cgattgggtacgtggccccccctcgagccctgcagtggtaaagggacggcgccgacaaaaccagaccatcaaacaagtgccagcgccctctcgcagtcgccgcaatggagagcaccttcatcatgatcaagcctgacggcgtccagaggggcctcattggtgagatcatcagccgttttgagaagaagggcttctacctcaaggccttgaagcttgtgaacgtggagaggtcgtttgctgagaagcactacgccgatctcgcctccaagcccttcttccagggcctcgtggactacatcatctctggccctgtggtggccatggtctgggagggcaagagcgtcgtcacaactggccgcaagatcattggcgccaccaaccccctggcttctgagcccggcaccatccgtggcgactttgctgtcgacattggcaggaatgtcattcatggaagtgacagcattgagagtgctaataaggagattgccctgtggttccccgagggccctgctgattggcagagcagccagcaccccctggatctacgagaaagtaacctgggaaagtttcacatcaaaacctttgagagccaagaagaaagcattgtcaccctttttgttgcttttatacaaatgttttttccaaaaaagaaattattgaatccctggtatcccttgggaaaaccctttaattt

SEQ ID NO: 71840 - protein, 196 aa, Zea mays
  misc_feature: Ceres CLONE 1554092
  misc_feature (2)..(134): Pfam Name: NDK Pfam Description: Nucleoside diphosphate kinase
  misc_feature: SWISSPROT Homolog: EC 2.7.4.6 Nucleoside-diphosphate kinase
MESTFIMIKPDGVQRGLIGEIISRFEKKGFYLKALKLVNVERSFAEKHYADLASKPFFQGLVDYIISGPVVAMVWEGKSVVTTGRKIIGATNPLASEPGTIRGDFAVDIGRNVIHGSDSIESANKEIALWFPEGPADWQSSQHPLDLRESNLGKFHIKTFESQEESIVTLFVAFIQMFFPKKKLLNPWYPLGKPFN

SEQ ID NO: 71841 - DNA, 710 bp, Zea mays
  misc_feature: Ceres CLONE 1554093
  misc_feature: Encodes the peptide sequence at SEQ ID NO. 71842
  misc_feature (100)..(100): n is a, c, t, g, unknown, or other
acgattgggtacgggccccccctcgagccctgcagtggtaaagggaggtggcggcgctcctcccgtcttcttcttcttcttcctgtactatatatatatnagcttcccctcgcaaattgtcactgacgttcattcggcttgcttgattgttccaggtattcgcagtcgaccgtgtcctcggagcacgatgaaggttgttgctgcctacctgcttgctgtcctcgctgggaatgccagcccctccgctgaggatttgactggcattctggagtcagttggctgtgaagttgacaatgaaaggatggaactgctgctgtcccaactgagcggtaaggacatcaccgagctcattgccgcccgcagagagaagggggcggcggtcccatgtggcggcggccgtgttgcctttgcggcaggtgcaccttgctgctgggggagctgctcctgcagctgaggcaaaaaagaagagaaggggggaaaaaaaggaaaaaaccgatgatgatttgggcttccccccccttccactcgggtggcacaatcatcacagttattgttttcgggcagtggaaatccaaggggaaaccccgagcccgtggtttagattttaacccttattttaagggcgggaaaaaaaccggccaaaaaccgccaaattgggccgctgggattttggggaattcccacgccggaaaattggccattggatgggg

SEQ ID NO: 71842 - protein, 88 aa, Zea mays
  misc_feature: Ceres CLONE 1554093
  misc_feature (17)..(79): Pfam Name: Ribosomal_60s Pfam Description: 60s Acidic ribosomal protein
MKVVAAYLLAVLAGNASPSAEDLTGILESVGCEVDNERMELLLSQLSGKDITELIAARREKGAAVPCGGGRVAFAAGAPCCWGSCSCS

SEQ ID NO: 71843 - DNA, 890 bp, Zea mays
  misc_feature: Ceres CLONE 1554104
  misc_feature: Encodes the peptide sequence at SEQ ID NO. 71844
  misc_feature (71)..(71): n is a, c, t, g, unknown, or other
  misc_feature (72)..(72): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (100)..(100): n is a, c, t, g, unknown, or other
cgtttgtggtgcactgtacgacaaatactcccaacacaacaggaattacgcggtctgtcttagggcaagtnnaaataatagagaannnnnnntttttttnttttttccaattggggtacgggtccccccctcgagccactgcagtggtaaagggagatccgcttcgcatctccgcgacagatccgggcaaacgggccgatgcagttcttcggcggctcgtcgctgacgtcggtcgcgccggaggcgaccccagccccggcggcgccccctggtacgggcacgggcgccagcgcgcaggtcctctacgtcttcaaccgcaacggcgtctgcctgctctaccgcgagtggcaccgccccctccgcacgctcgaccccacccaggatcacaagctcatgtttcgggctcctctttctcctttcgctcccttcaccgccaaagatcgaacccaacaccggcacgaaaaagggaaatctttggtgtgcccactaactgcccaggcccaagggtgggttccgttttttatagccttcacaaaaaccaaaacccctttcccaaaacctggaaacctttttaccgggaaaaaaccccccctttcttgggggtaataaaaaaccctttttataccctaaaattttccccaccccctccccccaaaaggaaaatcgggggggggaaattcaaggggggaagaaaactcccgcccttataagaaggctttttttctcttcaccaaaaccctccttataatgttggggagaaaaaaacccgtttttttaaaaaaaaaataatcccccccctgggtataaccccccccccggggaaaaacaccccccctttctccagggtggggggaaaaaatctttttttttaaaacacaaaaaaattttcg

SEQ ID NO: 71844 - protein, 135 aa, Zea mays
  misc_feature: Ceres CLONE 1554104
MQFFGGSSLTSVAPEATPAPAAPPGTGTGASAQVLYVFNRNGVCLLYREWHRPLRTLDPTQDHKLMFRAPLSPFAPFTAKDRTQHRHEKGKSLVCPLTAQAQGWVPFFIAFTKTKTPFPKPGNLFTGKKPPLSWG

SEQ ID NO: 71845 - DNA, 658 bp, Zea mays
  misc_feature: Ceres CLONE 1554112
  misc_feature: Encodes the peptide sequence at SEQ ID NO. 71846
cgattgtgtacgggccccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggcggcggctacggtggtggccgtggaggcggcggctacggcggtggcgggcgccgtgatggcggcggcggctacggcggtggcggcggcggctacggtggcggcggtggctacagtggtggtggtggcggctacggcggtggcaaccgtggcggcggctacggcaactccgacgggaactggaggaactgagcggtggggccc

SEQ ID NO: 71846 - protein, 167 aa, Zea mays
  misc_feature: Ceres CLONE 1554112
  misc_feature (10)..(81): Pfam Name: RRM_1 Pfam Description: RNA recognition motif. (a.k.a. RRM, RBD, or RNP domain)
  misc_feature (48)..(162): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGGGYGGGRGGGGYGGGGRRDGGGGYGGGGGGYGGGGGYSGGGGGYGGGNRGGGYGNSDGNWRN

SEQ ID NO: 71847 - DNA, 646 bp, Zea mays
  misc_feature: Ceres CLONE 1554118
  misc_feature: Encodes the peptide sequence at SEQ ID NO. 71848
cgattgggtaccgggccccccctcgagccactgcagtggtaaaggcggaaacccagcggcggccgcgggcgccccaaacccagggcagagtcgcagggtgacggggagagcccatcctggcgccgcagcagccgtgaagcacaagagctttgctgcagcacgacggctttgtcctctctcctttaaaacggactgctctcctcaattgtcagtcagtagcatccaattgattgttctatcctcttctctgttctcacccccttgcaagcaacaatcgttcaccgatcgatccagtgcgtcctgcatggaaactgccgccgtcgccgccgccggtgccgggcgccgcatcatggtggccgtggacgagggcgaggagagcctgcacgcgctcaactggtgcctcgccaacgtcgtctccccggcaggaggcgacacgctggtgctcgtccacgcccgccgcccgcgcccggtctacgccgccatggacagcgcagggtacatgatgacctcggacgtgctggcgagcgtcgagaggcacgccaacgcggtctcggcggcggcggtcgacaaggccaagcgcgtctgcgcggaccacccgcacgtcaaggtggagacgatggtggagagcggggacccgcgggacgtc

SEQ ID NO: 71848 - protein, 114 aa, Zea mays
  misc_feature: Ceres CLONE 1554118
METAAVAAAGAGRRIMVAVDEGEESLHALNWCLANVVSPAGGDTLVLVHARRPRPVYAAMDSAGYMMTSDVLASVERHANAVSAAAVDKAKRVCADHPHVKVETMVESGDPRDV

SEQ ID NO: 71849 - DNA, 630 bp, Zea mays
  misc_feature: Ceres CLONE 1554126
  misc_feature: Encodes the peptide sequence at SEQ ID NO. 71850
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
cgattgggtccgggccccccctcgagccactgcagtggtaaaggtccatcccctctttctctcgtggcgacgacggcgaccgtcacaccccccctatgtgctaggtgccagggtccgtcgggtccttcgctggcgacgagcaactaccaggcgacccagtggtgtgttcgggaacgtttccgcgggcgggcggcggcccccagtggcgaagatgatctgactaccgacgtacgcagcacgaggcgttcgttgccatcttcttctcctttgagtatatgatactagcaacatccacggtatcaacattcgtgaagtatatattctatgttagtgacatgctaatggaaggtcaatgggagaaaaaggcagtgtatacattttacttggagctcataagtgaccttgtgcacttgtcattatacatgctcttcttcatagttatcttcctgaactatggtgatcggcgaccgtgatcttccatgttattatgttctgatacttgagacttttattatgactatgtatgagatattgtctcttattagtactggttgatgagatgtgtcttattatgactatggatgagacttttgtgatgtaacccggnnnnnnnnnnnnnnnnnnnnnnnn

SEQ ID NO: 71850 - protein, 65 aa, Zea mays
  misc_feature: Ceres CLONE 1554126
  misc_feature: SWISSPROT Homolog: EC 6.3.2.19 Ubiquitin--protein ligase
MILATSTVSTFVKYIFYVSDMLMEGQWEKKAVYTFYLELISDLVHLSLYMLFFIVIFLNYGDRRP

SEQ ID NO: 71851 - DNA, 677 bp, Zea mays
  misc_feature: Ceres CLONE 1554134
  misc_feature: Encodes the peptide sequence at SEQ ID NO. 71852
ccaattgggtacgtggccccccctcgagcactgcagtggtaaagggggctataagtcgtgctccaagcctctggttaacacctctgcgctcccaactcgagaccaaggaaaaagagaagggggacgagtgcggctgtgggcgggattctgttcgaccgccgattcgaccccggggaagcctctggttaacacctctgcgcacccaactcgagaccgaggaaaaagagaagggaaagcatagggtgcggggaaggtatcgcctcggaaggactcaaatcaacggcaattcctcgccggacattgctttccgtcgtgaagtcgctccgctctgtggacaggctcgtcatcaagccaatcgcgggtacgctacaggatatggttgatggtgtgacttggccttctaccctgccaccgggttggacggttgagtgggatgctgcctcgacaggagaggagcaggaggagaggggataggccttgccctattcctcagtattcgacgtcatcgattatccgttgcactttaattatgaactagttcccttttatttaaaactcctatttatgtaaaaaaaaaaaaaaaaaccagagctctgggaattcctgcagcccgggggatccactagttctagagcggccgccaccgcggtggagctccagcttttgttccctttagt

SEQ ID NO: 71852 - protein, 32 aa, Zea mays
  misc_feature: Ceres CLONE 1554134
MVDGVTWPSTLPPGWTVEWDAASTGEEQEERG

SEQ ID NO: 71853 - DNA, 631 bp, Zea mays
  misc_feature: Ceres CLONE 1554135
  misc_feature (122)..(122): n is a, c, t, g, unknown, or other
  misc_feature (123)..(123): n is a, c, t, g, unknown, or other
  misc_feature (134)..(134): n is a, c, t, g, unknown, or other
  misc_feature (135)..(135): n is a, c, t, g, unknown, or other
  misc_feature (144)..(144): n is a, c, t, g, unknown, or other
  misc_feature (161)..(161): n is a, c, t, g, unknown, or other
  misc_feature (603)..(603): n is a, c, t, g, unknown, or other
  misc_feature (604)..(604): n is a, c, t, g, unknown, or other
  misc_feature (607)..(607): n is a, c, t, g, unknown, or other
ccattgggtcgggcccccctgacctctgcagtggtaagggctctgaagcattcctccatctcccaagacctcctcagacccgagaagcgcagcttgcggcctatggtacgccaccggcactnnggagctggagnnggaaggcgnaagaaagggggagcttngccggtcgcaaggggccggcgggccgaaggaagaagtcgggtggaacggaggggtcccgttggaaagggccgggggctcccagttttcccccgttcggggcccccattcccggggcggccttacccttcaaagaaaagggggccccgccctaacccgccgcccaaagcgggccggttccggggccaaagcccgggtttgccccccccccccccggttttttttaaccccctttccggggggggggccccccctttcccccccttgggaaaaaaatttaaaccccctttttgggccccccccctttttttaaaaaaaggggccccccccccggggggaaaaaaaaaatttttttttggccccccgggggggggcaaaaaaaaaacccccccctttttttttcccccccccaagagggggggggggccaaaaaaaaaacccccnnccngggggaaaaaaaaaaaaaaacccc

SEQ ID NO: 71854 - DNA, 641 bp, Zea mays
  misc_feature: Ceres CLONE 1554140
  misc_feature: Encodes the peptide sequence at SEQ ID NO. 71855
cgattgggtccgggccccccctcgagccactgcagtggtaaaggctgctcgatctgagatatcgctcgtccatttgacggcggcgcgccctcctgcagggaaaaacaaaatagaagacgatgctgccccgcttgccaatccgcctcgcgccgccgctcgccggcgtccttcgcggcatctgcgccaccgcgctgccgcaatccaagcccccacctcaacccctctccccgtccgacctggacgcgatctccgcgctcctcccgcgcctcctctacgcgggccacgtccccgccgccggccgcctcctctccgcggcgctcctcctcccgggctcccaggacggcctccccctcgattccctcgccgcgcaccttgcctcgcttccgaccctctccgctgccttcgcgctcctcaccgcgctgcgccatcacccggcccggccctcaccgctcctgctggcgtcgccgctgctcggcagcctcctctccctgcgccgcgcgcgcgaagcctcctccgtgctgcgctggctctgccgcccggactccccgcgccggcccgacgccgccacctacgctgacgccgtcgaggggctctgccgccttgaggacccaggggcgcgctggctgcgctcaggaagatgg

SEQ ID NO: 71855 - protein, 174 aa, Zea mays
  misc_feature: Ceres CLONE 1554140
MLPRLPIRLAPPLAGVLRGICATALPQSKPPPQPLSPSDLDAISALLPRLLYAGHVPAAGRLLSAALLLPGSQDGLPLDSLAAHLASLPTLSAAFALLTALRHHPARPSPLLLASPLLGSLLSLRRAREASSVLRWLCRPDSPRRPDAATYADAVEGLCRLEDPGARWLRSGRW

SEQ ID NO: 71856 - DNA, 626 bp, Zea mays
  misc_feature: Ceres CLONE 1554152
  misc_feature: Encodes the peptide sequence at SEQ ID NO. 71857
cgattgggtaccgggccccccctcgagccactgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcccctgggccacggacgaccactccctccacaacgccttcagcacctacggcgaggtcctcgagtccaagattatcctcaatcgcgagacgcagatgtcccgcggcttcggttttgtcaccttctccacggaggaggcgatgcggaacgccatcaagggcatgaacggcaaggagctggacggccgcaacatcaccgttaacgaggcccactcccgcggcggccgtggaggctgcggcggtggctacggtggtggccgtggaggcggcggctactgcggtggcgggcgccgtgatgtcggctgcggctacggctttggcagctgcggctactgtggcggcggtggctaccgtggtggtggtggcggctacggcggtggcaatcatggcggcggctactgcaactccaactgcaactggaggaactgagcggtggggcc

SEQ ID NO: 71857 - protein, 156 aa, Zea mays
  misc_feature: Ceres CLONE 1554152
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLPWATDDHSLHNAFSTYGEVLESKIILNRETQMSRGFGFVTFSTEEAMRNAIKGMNGKELDGRNITVNEAHSRGGRGGCGGGYGGGRGGGGYCGGGRRDVGCGYGFGSCGYCGGGGYRGGGGGYGGGNHGGGYCNSNCNWRN

SEQ ID NO: 71858 - DNA, 665 bp, Zea mays
  misc_feature: Ceres CLONE 1554163
  misc_feature: Encodes the peptide sequence at SEQ ID NO. 71859
cgattgggtaccgggccccccctcgagcactgcagtggtaaaggtcaaactttaccactgcagtggaggaagatgctgcaaataaggccaagggcgaggaagagaagaggctagatgagtacgaggctttcctcagggatttggaggtggactcagggatgtggtccaagatgaatctgtacaaaaatgaggactataggtctgagatggcatcaacagttggtgatgatatccctacggtgccaattgaggagctgattgaggacttgacccttggtgacgatgaggaggatgaagggaaagaaactgtggaagggaacactcatactggaatggtggaatgagcaatactgtctactatttgtttccgaattgctgactgggatgggttggcctacctgcccccttctggcgatgagcctgtcagttatcatatatgttattttttgttgttactgctacaagttagaattttggttgtagtgcttaagttttgaattctgctgtttgttcgaatcatctttttttttccaagtctttcccctgtatgccccacttttcattaatttttatataaaaagctttacataaaaaaaaaaaaaaaaaacccgagctctgggaaattcctgcagcccgggggatccactagtttctagagcgggcgc

SEQ ID NO: 71859 - protein, 61 aa, Zea mays
  misc_feature: Ceres CLONE 1554163
MWSKMNLYKNEDYRSEMASTVGDDIPTVPIEELIEDLTLGDDEEDEGKETVEGNTHTGMVE

SEQ ID NO: 71860 - DNA, 677 bp, Zea mays
  misc_feature: Ceres CLONE 1554167
  misc_feature: Encodes the peptide sequence at SEQ ID NO. 71861
cgattgtgtacgggccccccctcgagccctgcagtggtaaagggtgctctctcagaggtgggctggcttctcctccacctcttagctagtcctcttcggattacggttacttagggttttgtggaggggctatggcgggcgttgatgtggagtaccgttgcttcctctgcgggcttgcctggaccaccatcgacgagtcgctggagaatgccttcgcctcctacggtgagatcctcaactccaatgtcatcaccgatctgcagactgggaggcctcgcgacttccgcttcgttaccttctcctccgagaactccagtgctcgacgctatctagaacatttacggccagtaactcgacgaccgtttcatccccgtttaccatacccagtcccgtgccggaggcactcccgacagcgtctacggcggcaactcagcttgctgtgccgtcgagctatgagtggcgggcgccgagacggctgctattgctgctgcggccgctacggcattctacactatggtggtggctgcatctactgaggacgtggctgataccgcagactactctagagtggtggtggatgatacggcatctgcagcagcggctataagtactaatgtgtgtgcccatcctggcttcggacgagttatcttatctatctatcacttcgtgttaccgtt

SEQ ID NO: 71861 - protein, 134 aa, Zea mays
  misc_feature: Ceres CLONE 1554167
  misc_feature: SWISSPROT Homolog: EC 5.2.1.8 Peptidylprolyl isomerase
MAGVDVEYRCFLCGLAWTTIDESLENAFASYGEILNSNVITDLQTGRPRDFRFVTFSSENSSARRYLEHLRPVTRRPFHPRLPYPVPCRRHSRQRLRRQLSLLCRRAMSGGRRDGCYCCCGRYGILHYGGGCIY

SEQ ID NO: 71862 - DNA, 561 bp, Zea mays
  misc_feature: Ceres CLONE 1554174
cgattgggtaccgggcccccctcgagcctggagtggttaaggtgctttcttacaggtgggttggcttctcctccccctccggttcgggttcgggttcgtgaggttctccggggcttcggttatcgtgggtcgagcgagatcgaacgatggcggcatccatgtgagtacgctgctcgtagcggctcgctgagcaggagacactgctcagcaccctcagatcatagcgagtccttagtccagatactctcgatccgagacgccgaggcccccggattacgacttgtttcccttttccccgggtgaggctatttcggaaacgccctccaggggtttgaacggcaattgaattgggaggcccgcatttttaaccccttaaaaaagggcccccccccccggggggcccctaaaaaagcccaccccggggggttttcttttgggaggacccacaaaaaaacggggccctttaccgggggggggggggggccccctttttttggcgcgggggatattcccgggtggggggggggcgccttttcgggggggggggggtttttttttttg

SEQ ID NO: 71863 - DNA, 654 bp, Zea mays
  misc_feature: Ceres CLONE 1554177
  misc_feature: Encodes the peptide sequence at SEQ ID NO. 71864
  misc_feature (178)..(178): n is a, c, t, g, unknown, or other
cgattgggtaccgggccccccctcgagccactgcagtggtaaaggcggcggaagcagaagtggaaggaagcaggcggccaccatggtgaagggacgcacgggacagcgcgtcaggctctacgtccggggcaccatcctcggatacaagaggtccaagtcgaaccagtacgagaccacngtcgctcattcagaatcgagggggtgaacaccaaggaggacgtcgcgtggtacgctggcaagcgcatggcgtacatctacaaggctaagaccaagagcagcgagacccgctacaggtgcatctggggcaaggtcacccgcccgcacggcaactcgggcgtcgtccgccccaagttcaagtccaacctcccgcctgagtccatggggcgcaaagtcagagtgttcatgtacccgaccaccaccaaaggtttttgttggagtaaaggtggactctaaaggggccatgcttaagttcttctctctgaacctaaaaatgccatggggttggcaaacttaaaatggttcatgttaccggaacctgttgaaagttccttccaaaatttgtgttgtcaaaacgggttaaaaaatttgcccctaaatggtttaggcctaaaaaaaaaaagctttttttttccaaaaaaaaagaaaggtgagtgg

SEQ ID NO: 71864 - protein, 69 aa, Zea mays
  misc_feature: Ceres CLONE 1554177
  misc_feature (2)..(53): Pfam Name: Ribosomal_L35Ae Pfam Description: Ribosomal protein L35Ae
MAYIYKAKTKSSETRYRCIWGKVTRPHGNSGVVRPKFKSNLPPESMGRKVRVFMYPTTTKGFCWSKGGL

SEQ ID NO: 71865 - DNA, 522 bp, Zea mays
  misc_feature: Ceres CLONE 1554180
  misc_feature (162)..(162): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (179)..(179): n is a, c, t, g, unknown, or other
  misc_feature (180)..(180): n is a, c, t, g, unknown, or other
  misc_feature (217)..(217): n is a, c, t, g, unknown, or other
  misc_feature (218)..(218): n is a, c, t, g, unknown, or other
cattgggtacgggccccccctcgagccactggcagtggtaaaggtgaagagaagaggtccatccacaggaccaccagaagagccacagcaccagcggcaggcacccaaagcccaggaccgccaatggccgaccgcgtgtaccccgtccgccaagccgtaacnccgcctnnnccaggcgnncgggccgggccaaaacagccaaaacgggtcggcccgnnccaaaggcggtcggtcggttcccctgcgcccaagttcgcaaaaatggggtaaccccaaggcgggggccccattcttaccgtcccgcatggccccgccaaaccgcagccccgggccgccttgccggtgcaccttggggctgctgcctcctcccggggcccggggggggggggaatccttgctggggctttcgggggcccccggggggttgggggggggcgcctttttttctacctggttgtaacccggggccccaaaagggggcccctttttttttaaaaagggggggtcgcacaaaaggggggg

SEQ ID NO: 71866 - DNA, 658 bp, Zea mays
  misc_feature: Ceres CLONE 1554182
  misc_feature: Encodes the peptide sequence at SEQ ID NO. 71867
ccaattgggtacgtggccccccctcgagcactgcagtggtaaaggcgcccttctcatccgcatcagatctagcgccgcctccttcatcccgctggccggcgagctcctcagcacgggaagaaatggaagctcaaggcttcactaatgggcatgctacctggacatcagcaatttcctctttcatgttgtcctacatgtccaatgtggtgtcaagtggcgaaaggacatcgtctggttttaagaaagttcactacaatagttgtgcaaaagctatcaatgaaaagttccaaattgccctcaatggcgagcagattaaaaatcatctgaaaacttggtccagaaggtttgccaagataaataggataagaaaagtgagtggtacaggctgggatgaagatagttttactattaatatggatgaagagcactataatggctatgttaaggtaagtttgcaaaggattctagtgcaactttaggcgaagatgatgaagttgataatgaagaggtgatggcacatgctttcactaaaaggatgtccacttgtgatgataatgctacaacttcttgtacaagcaagaccaggaagaaggcaaaaaacgtgatagtgaagatgaggggttgattgctgcattcaaaagtgtcggggataccttat

SEQ ID NO: 71867 - protein, 118 aa, Zea mays
  misc_feature: Ceres CLONE 1554182
MEAQGFTNGHATWTSAISSFMLSYMSNVVSSGERTSSGFKKVHYNSCAKAINEKFQIALNGEQIKNHLKTWSRRFAKINRIRKVSGTGWDEDSFTINMDEEHYNGYVKVSLQRILVQL

SEQ ID NO: 71868 - DNA, 628 bp, Zea mays
  misc_feature: Ceres CLONE 1554183
  misc_feature: Encodes the peptide sequence at SEQ ID NO. 71869
  misc_feature (1)..(1): n is a, c, t, g, unknown, or other
  misc_feature (570)..(570): n is a, c, t, g, unknown, or other
  misc_feature (571)..(571): n is a, c, t, g, unknown, or other
  misc_feature (572)..(572): n is a, c, t, g, unknown, or other
  misc_feature (573)..(573): n is a, c, t, g, unknown, or other
  misc_feature (574)..(574): n is a, c, t, g, unknown, or other
  misc_feature (575)..(575): n is a, c, t, g, unknown, or other
  misc_feature (576)..(576): n is a, c, t, g, unknown, or other
  misc_feature (577)..(577): n is a, c, t, g, unknown, or other
  misc_feature (578)..(578): n is a, c, t, g, unknown, or other
  misc_feature (579)..(579): n is a, c, t, g, unknown, or other
  misc_feature (580)..(580): n is a, c, t, g, unknown, or other
  misc_feature (581)..(581): n is a, c, t, g, unknown, or other
  misc_feature (582)..(582): n is a, c, t, g, unknown, or other
  misc_feature (583)..(583): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
  misc_feature (587)..(587): n is a, c, t, g, unknown, or other
  misc_feature (588)..(588): n is a, c, t, g, unknown, or other
  misc_feature (589)..(589): n is a, c, t, g, unknown, or other
  misc_feature (590)..(590): n is a, c, t, g, unknown, or other
  misc_feature (591)..(591): n is a, c, t, g, unknown, or other
  misc_feature (592)..(592): n is a, c, t, g, unknown, or other
  misc_feature (593)..(593): n is a, c, t, g, unknown, or other
  misc_feature (594)..(594): n is a, c, t, g, unknown, or other
  misc_feature (595)..(595): n is a, c, t, g, unknown, or other
  misc_feature (596)..(596): n is a, c, t, g, unknown, or other
  misc_feature (597)..(597): n is a, c, t, g, unknown, or other
  misc_feature (598)..(598): n is a, c, t, g, unknown, or other
  misc_feature (599)..(599): n is a, c, t, g, unknown, or other
  misc_feature (600)..(600): n is a, c, t, g, unknown, or other
  misc_feature (601)..(601): n is a, c, t, g, unknown, or other
  misc_feature (602)..(602): n is a, c, t, g, unknown, or other
  misc_feature (603)..(603): n is a, c, t, g, unknown, or other
  misc_feature (604)..(604): n is a, c, t, g, unknown, or other
  misc_feature (605)..(605): n is a, c, t, g, unknown, or other
  misc_feature (606)..(606): n is a, c, t, g, unknown, or other
  misc_feature (607)..(607): n is a, c, t, g, unknown, or other
  misc_feature (608)..(608): n is a, c, t, g, unknown, or other
  misc_feature (609)..(609): n is a, c, t, g, unknown, or other
  misc_feature (610)..(610): n is a, c, t, g, unknown, or other
  misc_feature (611)..(611): n is a, c, t, g, unknown, or other
  misc_feature (612)..(612): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
ncgattgggtaccgggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctaccggggggcgggacgggcgccagaggagtgggcgnnnnnnnnnnnnnnnnnnnnnnnnnnnnnnnnnnnnnnnnnnnnnnnnnnnnnnnnnnt

SEQ ID NO: 71869 - protein, 142 aa, Zea mays
  misc_feature: Ceres CLONE 1554183
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYRGAGRAPEEWA

SEQ ID NO: 71870 - DNA, 528 bp, Zea mays
  misc_feature: Ceres CLONE 1554184
  misc_feature: Encodes the peptide sequence at SEQ ID NO. 71871
  misc_feature (263)..(263): n is a, c, t, g, unknown, or other
  misc_feature (264)..(264): n is a, c, t, g, unknown, or other
  misc_feature (364)..(364): n is a, c, t, g, unknown, or other
cgattggggtccgggccccccctcgagccactgcagtggtaaagggctccccacctgctcgcctctcgcgcatcctaccaggagggtgggagacccaggcagcggaggtgtgcgaagctcgcttcgcaccacgcgctgcggcctgcggggcgagagatcgaggcctgagctagggtctggtggcggagatgtcgacgccggcgaggaagcgcctgatgcgggacttcaagcgccttcagcaggacccgcccgccggcatcagnncggcgcgcccgtacggacaacaatatcctgctctggacgccgtcatatccgggccgatgacacccctgggggatggaggcacgttccagctgactcgggnaatttttccagaaaattccccccaaaaaaccccccactggttggggtttgtttcccaggaattttttcctccccaaccttttttgcgggggggggaaaccttttttttttggggaaactcccctccaaaaacccccggggggggccccctctttttattgttgt

SEQ ID NO: 71871 - protein, 113 aa, Zea mays
  misc_feature: Ceres CLONE 1554184
  misc_feature: SWISSPROT Homolog: EC 6.3.2.19 Ubiquitin--protein ligase
  misc_feature (25)..(25): Xaa is any aa, unknown, or other
  misc_feature (26)..(26): Xaa is any aa, unknown, or other
  misc_feature (59)..(59): Xaa is any aa, unknown, or other
MSTPARKRLMRDFKRLQQDPPAGIXXARPYGQQYPALDAVISGPMTPLGDGGTFQLTRXIFPENSPQKTPHWLGFVSQEFFPPQPFLRGGETFFFWGNSPPKTPGGGPLFLLL

SEQ ID NO: 71872 - DNA, 628 bp, Zea mays
  misc_feature: Ceres CLONE 1554185
cgaattgggtaccgggccccccctcgagccctgcagtggtaaagggactgcatttccgtttactccggctcacgctcaccccgcctggtctctcattctcgacgatggctgaggcgaccgccgccgtcctacgccaggtatcccgcgcttcaaggacggcaggcccttccccggcgaagagcacccatcagattcccgagttgtttatcccagttatctagcacccgagggctccgtagcatcttattatgcttcaagacctgttctacctgttggatcagatgttcttagaaacgatgtaatttctcaaccgagaacgcatggttatgatggtccagcaagagtgaccaatcctgctttggctggcctgactggactacctgctggagttaccgcaaggaggcctactgctctggaagacccgtctttggctggtctgagtggattagctccagatccgggaaacaggactgagctacgggcacgaagggtctgggttgcttttggaaaaaccccgatctttgggctgggccctgaagtggaactaacctcccatccaggggcaactgggggaccctttaaggctttttgaaaaaaaaaaaacctgggtctggtagttttgggggaa

SEQ ID NO: 71873 - DNA, 676 bp, Zea mays
  misc_feature: Ceres CLONE 1554192
  misc_feature: Encodes the peptide sequence at SEQ ID NO. 71874
cgattgggtaccgggccccccctcgagccctgcagtggtaaaggggagagaggccgcaaccagagccgggggagagagccatgtgcaagctcagatgcaccaaggagtgggtgggttgctacctgctggtgatcctggccatcgtcctcctcgtcggcgtcctcttcggcctcggcgtcttcaggcacggctgcgacaggatcacggagatcggccgctaccacacctgcttcgactgcaacacatacaggtaccaactgaccgacccaccggccgtgccctgctcctgcctgcctcggtcgggatcggtgccagcgtgcatgttgatttgtacgcgtgtgtggtagctcctccgcgcacagtacgtgtgtgcaaactcctgtcacttggtttagagtgtagactacaggttcaactgattctatgatgaatatctctctcggaaaaaaataaaacacaacctcagctctggtaattcctgcaaccagggggatccactagttctagagctgccgccaccgcggaggagctccagctcctgctccgtgtagtgaaggcacattacgagcttggcgtactcgtggctctagctgtctcctggtctgaaattgtgatccgacctacatcgcacactacatactagcccgaaacttaaaaccgtaaagcccagcgatga

SEQ ID NO: 71874 - protein, 88 aa, Zea mays
  misc_feature: Ceres CLONE 1554192
MCKLRCTKEWVGCYLLVILAIVLLVGVLFGLGVFRHGCDRITEIGRYHTCFDCNTYRYQLTDPPAVPCSCLPRSGSVPACMLICTRVW

SEQ ID NO: 71875 - DNA, 571 bp, Zea mays
  misc_feature: Ceres CLONE 1554193
  misc_feature: Encodes the peptide sequence at SEQ ID NO. 71876
  misc_feature (278)..(278): n is a, c, t, g, unknown, or other
  misc_feature (337)..(337): n is a, c, t, g, unknown, or other
cgattgggtaccgggccccccctcgagccactgcagtggtaaaggcagatcagatcacactcgtagagagaaggaaaaatatccccaaaccctagctcccgatctcgatggcgaaccctcgcgtcttcttcgacatgaccgtcggcggcgccccggcgggccggatcgtgatggagctgtacgccaacgaggtgcccaagaccgcggaagacttcgcgcgctgtgcacggcgagaagggcgtggcagtccggaagcgctcactacagggctccacttncacgcgtcatcccgagttatgtgcaggggcgcaactcacccgcggaacgcacccggggnaagtcatctaggggcaaaattccccgacaaaaatttctggcccaagcaacgcttcccggggggtctccatgggcaaacccgggccaaaaccaaagggttccaatttttaatttggacccttgggaaccctttggttaaaggaaaaaactttttttttgcccagtttcttaaggggttgggcacccccaagggcccctaaaaaaggggggggccccccaaaggggctcccccccc

SEQ ID NO: 71876 - protein, 142 aa, Zea mays
  misc_feature: Ceres CLONE 1554193
  misc_feature (5)..(143): Pfam Name: Pro_isomerase Pfam Description: Cyclophilin type peptidyl-prolyl cis-trans isomerase/CLD
  misc_feature: SWISSPROT Homolog: EC 5.2.1.8 Peptidylprolyl isomerase
  misc_feature (57)..(57): Xaa is any aa, unknown, or other
  misc_feature (77)..(77): Xaa is any aa, unknown, or other
MANPRVFFDMTVGGAPAGRIVMELYANEVPKTAEDFARCARREGRGSPEALTTGLHXHASSRVMCRGATHPRNAPGXSHLGAKFPDKNFWPKQRFPGGLHGQTRAKTKGFQFLIWTLGNPLVKGKNFFFAQFLKGLGTPKGP

SEQ ID NO: 71877 - DNA, 650 bp, Zea mays
  misc_feature: Ceres CLONE 1554195
  misc_feature: Translation starting site: 53
  misc_feature: SWISSPROT Homolog: EC 1.11.1.6 Catalase
ccgattgggtaccgggcccccctcgagccctgcagtggtaaaggggagagtcatgtccaccggaattagccgcaaggaaaaaaaaactccgtctactctcaaattggggtgcgtagttggtcttgaagcttcgtgtgatcaccacaaacctgctcgggacctctacaagtggtgattggatcgactgggctgtgattgctcgctggtagttatctcgacgtcaccatccacatcgccgcgtggccagcgtcacgcaatcatcgattggaggagaagagcaggtggttcaggaagagccgcctaacacggaggagttcgatctgatctaggtggcgtttcccagtcgacattggcgccgacgatccttagttcgttttatctttattttgtaataagtcttccactatgtaataaatactctgattattgtgacatttatctctaaaaaaaaaaaaaaaaaccagatctctgggaattcctgcagcccgggggatccactagttctagagcggccgccaccgcggtggagctccagcttttgttccctgtagtgagggttaatttcgagcttggcgtaatcatggtcatagctgtttcctgtgtgaaattgttatccgctcacaattccacacaacatacgacccggaagc

SEQ ID NO: 71878 - DNA, 588 bp, Zea mays
  misc_feature: Ceres CLONE 1554207
  misc_feature: Encodes the peptide sequence at SEQ ID NO. 71879
agagagagagctttccgattgcgatcccatcaacggccgccggccgccgctggttttctttcttctcgcccaagccgcgccgccggcgcggtcccttgtaaaggcctcgccgcacgggagcggcctgcgctccctctctctggattagacaaagcatcctcctgtttggatcggcatggagaagacgacgacgacggcgcagccggtttgcgcgcaggagtcgctggcgctgctcaactgcgtcgcctcggccccctacgaccgggataggtgcctcgccctcgtcgacgccctccgtgaatgcatcgtgcgcaagagggtgaagaagttttcgctggcagaaccaaactccaccacaaccaccgaagctctgaagagcgatacgaagccctgagcattctgcaaagaaaattctcttatgtttcggaaactgtatcatctgattgggcgcggttgatgataagtctatgcctgttaatgtagcgttagatttgtacttttgaacccatgccagaaatcaccaatctgttgaactgaaaaaaaaaaaaaaaaaaccagagataatacgaaaaaaaaaaaaaaaaaacc

SEQ ID NO: 71879 - protein, 72 aa, Zea mays
  misc_feature: Ceres CLONE 1554207
MEKTTTTAQPVCAQESLALLNCVASAPYDRDRCLALVDALRECIVRKRVKKFSLAEPNSTTTTEALKSDTKP

SEQ ID NO: 71880 - DNA, 731 bp, Zea mays
  misc_feature: Ceres CLONE 1554212
  misc_feature: Encodes the peptide sequence at SEQ ID NO. 71881
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (329)..(329): n is a, c, t, g, unknown, or other
  misc_feature (533)..(533): n is a, c, t, g, unknown, or other
  misc_feature (583)..(583): n is a, c, t, g, unknown, or other
  misc_feature (584)..(584): n is a, c, t, g, unknown, or other
  misc_feature (653)..(653): n is a, c, t, g, unknown, or other
  misc_feature (654)..(654): n is a, c, t, g, unknown, or other
  misc_feature (681)..(681): n is a, c, t, g, unknown, or other
  misc_feature (682)..(682): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnggggnnnnnnccctattggggtacgggccccccctcgagccactgcagtggtaaaggggttcgcgtcgcagtgtcttccgcccgggctaccaccatgccgaagcagatccacgagatcaaggacttcctgctgactgcgcggcggaaggaaacgcacgggtcggtgcggatcaagcgggccaaggacgccgtcaaagtcaagtgcgctgctcccagtactctacaccctctgcgtccacgacngccgaacaaggccaacaaacttcaaagcaagtccccctccccgcccaagtcttaactgtcccggaaaattttaagggtttcaaaagcccccaaacctggggctttttttttgcgggggtcaagggaacctttttccccccaggggaaccctttaaatttgggaaagggggggggccccccccaatggggggggggtgttttttnaaaaaaaaatttttttaaaaaatttttttttttttttttggggggggaanncaaaaaaaaataattttttttcccacaaaccctttgaaccccccccggtgtttttttaaaaaaaggggnncccccccccccccaacaaaaaaaaaannaaaggggggggggggggggggggccttccctccctctttaaaaaaaaat

SEQ ID NO: 71881 - protein, 67 aa, Zea mays
  misc_feature: Ceres CLONE 1554212
  misc_feature (2)..(63): Pfam Name: Ribosomal_L38e Pfam Description: Ribosomal L38e protein family
  misc_feature (50)..(50): Xaa is any aa, unknown, or other
MPKQIHEIKDFLLTARRKETHGSVRIKRAKDAVKVKCAAPSTLHPLRPRXPNKANKLQSKSPSPPKS

SEQ ID NO: 71882 - DNA, 634 bp, Zea mays
  misc_feature: Ceres CLONE 1554213
  misc_feature: Encodes the peptide sequence at SEQ ID NO. 71883
  misc_feature (16)..(16): n is a, c, t, g, unknown, or other
  misc_feature (527)..(527): n is a, c, t, g, unknown, or other
  misc_feature (577)..(577): n is a, c, t, g, unknown, or other
acgattgggtactcgnacgcccccgagccctgcagtggtaaaggtgctctctcagaggtgggctggcttctcctccccctcttacaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacngaggcggtggcggctacggcgttggcgcgagggtggcggtggcggctacngcggcggtggcggcggcggctggagggactgatgtgtgggcccatcctggcttcggc

SEQ ID NO: 71883 - protein, 168 aa, Zea mays
  misc_feature: Ceres CLONE 1554213
  misc_feature (10)..(81): Pfam Name: RRM_1 Pfam Description: RNA recognition motif. (a.k.a. RRM, RBD, or RNP domain)
  misc_feature (48)..(142): Pfam Name: GRP Pfam Description: Glycine rich protein family
  misc_feature: SWISSPROT Homolog: EC 5.2.1.8 Peptidylprolyl isomerase
  misc_feature (133)..(133): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGGYGGGRRDGGYGGGGGYGGRREGGGGGYXGGGGYGVGARVAVAATAAVAAAAGGTDVWAHPGFG

SEQ ID NO: 71884 - DNA, 633 bp, Zea mays
  misc_feature: Ceres CLONE 1554214
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (166)..(166): n is a, c, t, g, unknown, or other
  misc_feature (515)..(515): n is a, c, t, g, unknown, or other
ttttttttttttttnnnnccggcattattttttttagtattgaaggctctgattgaattttattataactttggnnnngcaattggtactggcccccctcgagccctgcagggtaaagccgccccgcctcccggcgctccggcgcctctccctccccgacaaccgncctctcgggggccgccgccctcgccgccgtcgccgaggcatgcggcgccacgctgcgccacctcgacctagggaacaaccggttcgcggaggtccaggaagctcgccgcccaattcgccggggtccgggtcgagtcgctcgaccttgtttcccattgccccccgtcacccaaagggtcaaaagggggtacaggggaattaaaggtctttccccggctttaatttcccccaaagccctttcaaaggtaccccttccgaattggggcgcttttaacccctttaaaaggggccaaaacgaaaggccttttttttgggaaaaaaccgggaatttgaaaacaaaaccaaaaccncacaaagggaaggggaaaggaccaaaccaaggaagggaaaaaaaaaaagggccccggaaaagggaaaaggaaaggattggggcgcccaaaattaaagggaaatttgaaaattggggaa

SEQ ID NO: 71885 - DNA, 747 bp, Zea mays
  misc_feature: Ceres CLONE 1554219
  misc_feature: Encodes the peptide sequence at SEQ ID NO. 71886
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnntttttttttttgctattgggtacgggtccccccctctagccactgcagtggtaaaggcttggcccggctgtctccactccacgctgcccacaatcccctttcccctccagtaggtagagtggcgagaaggatggtggccgtgtccacggcgacgatggcgagctcgctgctcctccgggcgcgcgcgctcctgccaccccatccgattcctagctccagccaccggccattgccagctccgcatgtacaactacaggggagcatccaggagaagccgggccttccggcgaaaagcgacggcgagcggaggcggccggctgggacgcagctctactcactggcgccctaccctctgctgctggccgcgctgctgccgggagctgagccggtgacggccgtgttcgcgccgttcgtggagctggtgaagacgtgggacctccccggctggctcgtgcactggggccacccgggtaacatggctgtggtgctcttcgcaatgggtggttacgggacatacctgggcttcaggatcaaactatcacacaaccttggaagagaaggccaaggccaaagatctccacccagaaactcctctgccgggcatgttcattatttcttcgccctggggcgcgaaccggtggtgatcacagacgtcttctcacc

SEQ ID NO: 71886 - protein, 177 aa, Zea mays
  misc_feature: Ceres CLONE 1554219
MVAVSTATMASSLLLRARALLPPHPIPSSSHRPLPAPHVQLQGSIQEKPGLPAKSDGERRRPAGTQLYSLAPYPLLLAALLPGAEPVTAVFAPFVELVKTWDLPGWLVHWGHPGNMAVVLFAMGGYGTYLGFRIKLSHNLGREGQGQRSPPRNSSAGHVHYFFALGREPVVITDVFS

SEQ ID NO: 71887 - DNA, 608 bp, Zea mays
  misc_feature: Ceres CLONE 1554229
  misc_feature: Translation starting site: 142
ggagctccccgcggtggcggccgctctagaactagtggatcccccgggctgcaggaattcgtctcacccctagaaaaagtgctatccccgcccattcgtcaccagccaggtcccggaaccttatcaccaaatcctcacgtcatggcggccgcgctcttctccacctcgctctcgccccgcttcctcgccctatcctccccgaagccggccgcgcccgcggcctcggccttcctccccttcacgctgccgctgcgctctgtgtcggcgccggcgccagcgaggcgggtcttcgagcccgttgccgtcgcggtgtcgtcggagtacgggaccgagggcgcggagcagcaggacggggagttctccgaggacctcaagctgttcgtcggtacctgccgttcaccgtcacagtgcgcagctgggcgggctcttcgagcaggcgggctccgtcgaaatggtcaaggttgtatacaataaaatgactgggccggacccgtgaatttggattcctgaaaatggcttccaccttgaaaaaaccgggggctgcttgtcaaacaatttcaccggtttaaacattttccaagggaaaaacctcttgaagggggaaaact

SEQ ID NO: 71888 - DNA, 591 bp, Zea mays
  misc_feature: Ceres CLONE 1554230
  misc_feature (210)..(210): n is a, c, t, g, unknown, or other
  misc_feature (211)..(211): n is a, c, t, g, unknown, or other
  misc_feature (280)..(280): n is a, c, t, g, unknown, or other
  misc_feature (299)..(299): n is a, c, t, g, unknown, or other
  misc_feature (329)..(329): n is a, c, t, g, unknown, or other
  misc_feature (384)..(384): n is a, c, t, g, unknown, or other
  misc_feature (424)..(424): n is a, c, t, g, unknown, or other
ccccgcggtggcggccgctctagaactagtggatcccccgggctgcaggaattcgtctcacccctagaaaaagctggtgagcaccgcaagcaccaactcgcgcccaccgctccgctacaccagccgacgccatcatgtctaccgtcgccgccgcccccaccgtcgtgaaatcggctccggagctcgtcgcgccagtggggccaacacccnnggcggcaccctcccactgtcctccatcgacaagaccgcggcggtgcgtgtgtcggtggatttcatccangtttttcccccggccgtangagcaggcggggacaaagacgccgctcgtnccgctgatgcgcgaacgggcttcgcgaaggcactggtgccgtactacccggtggncgggcgcatcgcgaacgccagccccgggggagcccgtggntggagtgcaccgggcaggggcgtctggttcgtgggaagccgctgcaagctgggcgcctccccacctcaactaacttcgagcgccctttggctcatccccaagggaaggaggtccttccgggaacttccccccgaggaaaaacttcgagggactccttcctcatgggt

SEQ ID NO: 71889 - DNA, 707 bp, Zea mays
  misc_feature: Ceres CLONE 1554231
  misc_feature: Encodes the peptide sequence at SEQ ID NO. 71890
  misc_feature (707)..(707): n is a, c, t, g, unknown, or other
agcggtggcggccgctctataactagtggatcccccgggctgcaggaattcgtctcacccctagaaaaagccacgagtcgccgacactccatcccggaagagctaacgaggtgactccccaccgcgcccatgggtgacagccagtactccttctccctcaccaccttcagtccgtcggggaagctcgtgcagattgagcacgcgctcacggctgtcggatccgggcagacctcgctcgggatcaaagctgccaatggtgtagtcattgctactgagaagaagctgccttctattttagtggatgaaaaatctgtgcaaaagattttgggactaacaccctaatattggagttgtccacactgggatgggtgcagatttccgaggccctggccgacaaaaaatttaaaagcaggcacaaacaatattattcgctttggtccaaggaacaatataacatggaaacacataccttgttacgacaaaactggttgtcggccattgccggggaattccaaaaaggtccacggtggaggtgagaaaccaattttggaagaaattacactagtttgaattgacaggcgctcaggaagacacactgaggccccgcaatcttgcgatctaccggttgtgattacctttcgcgtaacccatgcctttttccactgatacaggacaatactccctcgtgcgcgacaccaaataagacn

SEQ ID NO: 71890 - protein, 70 aa, Zea mays
  misc_feature: Ceres CLONE 1554231
  misc_feature: SWISSPROT Homolog: EC 3.4.25.1 Proteasome endopeptidase complex
MGDSQYSFSLTTFSPSGKLVQIEHALTAVGSGQTSLGIKAANGVVIATEKKLPSILVDEKSVQKILGLTP

SEQ ID NO: 71891 - DNA, 701 bp, Zea mays
  misc_feature: Ceres CLONE 1554235
tggcggccgctctagaactagtggatcccccgggctgcaggaattcgtctcacccctagaaaaaaaaacataataagcaaatagtctcttcacgtgattgccaaaattagtcaagacgggtgctctttgctgcgtggccgctaggccacatgggacgaagtctgaccctgcaagcagagatcgttctatggatcctactgagcctcgttggcgcataaactcgagcttctctcccccaacatcaaggagatgggactgtcgttattcatcacatggattgccccacagagttcatgatgctcctcatgatcacccaccttatgtttcatcattgtcatctcttatccacccccccccgagggggggtggggcagggaatcactacctccaatcaccatcattcttttgtctgagggaacacctttcttcatttggggagtccaggctgacagcctttagggaccccagctgggacgcccttctctttcaaaaatttgaaccttggtgaaaatcctcacacccttggcaggaggattcaaagccccgaaaacttactgactaatccccccagccaaagggaaaggcccccctgaactggccatctcaccaattttcaccttttcgcccctccccctatttttccacaaccccagacccgctttagctacccattcatcgccaaacacacctttacgcccata

SEQ ID NO: 71892 - DNA, 633 bp, Zea mays
  misc_feature: Ceres CLONE 1554238
  misc_feature: Encodes the peptide sequence at SEQ ID NO. 71893
  misc_feature (633)..(633): n is a, c, t, g, unknown, or other
cgcggtggcggccgctctagaactagtggatcccccgggctgcaggaattcgtctcacccctagaaaaaaaatctcttgctactccgctttctagctacacccttcctcttccttataaaatacgcaagagtgcagctgcgcagccgccgtcgcgcagccagccatggccatcaaagatgagccgctgcacatcctcttcttcccgttcctcgcgccggggcacctcatcccgatcgccgacatggccgcgctcttcgctgcccgaggcgtcaggtgcaccatcctcaccacaccggtgaacgcccaactcatccgctcggcggtagaccgcgccaacgacgcctcccgcggaatcgagggcgccctggccatcgaaatcgcggtcgtgcctttccccgacgtcggcctgccccccggcgtcgagtgcgccccggcgcttaacaccatggacgaccgcaaaaagttcttccacggggcccagttactccgcgagccgttcgaccggttcttggcggaaaacgcccggatgcccgccgtgaccaacagctttcttcaacgggtccccccgaaaccgcccgcggagaacgggggccccgcggaatagcgttcccccggcaccagctttgttctcn

SEQ ID NO: 71893 - protein, 146 aa, Zea mays
  misc_feature: Ceres CLONE 1554238
  misc_feature: SWISSPROT Homolog: EC 2.4.1.238 Anthocyanin 3'-O-beta-glucosyltransferase
MAIKDEPLHILFFPFLAPGHLIPIADMAALFAARGVRCTILTTPVNAQLIRSAVDRANDASRGIEGALAIEIAVVPFPDVGLPPGVECAPALNTMDDRKKFFHGAQLLREPFDRFLAENARMPAVTNSFLQRVPPKPPAENGGPAE

SEQ ID NO: 71894 - DNA, 889 bp, Zea mays
  misc_feature: Ceres CLONE 1554241
  misc_feature: Encodes the peptide sequence at SEQ ID NO. 71895
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
gttttttattattattgggttattataattaaaaaannnnnaaaaaaaaaannnttcgcgtaagagtcaccagagcggcggccgctctagaactagtggatcccccgggctgcaggaattcgtctcacccctagaaaaaatgccagcctccccttcgcttcgcttagctcgccgtcaccatggcgacctccaccttctctccgcgccccgtcaacctcaagcccctgcggggacgcgccaagcccgccggcctccagctccacatcccccccttaacgcgcctccgcgttgcctgcgccatcgccgccggagaggggccgcccgttaaataaccggccccaagtgcaagccgggctaccgccacgtcatcccaaagggaaatgccgatccgggctggaaagcgagcccgatgagaaaacatctcactttccctccccccccccacccggggcgggggggggggggggccccgcccccacggcccagaccccccaaaaaataaaggaagtgcaataaaaaaccccgactatgggccactaccctcaacctccttgataggctttcacccacaacaccccctaatatccgtccccatacccgcgcgccgccaaccccccgcgaattacaaccactttttgctcgccctccctactaccattctgcaacaagaggcaccaccgaaacgcccataacaccctacacgtaaagctcccccactctcacttagacgccgcacgacgccgaactctcaccctccacggacactccctaccacactcttcacaccgccgcccccccgagcacccgataatactaaatcgcgtactcccgcaacatcctacctgctccacacccaccacctaatgtctcacaccccacagtcacgtgc

SEQ ID NO: 71895 - protein, 50 aa, Zea mays
  misc_feature: Ceres CLONE 1554241
MATSTFSPRPVNLKPLRGRAKPAGLQLHIPPLTRLRVACAIAAGEGPPVK

SEQ ID NO: 71896 - DNA, 665 bp, Zea mays
  misc_feature: Ceres CLONE 1554247
  misc_feature: Encodes the peptide sequence at SEQ ID NO. 71897
ggagctccccgcggtggcggccgctctatactagtggatcccccgggctgcaggaattcgtctcacccctagaaaaaagccgctagtaccagtagtcgtcgcgttagcaggcagatctgagttagccggcggatccgatccgtgcgcgtgcagtgtacgtgtgtcggtggagatggccacagcttacgctcccatggcgagccaggtgatgaagagcagcctcgtcgtgcactcgaggccgaggggcctgtcaggcgctgctgcgctcacgaggcggccgcggttcaccgtcaaggccatccagcccgagaaggcaacgtaccaggtggtgcagcccatcaacggcgaccccttcatcggcagcctggagacgccggtcacctccagcccgctcgtcgcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgcttggggccgccggcctcgtcgccatcctcagcggcttgctcaccatggtacggggtctcctcctttcacaaggggggaccccttccatgggcgccctcgattaaagtttaa

SEQ ID NO: 71897 - protein, 154 aa, Zea mays
  misc_feature: Ceres CLONE 1554247
  misc_feature (43)..(145): Pfam Name: PsaL Pfam Description: Photosystem I reaction centre subunit XI
MASQVMKSSLVVHSRPRGLSGAAALTRRPRFTVKAIQPEKATYQVVQPINGDPFIGSLETPVTSSPLVAWYLSNLPAYRTAVSPLLRGVEVGLAHGYLLVGPFALTGPLRSTPVHGQAGALGAAGLVAILSGLLTMVRGLLLSQGGTPSMGALD

SEQ ID NO: 71898 - DNA, 836 bp, Zea mays
  misc_feature: Ceres CLONE 1554250
  misc_feature: Encodes the peptide sequence at SEQ ID NO. 71899
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (465)..(465): n is a, c, t, g, unknown, or other
  misc_feature (476)..(476): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (495)..(495): n is a, c, t, g, unknown, or other
  misc_feature (500)..(500): n is a, c, t, g, unknown, or other
  misc_feature (504)..(504): n is a, c, t, g, unknown, or other
  misc_feature (515)..(515): n is a, c, t, g, unknown, or other
  misc_feature (516)..(516): n is a, c, t, g, unknown, or other
  misc_feature (527)..(527): n is a, c, t, g, unknown, or other
  misc_feature (546)..(546): n is a, c, t, g, unknown, or other
  misc_feature (556)..(556): n is a, c, t, g, unknown, or other
  misc_feature (561)..(561): n is a, c, t, g, unknown, or other
  misc_feature (580)..(580): n is a, c, t, g, unknown, or other
  misc_feature (613)..(613): n is a, c, t, g, unknown, or other
  misc_feature (627)..(627): n is a, c, t, g, unknown, or other
  misc_feature (647)..(647): n is a, c, t, g, unknown, or other
  misc_feature (655)..(655): n is a, c, t, g, unknown, or other
  misc_feature (663)..(663): n is a, c, t, g, unknown, or other
  misc_feature (687)..(687): n is a, c, t, g, unknown, or other
  misc_feature (694)..(694): n is a, c, t, g, unknown, or other
  misc_feature (699)..(699): n is a, c, t, g, unknown, or other
  misc_feature (727)..(727): n is a, c, t, g, unknown, or other
  misc_feature (735)..(735): n is a, c, t, g, unknown, or other
  misc_feature (785)..(785): n is a, c, t, g, unknown, or other
ccgtgttggggggttgtggggtttgttttataaactttgcannnggggggnnnnnnaaaattggactccacgggggggcggccgctcttttcccccgcatcccccgggctgcaggaattcctctcacccctagaaaaagtgctttcttagaggtgggttggcttctcctccccctccggttcgggttcgggttcgtgaggttctccggggttcggtttcctgggtgagcggatcgagatggcggcgtcggatgttgagtaccgctgctttgtcgggggcctcgcctgggccccggaagaacactccctccacaacgcctttcacacctacggggaggtcctcgagtccaagaatatcctccaattgggaaaagcataaggtcccgcggattttgggtttcggtgaactttttccacggaattattttaatcccccaatcggcggggggggggggggggaaccggnaaggggagctngcacccccccccccnnnanttggnggtnaaaagtaaggnnataaggttccngtcgtatgagcgtgagggnaagggcaacnccganagggtgggggaaattcagnactttagtatctggggggaatagtggttggggnttaaaaaaacaacncagccctgttggggcacttntataaatntccatgtncgtacgcataatccagagtgtttnaaatagnagagnggcggaaaaaccgtgaacgataataatntcgagaanattctcttccgtcgctggcggacgcggtgctactgttcgcctcccgtatngtagcgtagttctaatggctgtgacagatctgtcgtactttgattataagc

SEQ ID NO: 71899 - protein, 46 aa, Zea mays
  misc_feature: Ceres CLONE 1554250
MAASDVEYRCFVGGLAWAPEEHSLHNAFHTYGEVLESKNILQLGKA

SEQ ID NO: 71900 - DNA, 801 bp, Zea mays
  misc_feature: Ceres CLONE 1554252
  misc_feature: Encodes the peptide sequence at SEQ ID NO. 71901
  misc_feature (20)..(20): n is a, c, t, g, unknown, or other
  misc_feature (32)..(32): n is a, c, t, g, unknown, or other
  misc_feature (33)..(33): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (452)..(452): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (474)..(474): n is a, c, t, g, unknown, or other
  misc_feature (475)..(475): n is a, c, t, g, unknown, or other
ttttttatctccctctccanctcctttatttnntttnnnnnnnnnnaaacgaannnnnnnactaaagaatacaaaaaagcggtggggggaggttttttactaatggataccccgggctgcaggaattcgtctcacccctagaaaaagcgccgccacttccctcccgacccactcggccaaaaccgtagcgccctcgcctgctcgccgccgccgtcgttgcgagctccccatcttcctccgttaaccatggcgacccagatcagcaagaagaagaagttcgtcagcgacggcgtgttctacgccgagctcaatgagatgctgacgcgggagctcgcggaggacggctactccggcggggaggtgggtgtcacaccgatgcgcatgtaaatcatcatcccgggaaaggcgcacagcaaaatttttttttccccccccacgggggggggaaagcnagaggggcttcnnnttcctttnntcccaacaaaaaggttttaaatttccccccaaaaaaaggacgaccaaagcttcttccgcgggaagaagggtcctccccaccttctccgacccccctgggttctcactccctccgcaagggcggaaaaatcccttcccgggttaaaaacacttccccaacaaaagccccctagtcgcaccccgttaagacccctgcccaatgcggaggccccatcccacccccgaaacatagaacaaaaaggcactccccatcaccgcttctccaatgccacatatccgcccgcggcgaaaaaaaccaccatgctttcttaaagaccccctagtata

SEQ ID NO: 71901 - protein, 46 aa, Zea mays
  misc_feature: Ceres CLONE 1554252
MATQISKKKKFVSDGVFYAELNEMLTRELAEDGYSGGEVGVTPMRM

SEQ ID NO: 71902 - DNA, 632 bp, Zea mays
  misc_feature: Ceres CLONE 1554257
  misc_feature: Encodes the peptide sequence at SEQ ID NO. 71903
  misc_feature (232)..(232): n is a, c, t, g, unknown, or other
  misc_feature (351)..(351): n is a, c, t, g, unknown, or other
  misc_feature (356)..(356): n is a, c, t, g, unknown, or other
  misc_feature (366)..(366): n is a, c, t, g, unknown, or other
  misc_feature (367)..(367): n is a, c, t, g, unknown, or other
  misc_feature (368)..(368): n is a, c, t, g, unknown, or other
  misc_feature (369)..(369): n is a, c, t, g, unknown, or other
  misc_feature (514)..(514): n is a, c, t, g, unknown, or other
  misc_feature (591)..(591): n is a, c, t, g, unknown, or other
aatggatcccccgggctgcaggaattcctctcacccctaagaaaaaaaatcaaaaaccccgaaggttcggactgaatgaagcgaaagcccaaatccccttccccttccccctcttcgtctccgtcggcggcgtcggaccgaacccgatcccgcagccctaactaaccctaggaggcaggcggcggcggggatggtgtactacgcgctgttggtgggcgcggaactggatggnctccccaactgcatttctcccacggatgcggagacccccgcttcccctattattttcagtcaagtgcgagaactgcggggaggtttttttttccccacccagggggaaagaaaagaggnttttnaccttccctnnnnaaacttccccctatcaacaaaaaaacaaaaaattcaaacttttgggtggagagatcgaacccctctttgatgaaccctcctggggccgggagcccccccctctctttttgtggccgaacccccaaaacggccaaacaacttgttntcctcggtttccttatatctttaaaacactcacccccccggctacctctttttttttggttgtcagccctttaagancgccctaatatctgggctgcgcgcgcccccttccctatacg

SEQ ID NO: 71903 - protein, 82 aa, Zea mays
  misc_feature: Ceres CLONE 1554257
  misc_feature (54)..(54): Xaa is any aa, unknown, or other
  misc_feature (56)..(56): Xaa is any aa, unknown, or other
  misc_feature (59)..(59): Xaa is any aa, unknown, or other
  misc_feature (60)..(60): Xaa is any aa, unknown, or other
MVYYALLVGAELDGLPNCISPTDAETPASPIIFSQVRELRGGFFFPTQGERKEXFXLPXXNFPLSTKKQKIQTFGWRDRTPL

SEQ ID NO: 71904 - DNA, 736 bp, Zea mays
  misc_feature: Ceres CLONE 1554258
  misc_feature: Encodes the peptide sequence at SEQ ID NO. 71905
  misc_feature (395)..(395): n is a, c, t, g, unknown, or other
ggtggcggccgctctagaactagtggatcccccgggctgcaggaattcgtctcacccctagaaaaaaaaaaaaaaaagccgcctcctccccactgcctcgtgtggccgtcgtctcccgttcggaacgccaagccccccctccggcgaaatggcccccaagcgaggtggcagggcgccggtgccggccaagaagaagacggataaagtgacgaaccctctattcgagaagaggccgaagcagttcggcatcggcggcgcgttgccgcccaagaaggacctggagcggggtcgtcaagtggccccagggtctttgtttattccggggggagcgctcgcatccttcaggaggtttttccccgccccccccacgggggggggggggggggggggcccgncgccccctcgaagaaggaatctcggggtgggaaagtgggttaaaaaaggctttctcggggttagcgggcggtgggggagaagggcttgccccaggaagggagaaggcgtttctttaaaaaggggcccggatccttcacggagggaaggggggaagaagggggtgggggtcagaaaaaaacccgcgtgtgtgcggagaaatacagcgggttaagcccgggtggccctggcccgtgcggtcagagacgaaagcgagaggggcagggtgtgggtggggggtgcgttaagaggcagggtgggcccgctctgaagtctgggaggggggtgttgtccccgcgtggtt

SEQ ID NO: 71905 - protein, 152 aa, Zea mays
  misc_feature: Ceres CLONE 1554258
  misc_feature (83)..(83): Xaa is any aa, unknown, or other
MAPKRGGRAPVPAKKKTDKVTNPLFEKRPKQFGIGGALPPKKDLERGRQVAPGSLFIPGGALASFRRFFPAPPTGGGGGGGPXPPRRRNLGVGKWVKKGFLGVSGRWGRRACPRKGEGVSLKRGPDPSRREGGKKGVGVRKKPACVRRNTAG

SEQ ID NO: 71906 - DNA, 867 bp, Zea mays
  misc_feature: Ceres CLONE 1554262
  misc_feature (20)..(20): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (451)..(451): n is a, c, t, g, unknown, or other
tttttttttcgcttcttaanatttttnnnnnnnnttcgcgtcnnnncgccccccgactcccccccggggggggcgctctttaataatggattccccgggctgcaggaattcttctcacccctagaaaaaatccccagtcccgcggcggccgcattgcccgccgccgcaccgtgtcttgctaggactaggaccccctgtttgggctcttgcggtgcgattcctgggtcgtctgcaaggagtgtggccgaccgagggggccaaaatgtgggcggaaaaagtggtcggcaaacctcctattccgcaaattccccccttctcccggaaagcctttttccccccggggcgggggtctccctcatcgtatttgttttttttcagcacccaccgcctctcggagagattattgtttttttttttcccccccccccccggggaaaagaaaggggggatntcttcttctcccccccctttttttttttttttttcccattatcaataaaaaaaattacatcccctctcttccctccctccgggacccccgcagcattcataacacctctattactttttcccaatcgcttggatcttcttctttacgccgccgtcttacttcctcaaaactacacgcaccccacccgctcaaacctgtgccttaatctccatcttccgatctcctccttctcagtttcgacgccccgattaaaccagcatgtccatctcattatggcaccctaatcataaaacctgtttaccaccacggcccgtgccccggaatatatccacccataacactcatctccatgtaccaacgagcggcgcatattccccgctctccgttcttgtttctccctctcacgtccattaata

SEQ ID NO: 71907 - DNA, 605 bp, Zea mays
  misc_feature: Ceres CLONE 1554277
  misc_feature: Encodes the peptide sequence at SEQ ID NO. 71908
  misc_feature (120)..(120): n is a, c, t, g, unknown, or other
  misc_feature (132)..(132): n is a, c, t, g, unknown, or other
  misc_feature (133)..(133): n is a, c, t, g, unknown, or other
  misc_feature (423)..(423): n is a, c, t, g, unknown, or other
  misc_feature (426)..(426): n is a, c, t, g, unknown, or other
  misc_feature (429)..(429): n is a, c, t, g, unknown, or other
  misc_feature (438)..(438): n is a, c, t, g, unknown, or other
  misc_feature (456)..(456): n is a, c, t, g, unknown, or other
  misc_feature (468)..(468): n is a, c, t, g, unknown, or other
  misc_feature (471)..(471): n is a, c, t, g, unknown, or other
  misc_feature (496)..(496): n is a, c, t, g, unknown, or other
  misc_feature (549)..(549): n is a, c, t, g, unknown, or other
  misc_feature (574)..(574): n is a, c, t, g, unknown, or other
cgattgggtaccgggccccccctcgagccctgcagtggtaaaggggctctctcagaggtgggctggcttctcctccccctcttaccaagtcctcttcgggttagggttacttagggtttntgtggaggggcnngatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtgggcgcggtggctacngcngcngtcgcggcngcggcggctatggtggcnggcgccgtgacngcngttatgggcggcgtggccgctaccngcgtccgccccaaggttggtggcgccgctaccgaagcggtggcggctaccgcngtcgggcccaaggttggggttggcngctaccgcggccgccgccgcgcctggaggga

SEQ ID NO: 71908 - protein, 157 aa, Zea mays
  misc_feature: Ceres CLONE 1554277
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (97)..(97): Xaa is any aa, unknown, or other
  misc_feature (98)..(98): Xaa is any aa, unknown, or other
  misc_feature (99)..(99): Xaa is any aa, unknown, or other
  misc_feature (102)..(102): Xaa is any aa, unknown, or other
  misc_feature (108)..(108): Xaa is any aa, unknown, or other
  misc_feature (112)..(112): Xaa is any aa, unknown, or other
  misc_feature (113)..(113): Xaa is any aa, unknown, or other
  misc_feature (121)..(121): Xaa is any aa, unknown, or other
  misc_feature (139)..(139): Xaa is any aa, unknown, or other
  misc_feature (147)..(147): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGRGGYXXXRGXGGYGGXRRDXXYGRRGRYXRPPQGWWRRYRSGGGYRXRAQGWGWXLPRPPPRLEG

SEQ ID NO: 71909 - DNA, 517 bp, Zea mays
  misc_feature: Ceres CLONE 1554287
  misc_feature: Encodes the peptide sequence at SEQ ID NO. 71910
  misc_feature (269)..(269): n is a, c, t, g, unknown, or other
cgattgggtaccgggcccccctcgagccactgcagtggtaagggtgctctctcgaggtgggctggcttctcctccccctcttaccaagtcctcctcgggttagggttccttagggttttgtggaggggcgatggcggcggctgatgtggagtaccgttgcttcgtcggcgggcttgcctggccacagcacgagtcgctggagatgcttcgctctacgcgagatctcgactccaggtcatcacgaccggagacggggagtcccgcgcttncgctcgtacctctcctccgagaactcatgctcgacgctatcgaagacctgaaccggaaagaacctcgacggccgtaccattcccgttaccaggcccaaccccttggcggtggcggtgcccccggggtttacgggggggtcccgggggcggcgccgttttgggggcgggcccccttaccgcgtttttgggggcggggggggttctcggggttccgccccaaaggggggcgggggcgtcccgagaggggg

SEQ ID NO: 71910 - protein, 129 aa, Zea mays
  misc_feature: Ceres CLONE 1554287
  misc_feature (47)..(47): Xaa is any aa, unknown, or other
MAAADVEYRCFVGGLAWPQHESLEMLRSTRDLDSRSSRPETGSPALXLVPLLRELMLDAIEDLNRKEPRRPYHSRYQAQPLGGGGAPGVYGGVPGAAPFWGRAPLPRFWGRGGFSGFRPKGGRGRPERG

SEQ ID NO: 71911 - DNA, 690 bp, Zea mays
  misc_feature: Ceres CLONE 1554288
  misc_feature: Encodes the peptide sequence at SEQ ID NO. 71912
cgattgggtaccgggctctccctcgagccactgcagtggtaaaggtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggccgtggcggcggtggctacgggggcggtcgcggcgggcggcgggggttatgggggggggcgcccgggccggggttatgggggggggggccggctacgggggggcggcggcaaggggggcggtggcagctaccgaggggggggggcgggttcgggcggcccggcggcggggggggggggtgggctgttaccgtcgcgtggtctgtcgtccttttcctttgtgaggtgactctaagaacttgggaccccattccttggcgtttccagcccagaattctccttttatccctg

SEQ ID NO: 71912 - protein, 186 aa, Zea mays
  misc_feature: Ceres CLONE 1554288
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGRGGGGYGGGRGGRRGLWGGAPGPGLWGGGPATGGRRQGGRWQLPRGGGGFGRPGGGGGGWAVTVAWSVVLFLCEVTLRTWDPIPWRFQPRILLLSL

SEQ ID NO: 71913 - DNA, 627 bp, Zea mays
  misc_feature: Ceres CLONE 1554296
  misc_feature: Encodes the peptide sequence at SEQ ID NO. 71914
caattgggtacggggcccccctcgagccctgcagtggtaaaggctattcgtgtcctggcatccgcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccggaaccgtggcgctgcgcgagatccgcaagtaccagaagagcacggagctgctgatccgcaagctgcccttccagcgcctggtgcgcgagatcgcgcaggacttcaagacagacctccggttccagagccacgccgtgctggcgctccaggaggccgccgaggcctacctcgtcggtctcttcgaggacaccaacctctgcgccatccacgctaagcgcgtcaccatcatgcccaaggacatccagctcgcccgccgcatccgtggcgagcgcgcgtagccatcatctcccggggatctggatgaatggctagttacccaaacaaatagggcttgtatttaccgtccgtttggttc

SEQ ID NO: 71914 - protein, 136 aa, Zea mays; identical to SEQ ID NO: 35188
  misc_feature: Ceres CLONE 1554296
  misc_feature (58)..(132): Pfam Name: Histone Pfam Description: Core histone H2A/H2B/H3/H4

SEQ ID NO: 71915 - DNA, 750 bp, Zea mays
  misc_feature: Ceres CLONE 1554298
  misc_feature: Encodes the peptide sequence at SEQ ID NO. 71916
  misc_feature (601)..(601): n is a, c, t, g, unknown, or other
  misc_feature (603)..(603): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (668)..(668): n is a, c, t, g, unknown, or other
  misc_feature (669)..(669): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
  misc_feature (676)..(676): n is a, c, t, g, unknown, or other
  misc_feature (683)..(683): n is a, c, t, g, unknown, or other
  misc_feature (684)..(684): n is a, c, t, g, unknown, or other
  misc_feature (685)..(685): n is a, c, t, g, unknown, or other
  misc_feature (686)..(686): n is a, c, t, g, unknown, or other
  misc_feature (689)..(689): n is a, c, t, g, unknown, or other
  misc_feature (690)..(690): n is a, c, t, g, unknown, or other
  misc_feature (692)..(692): n is a, c, t, g, unknown, or other
  misc_feature (693)..(693): n is a, c, t, g, unknown, or other
  misc_feature (694)..(694): n is a, c, t, g, unknown, or other
  misc_feature (695)..(695): n is a, c, t, g, unknown, or other
  misc_feature (696)..(696): n is a, c, t, g, unknown, or other
  misc_feature (697)..(697): n is a, c, t, g, unknown, or other
  misc_feature (698)..(698): n is a, c, t, g, unknown, or other
  misc_feature (699)..(699): n is a, c, t, g, unknown, or other
  misc_feature (700)..(700): n is a, c, t, g, unknown, or other
  misc_feature (701)..(701): n is a, c, t, g, unknown, or other
  misc_feature (702)..(702): n is a, c, t, g, unknown, or other
  misc_feature (709)..(709): n is a, c, t, g, unknown, or other
  misc_feature (710)..(710): n is a, c, t, g, unknown, or other
aaattaacgccgcctaaccaccctctaaaaacaaaaaaataaataataatatggaaataaatatttatggtttttcgattggtccggccccctcaaccatcttggtaaggggagggatgactctaagaaatttcttcgaccccatccacttctcacctcaatctcgcgagaagcgaagccggaggaggagggtgcgaggagatcgcgagcagccggagccggagccggagccggaggcctagtagatgaagacgttcgatccgtggccggtcttcttccgccgggagtggaagcgcaattggccctttcctcacggggtttcgccattcaccgggcttccatcattcacttaaaaattgaacggggcccaaacttttccacccgaagggaaaggaacccctcaaaaaaaaactccccaaagttttccctccccccccgggggaacccccccccaaccaaaaaaagggccttttttaaacccccaaaacccagggggggggtgtttttttctccccccaaaaaatttttgtgcccccccccttgttttttttggggggagaaaaaaaaaagccccccaacaaattttttttttttttttttntnaaaaaaaacccccccnnngattttttttttttgaggggctcctttctgaaaaaaaaaaaaaaaannctgnnnngcggttnnnntgnnannnnnnnnnnnggggggnngggggttgttgttgtttttttcccaaaagacaaaaaaagc

SEQ ID NO: 71916 - protein, 63 aa, Zea mays
  misc_feature: Ceres CLONE 1554298
MEINIYGFSIGPAPSTILVRGGMTLRNFFDPIHFSPQSREKRSRRRRVRGDREQPEPEPEPEA

SEQ ID NO: 71917 - DNA, 636 bp, Zea mays
  misc_feature: Ceres CLONE 1554303
cgattgggtccgggcccccctcgagccctgcagtggtaaaggcgagggttctcttctacccgacactgctgtacaacgtggtgcggagcaaggtccaggccgagttccggtggtgggacgaggtcgatccgttcgttttgctcggagcggttccattccgcagcgatgtaacacgcttacagaagcttgggatatgtggtgtgataaccttaaatgaaccatttgagactttggtaccatcatctatgtataaggcaagtgacattcacgtgggatcgatcaccttgttattcctacaagagattatatgtttgctccttcacttgtggatattaatcaagctactgatttcattcatagaaatgcgtcttgtgggaaaataacatatattcactgcaaagctggaaggggccggagtacaacagtcgtcttgtgctatctggtcaaatacaagaatatgacacctgctgcagctttcgagcatgtacggtctaaaagggctcgagtgctgttgacacattcgcaatggaaggctgttcaagaattcagcaagaagaacacggaccgtcctgctctcacgagcggtcccgcaacagcatctccagcacgggacgcggcaccggtaacagtagcgga

SEQ ID NO: 71918 - DNA, 598 bp, Zea mays
  misc_feature: Ceres CLONE 1554304
  misc_feature: Encodes the peptide sequence at SEQ ID NO. 71919
  misc_feature (390)..(390): n is a, c, t, g, unknown, or other
  misc_feature (392)..(392): n is a, c, t, g, unknown, or other
  misc_feature (395)..(395): n is a, c, t, g, unknown, or other
  misc_feature (400)..(400): n is a, c, t, g, unknown, or other
  misc_feature (414)..(414): n is a, c, t, g, unknown, or other
  misc_feature (417)..(417): n is a, c, t, g, unknown, or other
  misc_feature (423)..(423): n is a, c, t, g, unknown, or other
ccgggcccccctcgagccactgcagtggtaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcgcacctacggcgaggtcctcgagtcaagatatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtccccncngcngcccntgaaggcggcggcngcngctacngtgggtgccctggaaggcggcgggctacggcgggtggcgggcccccctgaatggcggcggccggctacgggggggggcgggcgggggttaccgggggggggggggggggttacgtgggggggggggggggggggcttccgggcggggggcaccccgggggcgggggggtttaggg

SEQ ID NO: 71919 - protein, 155 aa, Zea mays
  misc_feature: Ceres CLONE 1554304
  misc_feature (10)..(80): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (87)..(87): Xaa is any aa, unknown, or other
  misc_feature (88)..(88): Xaa is any aa, unknown, or other
  misc_feature (90)..(90): Xaa is any aa, unknown, or other
MAASDVEYRCFVGGLAWATDDHSLHNAFAPTARSSSQDILDRETQRSRGFGFVTFSTEEAMRNAIEGMNGKELDGRNITVNEAQSPXXPXKAAAAATVGALEGGGLRRVAGPPEWRRPATGGGGRGLPGGGGGVTWGGGGGGFRAGGTPGAGGFR

SEQ ID NO: 71920 - DNA, 645 bp, Zea mays
  misc_feature: Ceres CLONE 1554307
  misc_feature: Encodes the peptide sequence at SEQ ID NO. 71921
  misc_feature (481)..(481): n is a, c, t, g, unknown, or other
  misc_feature (487)..(487): n is a, c, t, g, unknown, or other
  misc_feature (493)..(493): n is a, c, t, g, unknown, or other
  misc_feature (495)..(495): n is a, c, t, g, unknown, or other
  misc_feature (496)..(496): n is a, c, t, g, unknown, or other
  misc_feature (503)..(503): n is a, c, t, g, unknown, or other
  misc_feature (516)..(516): n is a, c, t, g, unknown, or other
  misc_feature (539)..(539): n is a, c, t, g, unknown, or other
  misc_feature (578)..(578): n is a, c, t, g, unknown, or other
  misc_feature (645)..(645): n is a, c, t, g, unknown, or other
cgattgggtaccgggccccccctcgagccctgcagtggtaaagggtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacagcggcggtcgcggcggcggcggctatggtggcgggcgccgtgaccggcgttatgggcgcngtggcngctacngnncgtcgcncaagggtggtgcngccggctaccgaagccggtggcngctaaccgcgtcggcccaagggtggtggttgcggctacngcggccgcggcggccgcctggaagaactaatttttggggccctcctggcttcgggccaagttacctn

SEQ ID NO: 71921 - protein, 171 aa, Zea mays
  misc_feature: Ceres CLONE 1554307
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (117)..(117): Xaa is any aa, unknown, or other
  misc_feature (119)..(119): Xaa is any aa, unknown, or other
  misc_feature (121)..(121): Xaa is any aa, unknown, or other
  misc_feature (122)..(122): Xaa is any aa, unknown, or other
  misc_feature (124)..(124): Xaa is any aa, unknown, or other
  misc_feature (136)..(136): Xaa is any aa, unknown, or other
  misc_feature (149)..(149): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYSGGRGGGGYGGGRRDRRYGRXGXYXXSXKGGAAGYRSRWXLTASAQGWWLRLXRPRRPPGRTNFWGPPGFGPSYL

SEQ ID NO: 71922 - DNA, 708 bp, Zea mays
  misc_feature: Ceres CLONE 1554309
  misc_feature: Encodes the peptide sequence at SEQ ID NO. 71923
  misc_feature (375)..(375): n is a, c, t, g, unknown, or other
  misc_feature (686)..(686): n is a, c, t, g, unknown, or other
  misc_feature (687)..(687): n is a, c, t, g, unknown, or other
acgattgggtacgggccccccctcgagccctgcagtggtaaaggagactctaccctgaccacagcaaccaacctcctctttcctttccatccatcggaccatcgatcacaattcacacagccctagcccctaggtagtggcatcatggcggtgaaggactgcggcgggcacaagggctgcgagtgcgagcgggagcggctgtaccggcggtgctgcgcggcggtcgtggctctgatcctcctggtcctcttcatcgtgctcgtcgtgtggctggtgctgcgcccccacaagccccggttctacctgcaggacctgtcggtgctgtgcctgaacgtgacgccgccggcgtccacgtacctgttcacgacaatgcangcgacggtggcggctcgcaacccgaacgagcgcccgggcgtgtactacgaccaggcggacgcgtacgcggagtacaagggcgtggcgatcacggtgcccacgcggctgcccgtgcagtaccaggggccccgggacgcgtccgtgtggtccccgttcctgcgcgcccccggacggcggggtgcaactcccgcccgcaacctggccttggagcctggggccaggacaaaaacggcggggcttacttggctcggttcaacatccctccttcaaacgggctggggtcccccctggaaaaagtccgcgccccccannctggaattcctccgggttccc

SEQ ID NO: 71923 - protein, 188 aa, Zea mays
  misc_feature: Ceres CLONE 1554309
  misc_feature (42)..(168): Pfam Name: Hin1 Pfam Description: Harpin-induced protein 1 (Hin1)
  misc_feature (77)..(77): Xaa is any aa, unknown, or other
  misc_feature (181)..(181): Xaa is any aa, unknown, or other
MAVKDCGGHKGCECERERLYRRCCAAVVALILLVLFIVLVVWLVLRPHKPRFYLQDLSVLCLNVTPPASTYLFTTMXATVAARNPNERPGVYYDQADAYAEYKGVAITVPTRLPVQYQGPRDASVWSPFLRAPGRRGATPARNLALEPGARTKTAGLTWLGSTSLLQTGWGPPWKKSAPPXLEFLRVP

SEQ ID NO: 71924 - DNA, 650 bp, Zea mays
  misc_feature: Ceres CLONE 1554312
  misc_feature: Translation starting site: 159
acgattgggtaccgggccccccctcgagccactgcatggttaagggaggcccacatatatctccccgacgtccactagcccttgccgccgtacgactacttcatcgtagacgacgtctagacctcttcgcgcactggaaaggttaaagtcccacatcaatgggcaagcatcatcctaatctcatcatgtgcctgaagcaaccaggcatcactattggccgcctttacgataaatgtgatcgcgagtgtgttgtctgcgactcgtacatgcgcccatgtacgcttgtccgggtctgcaacgagtgcaattatcgttcggtccacgcaacgtgtgtcatctcgtcgacgattcagcctctcagacacgtactactgcaaggactgcacccaccaggaagaggaccaggacggttgccccacgatcgtgaatctcgcaagcgcccagactgatctcatctatgaccgcaagaagtattgttatcctaagagatgacctagaccatggagctgcgtgtggttcacttaggctgtgtggaccgtgctctggcactgcatactgacagtaggccgctgatacagcagctatgtattcctgctatggtttgcatgctgatactcgcatggaaaacagctgtgatatgcgttataaca

SEQ ID NO: 71925 - DNA, 653 bp, Zea mays
  misc_feature: Ceres CLONE 1554313
  misc_feature: Encodes the peptide sequence at SEQ ID NO. 71926
cgattgggtaccgggcccccctcgagccactgcagtggtaaaggagcctgacccttacgccttcgctcttgccgacgccgtcgccgccgatacgcgccgcacctcgcttcatttcgtgtcgccaagatgaccaagcgcactaagaaggcaggaattgttggcaaatatggcaccaggtatggtgctagcttgcgtaagcaaatcaagaagatcgaggtatctcagtattccaagtacttttgcgacttctgtggaaagttttctgtgaacaggaaagcatttggaatttgggggtgcaacgactgtgggaaggtgaaggctggtggtgcttacaccatgaacactgctagtacggtcaccgtcaggagcacgatccgcctcctgagggagcagactgaagcctgatatagctctctatattattggggtttcctgcagttgctcttgtcaagcatgttgtgggggccttatctagtgcaaatgtggaatcactgtactggctgttttgccaagacaatgcgtcttatatttatactatgctcgaggatctcacagttgtgttaataaccaattacctatgccatagctctggcgattgctgctgcccgagcgatccattagttctagagctgccgcgaccgcggtgtagctcc

SEQ ID NO: 71926 - protein, 92 aa, Zea mays
  misc_feature: Ceres CLONE 1554313
  misc_feature (2)..(91): Pfam Name: Ribosomal_L37ae Pfam Description: Ribosomal L37ae protein family
MTKRTKKAGIVGKYGTRYGASLRKQIKKIEVSQYSKYFCDFCGKFSVNRKAFGIWGCNDCGKVKAGGAYTMNTASTVTVRSTIRLLREQTEA

SEQ ID NO: 71927 - DNA, 555 bp, Zea mays
  misc_feature: Ceres CLONE 1554314
  misc_feature: Encodes the peptide sequence at SEQ ID NO. 71928
cgattgggtccgggccccccctcgagccctgcagtggtaaaggcttcaggcttctagggttttcgcgccgccgccgccgccgcttcgtcgtctccgccgcagcgatgccgtcgcacaagaccttccggatcaagaagaagctggcgaagaagtgcgccagaccgccccatcccctactggatccgcatgcgcacggacaacaccatcaggtacaacgccaagcgcaggcactggcgccgcaccaagctcggctttctgagcgcgcggatcggccggctcctgcgtcggaatctaggtctctacctttccttggtttatcgatgtctctggggttctggagccagcaacagttcagaaagcttttgtaagatttgatgacgctaaaggatgtgctcctaaaaaaaaaaaaaaacccaagccctggaaatcctgccgcccggggatccccttttctaaaggggcccccccccgggggaacccccccttttttcccttttgggggggtatttccgggtgggggaaacggggcaaaacgttttcccggggaaaaatttt

SEQ ID NO: 71928 - protein, 62 aa, Zea mays
  misc_feature: Ceres CLONE 1554314
  misc_feature (1)..(23): Pfam Name: Ribosomal_L39 Pfam Description: Ribosomal L39 protein
MRTDNTIRYNAKRRHWRRTKLGFLSARIGRLLRRNLGLYLSLVYRCLWGSGASNSSESFCKI

SEQ ID NO: 71929 - DNA, 602 bp, Zea mays
  misc_feature: Ceres CLONE 1554316
  misc_feature: Encodes the peptide sequence at SEQ ID NO. 71930
cgattgggtaccgggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcgggcgggctaacggtgggtgggccccgtgaaggccggggctacggcggtggcgggcgccctgaggccgcggcgggtaccgccgtgggcgggggcggtaccgggggggggggtgggctccggggggggggggtggggggttccggggggggggaaaccgtgggcgggggcccccccccc

SEQ ID NO: 71930 - protein, 103 aa, Zea mays
  misc_feature: Ceres CLONE 1554316
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGRANGGWAP

SEQ ID NO: 71931 - DNA, 625 bp, Zea mays
  misc_feature: Ceres CLONE 1554320
  misc_feature: Encodes the peptide sequence at SEQ ID NO. 71932
  misc_feature (371)..(371): n is a, c, t, g, unknown, or other
  misc_feature (563)..(563): n is a, c, t, g, unknown, or other
acgattgggtaccgggccccccctcgagccactgcagtggtaaaggagtcaccgcatcgtcgccctcaaattcgttccgtccaggcaaggaagaaatcgagcagccaaggagaggagaagatggctcgtacgaagcagaccgcccgcaagtccaccggaggcaaggccccgcgcaagcagctcgccaccaaggcggcgaggaagtctgcgccgacgaccggcggcgtgaagaagccccacaggtacaggcccgggacggtggctctgcgcgagatccgcaagtaccagaagagcacggagctgctgatccggaagttgcccttccagcgcctggtccgtgagatcgctcaggactttcagacggatctgcngttccagagccacgccgtcctggccctcccagaagcgccgaaggctaactcgtcggcctgttcgaggaaacaacctcttgcgcattccaggccaaggggtcaaccttatggccaaaaaaattcaggtggcccgcccctttcccggggaaggcccccttaggctttttcccccccccggcccccagggccggngaaagggatgtgaagagggggaaattttgaacccttttgggggtttggttcccttttaaaac

SEQ ID NO: 71932 - protein, 136 aa, Zea mays
  misc_feature: Ceres CLONE 1554320
  misc_feature (84)..(84): Xaa is any aa, unknown, or other
MARTKQTARKSTGGKAPRKQLATKAARKSAPTTGGVKKPHRYRPGTVALREIRKYQKSTELLIRKLPFQRLVREIAQDFQTDLXFQSHAVLALPEAPKANSSACSRKQPLAHSRPRGQPYGQKNSGGPPLSRGRPP

SEQ ID NO: 71933 - DNA, 538 bp, Zea mays
  misc_feature: Ceres CLONE 1554326
cgattgggtacgggcccccctcgagccctgcagtggtaaagggagagatctggtctgccattccccgctccttcctgtgaaccacaaacctaacgcggaagcggcgcgggccggccgccgggcgagtgcgcgtacctgccgtcgatcgtcgcggatcatccacatggcggtggcaacggcagagtccagatgcccgcgagcgcacttgagaagaacaggggccaggggagcagctcgagaccaacagaaggcatgagcatcagtgcaagtgtgatgcaacattctgtgtacaccactgaattgattgccgggagccccccaagcccaactttccagaaagaacctgttccattgtttccccattttaaaaatttaaaggcccaactttttcacccgggctgggtttggccctacaaaagggccagggggtttccttttgtcaaggggtttcttcccggttgttttccccaaaaaaaggggcctttcctttttttccccccccaaaaaaagggggggggggcccccttttaggaaaacc

SEQ ID NO: 71934 - DNA, 596 bp, Zea mays
  misc_feature: Ceres CLONE 1554329
  misc_feature: Translation starting site: 148
  misc_feature (37)..(37): n is a, c, t, g, unknown, or other
  misc_feature (184)..(184): n is a, c, t, g, unknown, or other
  misc_feature (218)..(218): n is a, c, t, g, unknown, or other
  misc_feature (227)..(227): n is a, c, t, g, unknown, or other
  misc_feature (259)..(259): n is a, c, t, g, unknown, or other
cgaattggggtaccgggcccccccttcgagccactgncagtggtaaaggtgctttcttagaggtgggttggcttctcctccccctccggttcgggttcgggttcgtgaggttctccggggttcggtttcgtgggtgagcggatcgagatggcggcgtctgatgttgagtaccgctgcttcgtcngcggcctcgcctgggccacggacgaccactcccntcacaacgncttcagcacctacggcgaggtcctcgagtccnagatatcctcgatcgggagacgcagaagtcccggcggcttcggctttcgtcaccttcttccccggaggagcgatgccgaaacccatccagggcataaacgcaaaggacctggaaggccccaaatttcccttaaaaaggcccattccccggggggccccgaaaggggggggggggcgctcccggggggccccctgaaggcccccgcttcccccggggggggggcccccctttaatggcggcggccgcctccggggggggccgggggggccctcccggggggggcggggggtccccaggggggggggggggggggcgcccacccgggggggcacccccc

SEQ ID NO: 71935 - DNA, 659 bp, Zea mays
  misc_feature: Ceres CLONE 1554330
  misc_feature: Encodes the peptide sequence at SEQ ID NO. 71936
acgattgtgtacgtggccccccctcgagccctgcagtggtaaaggaatgaatacgcgactgctactagtgatactggtacgacagctagcatagcacatcacagcacatcaccgctacacgttgggagtgcatccattctagatcatggacgacggcgactggatcacggggaggtacctcctctcgtcgatcctcgggcggaacccgctggtggtggactacgtcgactaggagtccttccccgtcgaccttccacctcccacgccgtcaccctcttcctcctgcggacgccgcgcggagccgccgccgccggtgcacgcgccctctggggtggcctgcaactcgtgcgcgatgtgcacagaggacatcgctgcggctgactccgtggcgcgcctgccctgctcgcactggtaccaccactgctgcatcacgccgtggctcgagatcctccccacctgccccatgtgcctcgccgagctgccgccgagggaagccgccgccgggaatgatggcgccgggcgcaccaagccgccgcccgcggggaccaccgccggcgcgactgtcgctgcctgcacgctcatagcgggacgcaccgtacgagctcctctccggctgcgtagctgtcctgctgatccggaccaggccgatccagagtaga

SEQ ID NO: 71936 - protein, 101 aa, Zea mays
  misc_feature: Ceres CLONE 1554330
  misc_feature: SWISSPROT Homolog: EC 6.3.2.19 Ubiquitin--protein ligase
MCTEDIAAADSVARLPCSHWYHHCCITPWLEILPTCPMCLAELPPREAAAGNDGAGRTKPPPAGTTAGATVAACTLIAGRTVRAPLRLRSCPADPDQADPE

SEQ ID NO: 71937 - DNA, 651 bp, Zea mays
  misc_feature: Ceres CLONE 1554335
  misc_feature: Encodes the peptide sequence at SEQ ID NO. 71938
  misc_feature (1)..(1): n is a, c, t, g, unknown, or other
  misc_feature (47)..(47): n is a, c, t, g, unknown, or other
  misc_feature (153)..(153): n is a, c, t, g, unknown, or other
  misc_feature (206)..(206): n is a, c, t, g, unknown, or other
ncgattgggtaccgggccccccctcgagccctgcagtggtaaagggnatgacacactcgactctcctctctctgattcgcagcctctcgagctctactccatcccctctatctaaaagcgcagcaacagtagtgaggcggccatggacgccanctcaactggagttggtagtaaagaaaagaagggcgcggccgggcccaaggtcngcaaaaaaaaaaagaagtcggtgactaggtccgtctaggccggtctgcacttccccgtcggcctcattgttcggtatctgaagaagggccggtacgcgcagcgcgtcggcacgggcgcccccgtctacctggccgccgtcctctagtacctggccgccgaggtgctggagctggcctgcaacgctgccaaggacaacatgaatacccgcatcatcccgcgccacgtgctcctggccatccgcaacgactaggagctcggcaagctgctgtccggcgtcaccatcgcccacggcggcgtcctccccaacatcatcccggtgctcctgcccaagaagaccgctgagaaggcggcggccaaggaggccaagtcgcccaagaaggccgctaagtcccccaagaaggcatacaggggcgcctttaccgctgtgatgttgaatgctcgtgt

SEQ ID NO: 71938 - protein, 33 aa, Zea mays
  misc_feature: Ceres CLONE 1554335
  misc_feature (4)..(4): Xaa is any aa, unknown, or other
  misc_feature (22)..(22): Xaa is any aa, unknown, or other
MDAXSTGVGSKEKKGAAGPKVXKKKKKSVTRSV

SEQ ID NO: 71939 - DNA, 629 bp, Zea mays
  misc_feature: Ceres CLONE 1554336
  misc_feature: Encodes the peptide sequence at SEQ ID NO. 71940
  misc_feature (399)..(399): n is a, c, t, g, unknown, or other
  misc_feature (436)..(436): n is a, c, t, g, unknown, or other
  misc_feature (475)..(475): n is a, c, t, g, unknown, or other
cgattgggtaccgggccccccctcgagccctgcagtggtaaaggtgatactcgtgcagagtctactccgcggctccgcgcgggcgcacgcagatgggcatcagcccctccaagcgcgtggacgctgcgctgcgccgcgcgccgttgttcgccgccgcctgcgacgccgccttcgaccggtgcctcgccgacgcgcagcgccgcttcccgggcgtccgccggtaccagctcgccgacgccgccgcacaccttcactcggagctcagcgcgtccgtcccgctggtccggcgctgggtgccctcgccgccgccccgcgtccgagtcgacgccgcgctccgcgccgctgggctagaggacgaggcagagctctcgcgactccagttccgggagtttgccgtcnagctgttcaagggagccgtgctggccggagctgcggnacttctccgcgcgcccgcaggcgcgggcggggatcgtcnggataggcatggtggctcgagcccgctcccccggtggtccgggaagatccgtcgcccgtcttggcccgcttagggtgggccccccccagtttttccctcaaccctggggttatgggttttcccccccccaattttctgggggggaatttaagga

SEQ ID NO: 71940 - protein, 151 aa, Zea mays
  misc_feature: Ceres CLONE 1554336
  misc_feature (103)..(103): Xaa is any aa, unknown, or other
  misc_feature (115)..(115): Xaa is any aa, unknown, or other
  misc_feature (128)..(128): Xaa is any aa, unknown, or other
MGISPSKRVDAALRRAPLFAAACDAAFDRCLADAQRRFPGVRRYQLADAAAHLHSELSASVPLVRRWVPSPPPRVRVDAALRAAGLEDEAELSRLQFREFAVXLFKGAVLAGAAXLLRAPAGAGGDRXDRHGGSSPLPRWSGKIRRPSWPA

SEQ ID NO: 71941 - DNA, 613 bp, Zea mays
  misc_feature: Ceres CLONE 1554338
  misc_feature: Translation starting site: 123
  misc_feature (22)..(22): n is a, c, t, g, unknown, or other
  misc_feature (23)..(23): n is a, c, t, g, unknown, or other
  misc_feature (293)..(293): n is a, c, t, g, unknown, or other
  misc_feature (366)..(366): n is a, c, t, g, unknown, or other
  misc_feature (389)..(389): n is a, c, t, g, unknown, or other
  misc_feature (390)..(390): n is a, c, t, g, unknown, or other
  misc_feature (406)..(406): n is a, c, t, g, unknown, or other
cgattgggtaccgggccccccnnctcgagccactgcagtgggggtaaagcgtgtgtctggaaaccctagccgccatatctcacgatccactcgagcaccaagccgagggaaggtgaggagcgatggcgcgcggcgtggtgtcggcgaagggcggcgcggtcgcgggcaagaagaaggggtcggttttcttcacgatcgactgcaccaagccagtggaggacaagatcatggaggtcgcctcgctcgagaagttcctgcaggagcgcatcaaggtcgccggcggcaaggctggncacctcggcgactcccgtcacatctctcgcgagaagaccagggtcacgtcacctctgacggacccttcttccnagagtaccctgagtacttgaccnnagagtactttgagaangcccacgtgcggggatggctacccgtggttgctgcccaccaggaacgaaacgtctattaactccgctacctcaacattggtttaaaaccagggccaaggaaaaaaattaatttgccctaccccttttatttttagatttaaaccccgtggcttttttgaaacccgggcccccggatttttccaaaaaggcccccggtttaggggggg

SEQ ID NO: 71942 - DNA, 629 bp, Zea mays
  misc_feature: Ceres CLONE 1554340
  misc_feature: Translation starting site: 121
  misc_feature: SWISSPROT Homolog: EC 1.15.1.1 Superoxide dismutase
  misc_feature (16)..(16): n is a, c, t, g, unknown, or other
ccgattgggtacgggnccccccctcgagccctgcagtggtaaagggaacgcacgcaatctcgcagcaaaccgccgggcccctcgcgcgcacacacctcagctccctcgtaccggggctccatgggcaacttcgcatcgtgcacgctggcgaggacggccggggccgggagggccagcggctcgaccgtcgtgctcccggacgggcgggtgcggcaggtggccctcccggccacggcggccgagctgatgctcgacgcgccgggccatttcctggcggacgcgcgggcgctgcggcccgggcggcggatcgaggcgctcgcggcggacgagggcctcgtgcgcggggcgctgtacgccgtgctccccatgaagcgcctgggcgcccccgtggcgcccgccgacgtggcgcgcctggcggccgcggtggtggccagcggggagaaggcgcgggccacgagggggaggacgcggccggtgtcgtcccccgccgccacggccaaggtcgccgccgtcttcgtcgcgccgcccgagacgctcgaggccgcggcccttgagctccaggagacggacgcgtccaagccgagggccccgaggctggaggagatggccgtcgacgacgcagcggccgc

SEQ ID NO: 71943 - DNA, 624 bp, Zea mays
  misc_feature: Ceres CLONE 1554350
  misc_feature: Encodes the peptide sequence at SEQ ID NO. 71944
cgattgggtccgggcccccctcgagccactgcagtggtaaaggtggttctactgaacgagcactcgcctgcgctcttctctctctcgtggcgacgactgggtgactgccggcgccccaggcctgagcctccatcttcgggcccttcactggctacgagcaccacctgaggattatggattggctggggcagaagcgcgcggagatgctgatgcaggtgctgctggtggcgtctgctgtggcggcgttcctggggggctacgtgcgcgcggacttccagctcatgctgctcgtctacgccggcggcgtcgtgctcacagcgctcgtcaccgtccccaactggcccttcttcaaccgtaacccgcttaagtggctcgacgctgccgaggccgagcgccacccgcgcccccaggtcagcgccggtgcggcagcagggggaaagaagaagtccgggaagaacaagtaatcgatctttcggagcgatatgtgttctttgtcgatttgactcacacctatttaaagttttatttcgcagaactaatcaatgataaaagagctagagcctagaggtgttcgacagtttttggttggtacttaaaaatatgcagttgtgccctgaaatttac

SEQ ID NO: 71944 - protein, 96 aa, Zea mays
  misc_feature: Ceres CLONE 1554350
  misc_feature (1)..(80): Pfam Name: SPC12 Pfam Description: Microsomal signal peptidase 12 kDa subunit (SPC12)
MDWLGQKRAEMLMQVLLVASAVAAFLGGYVRADFQLMLLVYAGGVVLTALVTVPNWPFFNRNPLKWLDAAEAERHPRPQVSAGAAAGGKKKSGKNK

SEQ ID NO: 71945 - DNA, 596 bp, Zea mays
  misc_feature: Ceres CLONE 1554351
  misc_feature: Encodes the peptide sequence at SEQ ID NO. 71946
  misc_feature (481)..(481): n is a, c, t, g, unknown, or other
  misc_feature (487)..(487): n is a, c, t, g, unknown, or other
  misc_feature (517)..(517): n is a, c, t, g, unknown, or other
ccgggcccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccctggaggcggcggcggcggctacggtggtggccgtggaggcggcggctacggcggtggcgggcgccctgatggcggcggcngctacngcggtggcggccgcggctaccgtgggcgcngtggctaccgtggtggtgggtggcggctacggccggtggcaaccgtgggcggcggctaccggaaactccgaagggaaac

SEQ ID NO: 71946 - protein, 154 aa, Zea mays
  misc_feature: Ceres CLONE 1554351
  misc_feature (10)..(81): Pfam Name: RRM_1 Pfam Description: RNA recognition motif. (a.k.a. RRM, RBD, or RNP domain)
  misc_feature (48)..(140): Pfam Name: GRP Pfam Description: Glycine rich protein family
  misc_feature: SWISSPROT Homolog: EC 5.2.1.8 Peptidylprolyl isomerase
  misc_feature (117)..(117): Xaa is any aa, unknown, or other
  misc_feature (119)..(119): Xaa is any aa, unknown, or other
  misc_feature (129)..(129): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGPGGGGGGYGGGRGGGGYGGGGRPDGGGXYXGGGRGYRGRXGYRGGGWRLRPVATVGGGYRKLRRE

SEQ ID NO: 71947 - DNA, 501 bp, Zea mays
  misc_feature: Ceres CLONE 1554354
  misc_feature (490)..(490): n is a, c, t, g, unknown, or other
cgattgggtacgggcccccctcgagcactgcatggtaaaggaaccgagacaccgcgtgcgaaccaagcaaccccagcagaagaagcgaagtcgtcgccggagcaggaggaagagcgagcagcaagatgtcgtggcaggcgtacgtcgatgaccacctgctgtgcgactcgaagccagcacctcagcgccgccgcatcgtcgccacgacggcagcgtctggccacatccaaaaacttcccaaatttaaaaccttaaagaagtttcctgggaataataaaaaacttttgataaaccctgaaaacctttttccccaaaaggggccttttttttttgggaaggggcacaaaaatttcttttgggggtatcccacgggggaaaacccccggattttttctcccctccaaaaaaaaaaaaaaaaaggggcccccccttggggggttttttttttttttcaaaaaaaaaacgggggggggttccctcccctttttanaaaaaaaaact

SEQ ID NO: 71948 - DNA, 668 bp, Zea mays
  misc_feature: Ceres CLONE 1554355
  misc_feature: Encodes the peptide sequence at SEQ ID NO. 71949
gcgattgggtacgggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccttgatggcggcggcggctacagccgtggcggcggcagctacggtggcggcggtggctacggtggtggttgtggccggctccggcgggtggcaaccgtggcgggcggctacggcaactcccgacgggaaactggagggaacctgagcgggggggcccgcgcggcccaagttttcctggttcgcttccggggat

SEQ ID NO: 71949 - protein, 175 aa, Zea mays
  misc_feature: Ceres CLONE 1554355
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRLDGGGGYSRGGGSYGGGGGYGGGCGRLRRVATVAGGYGNSRRETGGNLSGGARAAQVFLVRFRG

SEQ ID NO: 71950 - DNA, 669 bp, Zea mays
  misc_feature: Ceres CLONE 1554356
  misc_feature: Encodes the peptide sequence at SEQ ID NO. 71951
  misc_feature (669)..(669): n is a, c, t, g, unknown, or other
cgattgggtaccgggccccccctcgagccactgcagtggtaaaggcgggcaacgcgacctcggccgctcggggaagggtcggtccacgcacgccgctcgcgcttcgcgtcggttttatgcacgactccttttcgcacccggctggccggctccccacctgctcgcctctcgcgcatcctaccaggagggtgggagacccaggcagcggtggtgtgcgaagctcgcttcgcaccacgcgctgcggcctgcggggcgagagatcgaggcctgagctagggtctggtggcggagatgtcgacgccggcgaggaagcgcctgatgcgggacttcaagcgccttcagcaggacccgcccgccggcatcagcggcgcgccgtacgacaacaatatcatgctctggaacgccgtcatattcgggccggatgacacgccgtgggatggaggcacgttcaagctgactctgcaatttacagaagattaccccaacaaacctccaactgttcggtttgtttcgaggatgtttcatccaaacatctatgcggatggaagcatctgtttggacatcctacaaaaccagtggagccctatatatgatgttgcggcaatattgacctctattcagtccctgctgtgtgacccacacccaaattctcctgctaactctgaagcn

SEQ ID NO: 71951 - protein, 126 aa, Zea mays
  misc_feature: Ceres CLONE 1554356
  misc_feature (8)..(126): Pfam Name: UQ_con Pfam Description: Ubiquitin-conjugating enzyme
  misc_feature: SWISSPROT Homolog: EC 6.3.2.19 Ubiquitin--protein ligase
MSTPARKRLMRDFKRLQQDPPAGISGAPYDNNIMLWNAVIFGPDDTPWDGGTFKLTLQFTEDYPNKPPTVRFVSRMFHPNIYADGSICLDILQNQWSPIYDVAAILTSIQSLLCDPHPNSPANSEA

SEQ ID NO: 71952 - DNA, 671 bp, Zea mays
  misc_feature: Ceres CLONE 1554370
  misc_feature: Encodes the peptide sequence at SEQ ID NO. 71953
  misc_feature (666)..(666): n is a, c, t, g, unknown, or other
ccaattgggtaccgggccccccctcgagccctgcagtggtaaaggaagggccaaggcagggcactgcactgcacgcatgcactgacctgacgacgcgcgccacagtccactccacactcaggcatggcgatgggcgccgcttccatcctactgatgatggtttcgctggaggccctgcttctcgccgccgccgccggcggcgggaccatccgtctgcccagcgatgtcggaggcgttgctgcagaccttgtcacggcgatggcgagggcgagggcaagggcaaagcatcagcttcgcgacgaggagaggccgtggggggaatgctgcgacttggccgtatgcgtcaagacgtacccgctaacttgctcgtgcttcgatcgggttgagcgctgctccgacgcctgtaaggagtgcgtggaaacggaggactcgcgccacgtctgcgtcgacaggtaccgtggcgaccccgggcccaggtgccacgacgaggacgggaggagcggcggacccgctgacgacgacgctggtgggcaagcgacgccgacggcagtgatggcagatgacaagaaagcaggcggcggcgacgacgacaagaagatgaggccgtggaaatgctgcgacgtgcccatctgcaccaggtccctggcctcgggtgtgccgctgcgncgact

SEQ ID NO: 71953 - protein, 182 aa, Zea mays
  misc_feature: Ceres CLONE 1554370
MAMGAASILLMMVSLEALLLAAAAGGGTIRLPSDVGGVAADLVTAMARARARAKHQLRDEERPWGECCDLAVCVKTYPLTCSCFDRVERCSDACKECVETEDSRHVCVDRYRGDPGPRCHDEDGRSGGPADDDAGGQATPTAVMADDKKAGGGDDDKKMRPWKCCDVPICTRSLASGVPLRR

SEQ ID NO: 71954 - DNA, 595 bp, Zea mays
  misc_feature: Ceres CLONE 1554371
  misc_feature: Encodes the peptide sequence at SEQ ID NO. 71955
caattgggtaccgggccccccctcgagccctgcagtggtaaaggatggaggtccactacctggagtacgtggtgcagctggacgagacgacgctgagcgagcagtacccgagcgatcacccggtgctgagggaccccatggccatccacaagcaggggtggaacgcgctcaagaccacgtacctggacaagcagaacgtgcggccgcacctgggccgcctcaagaacaccttcctccaggcgctcaagatgctgccgcacggccgggacgattgataagtcaaattagttgattcacctggatctcagcctcagtttttagagggagtaaatgtataggttaatggtagctactacttttttcggcttattgttttttttattttttgcctgtattcgttgtaccagtaagaggatgcacccgcgtagctgtgaatgccttccagtttctcaaaaacaaacctagagtgttaactggtgaaattttattaataaagaatgttggctttgaaaaaaaaaaaaaaaaaacccgaagcccttgggaaattcttgcaagccccggggaatcccttaaatttttaaagcggccccccccc

SEQ ID NO: 71955 - protein, 76 aa, Zea mays
  misc_feature: Ceres CLONE 1554371
MEVHYLEYVVQLDETTLSEQYPSDHPVLRDPMAIHKQGWNALKTTYLDKQNVRPHLGRLKNTFLQALKMLPHGRDD

SEQ ID NO: 71956 - DNA, 630 bp, Zea mays
  misc_feature: Ceres CLONE 1554372
  misc_feature: Encodes the peptide sequence at SEQ ID NO. 71957
  misc_feature (554)..(554): n is a, c, t, g, unknown, or other
cgattgggtacgggcccccctcgagccctgcagtggtaaaggttcgttcccacacccctcaccgcgtccgcctcccctatcatctagggtttctagggttttccaggaggaggaaatggcgtctgatagggtgctcgggactgtgaagtggttcaacggaaccaagggcttcggtttcatcacccccgacgacgggagtgaggatctcttcgtccaccagtcctccatcaagtccgacggctaccgcagcctaaacgacggcgatgccgtcgaatacaccgtcggcagcggcaacgacggccgcgccaaggccctggatgtcaccgcgcccggcggcggcccgcttgccggcggggaacgtcccgacggcggcaacggcggtgggcgcggcggatacggcggcggcgaccgcggatacggcggcggcggtgaccgcggctacgggggaggaggcgaccgcggctacggcggcggcgaccgtggttacggtggaggtggcgaccgcggctacggcggcggcggcgaccgtggctacgggggaggcggcggctacngcggcgggtacggtggaaggtggcggcggcggcggccgcggctgcttcaagtgcggcgaggagggccacatggcaa

SEQ ID NO: 71957 - protein, 171 aa, Zea mays
  misc_feature: Ceres CLONE 1554372
  misc_feature (5)..(72): Pfam Name: CSD Pfam Description: 'Cold-shock' DNA-binding domain
  misc_feature (147)..(147): Xaa is any aa, unknown, or other
MASDRVLGTVKWFNGTKGFGFITPDDGSEDLFVHQSSIKSDGYRSLNDGDAVEYTVGSGNDGRAKALDVTAPGGGPLAGGERPDGGNGGGRGGYGGGDRGYGGGGDRGYGGGGDRGYGGGDRGYGGGGDRGYGGGGDRGYGGGGGYXGGYGGRWRRRRPRLLQVRRGGPHG

SEQ ID NO: 71958 - DNA, 664 bp, Zea mays
  misc_feature: Ceres CLONE 1554377
  misc_feature: Encodes the peptide sequence at SEQ ID NO. 71959
  misc_feature (579)..(579): n is a, c, t, g, unknown, or other
cgattgtgtaccgggccccccctcgagccctgcagtggtaaagggtgctctctcagaggtgggctggcttctcctccccctcttacaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctactgaggcggtggcggctacggcggtcggcgcgagggtggcggtggcggctacngcggcggtggcggcggcggctggagggactgatgtgtgggcccatcctggcttcggcccgagtatcctatctatctatagtatcg

SEQ ID NO: 71959 - protein, 132 aa, Zea mays
  misc_feature: Ceres CLONE 1554377
  misc_feature (10)..(81): Pfam Name: RRM_1 Pfam Description: RNA recognition motif. (a.k.a. RRM, RBD, or RNP domain)
  misc_feature (48)..(129): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGGYGGGRRDGGYGGGGGYGGRREGGGGGY

SEQ ID NO: 71960 - DNA, 594 bp, Zea mays
  misc_feature: Ceres CLONE 1554379
  misc_feature (218)..(218): n is a, c, t, g, unknown, or other
ccaattgggtaccgggccccccctcgagccctgcagtggtaaaggaggggccatcagatccaagaagagggaagagcaccaaggaccttcggcgcccgttcaggatccacatcttcacgagcgagttcttggttggcctcttcctcttcggaccacctcaaggctcttggtgtagcttgccactctcaccaatcaaaagttttcatgtctgatctccnactttcagatcccaaactgcccttcgatcccttcccctgaggcccaatgctggggaactctggtgcaccaccaggggtcaaaggaattacttccaccttcccattcccaaaacttaaatggccccaaaaacccttacccccccccccgggatttaaaaaaggattttccctccccccaaaccccccaaaaattccaaaaaaaaaagtttcccccccattttaaatggggtccccaacccccaaaattttgaaagggtttttcccccccccgggggaaaaagaaaaaaaaaaactcccaattttccccccccccccccccccttttttttaaaaaaaacccccccccaatttttttttgttttctataaaaaacccc

SEQ ID NO: 71961 - DNA, 664 bp, Zea mays
  misc_feature: Ceres CLONE 1554384
  misc_feature: SWISSPROT Homolog: EC 6.3.1.2 Glutamate--ammonia ligase
cgattgggtacgtcgacccccccgagccctgcagtggtaaagggagcacatcgcggcctacggcgagggcaacgagcgccggctcaccggcaggcacgagaccgccgacatcaacacgttcagctggggcgtggccaaccgcggcgcgtcggtgcgcgtgggccgggagacggagcagaacggcaagggctacttcgaggaccgccgcccggcgtccaacatggacccctacgtggtcacctccatgatcgccgagaccaccatcatctggaagccctgagcgccgcggccgttgcgttgcagggtccccgaagcgattgcaaagccactgttccttccgttctgtttgcttattattgttattatctagctagatcatccgggggtcaggtcgtcgtggtgtgccaaaacagaacacagaaagaggaagaagaaaaaaaaaacaagacgtgtggcgtttatgttatatcatccaataatggccgtaccacacttgtggtacctttcagtacgtatacttgcgttgtatgaggggtcgctttcctacgccctaaaaaaaaaaaaaaaaaaccagagctctgggaattcctgcagcccgggggatccactagttctagagcggccgccaccgcggtggagctccagcttttgttccctttagtga

SEQ ID NO: 71962 - DNA, 607 bp, Zea mays
  misc_feature: Ceres CLONE 1554399
  misc_feature: Encodes the peptide sequence at SEQ ID NO. 71963
acgattgggtaccgggccccccctcgagcactgcagtggtaaatgctgatcgtgagagctagctactaccttattacctctctccggtctccgcatctgtaggcggcggcggccatggacttcgtgctccaggtcctgctgcgagtggtgatgagaagaagcatccgcatgctgcaagatgtcgttgacatcgccgtggacatcagcacggctgtcttcgtggccgtgcgggtctccggcctcttcttccgccgcctgctgcccacgccgactacgacatcgtcgtcttcgacgacgtactactactccccggggacgtcctcctcgatcggcatgcatgtccaggaggattaattattggcaggcactacatgactagctagctgctagggcagagatgtatactctctcggggggcatgtcagtacgagtctatatctgtgcgttctttttcgtagatcagattatttcgctagctcccgaccatatgtgttgggcctttgcccacctatatcatccctgtttaatttgaggaattgagggcccaaattcaaaccaaaaccttttgaacgccattctagttttcccttgaaaaaaaaacctcgct

SEQ ID NO: 71963 - protein, 79 aa, Zea mays
  misc_feature: Ceres CLONE 1554399
MDFVLQVLLRVVMRRSIRMLQDVVDIAVDISTAVFVAVRVSGLFFRRLLPTPTTTSSSSTTYYYSPGTSSSIGMHVQED

SEQ ID NO: 71964 - DNA, 616 bp, Zea mays
  misc_feature: Ceres CLONE 1554405
  misc_feature: Encodes the peptide sequence at SEQ ID NO. 71965
cgattgggtaccgggccccccctcgagcactgcagtggtaaaggaggcgccatcagatccaagaagagggaagagcaccaaggaccttcggcgcccgttcaggatccacatcttcccgagcgagttcttggttggcctcttcctcttcggaccacctccaaggctcttggtgtagcttgcctctctcaccaatcaagttttcatgtctgatctcgacattcagatcccaactgccttcgatcccttcgctgaggccaatgctggggactctggtgcagcagcagggtcaaaggactacgttcacgtgcgcatccagcagcgtaatggtcgcaagagcctgaccaccgtccagggattgaagaaggagttcagctacagcaagatcctcaaagatctcaagaaagagttctgctgcaatggtacagtggtccaggaaccagaacttggacaggtcattcagctccagggtgaatagaagaagaacgtctcgaatttccctcgtcaacccggcattgtgagaaggagcacttcaaaattcctggtttctgaacaacccccggggccaaatcaaacaaccctggattggggggacttttatttatttaaaaattgaagg

SEQ ID NO: 71965 - protein, 90 aa, Zea mays
  misc_feature: Ceres CLONE 1554405
  misc_feature (27)..(91): Pfam Name: SUI1 Pfam Description: Translation initiation factor SUI1
MSDLDIQIPTAFDPFAEANAGDSGAAAGSKDYVHVRIQQRNGRKSLTTVQGLKKEFSYSKILKDLKKEFCCNGTVVQEPELGQVIQLQGE

SEQ ID NO: 71966 - DNA, 607 bp, Zea mays
  misc_feature: Ceres CLONE 1554406
  misc_feature: Translation starting site: 35
cgattgggtaccgggccccccctcgagcactgcaatggtaaaggctaaactggtgaagggctcggcagactacatcggtatcaacgagtacacatccagctacatgaaaggggcagaagctggtccagctggcgcccagtatctactctgccgattggcaagttcaatatgttgatgcacgcaatgggaaacctattggaccacaggctaattctaagcggctctacatcaacaccgactgggatgtacgggtgcctgaaccaccctccaggaagaacttggggaatcccaaccaatttaattaaccggaaaaagggaattgaaccaacccgggaaaaatttgacccgaaaaccccttctttggccaaaccccccgggggcccggacttaaaggggagcctggttgggcccaccccaaaaaagggtttgtccccccccaaagaaagggggggtggtttatttgccctgtttttttctctacaaaaattttgaaggggggttggggggggcaccccccccaccaggggggggggcctctttttgggatattttaaagagggcaaaaaaaccccccaaaggggctctccccccctgatggagcgggagc

SEQ ID NO: 71967 - DNA, 656 bp, Zea mays
  misc_feature: Ceres CLONE 1554413
  misc_feature: Encodes the peptide sequence at SEQ ID NO. 71968
  misc_feature (131)..(131): n is a, c, t, g, unknown, or other
  misc_feature (275)..(275): n is a, c, t, g, unknown, or other
cgattgggtaccgggccccccctcgagccctgcagtggtaaaggaagcgaagaacatccggactctctcgctcgaggggcagggcagggcaggcggcgatccgaatccaatcgccggagggagggaagccnaccggtgggacgcagtgaggggcggcggaaggtagaaggcaaagggatgacgcgcgggaagcagagatcgacgcgcagcggcgtaacgcgagcgaaccagaaatcccaagggtctcagctcgaggcccgcggcgtcggcctcangatcgtctgctcaatctggaaggtacaattgggcaaatgaaaaaacggctgacccgtttcccctttgggatccaaagcctcccaaaggaagaaaccccccgaaacccttttagagccccgaaattaacccctgggtttgggccttgaccccaaaaaaaataaaaacccccccctttggggtgggttttaaaaaaattttttaaaacccccccttataacccccgcccctgggaaccccccacgggccgggtttttaacccccccccggggggggggcgcgtttctcccccctttttttaaaagaatttttttgtttttcccccccccccccaaattttttttcccaaaaaaagacaaaaattgttttttggggggccgccc

SEQ ID NO: 71968 - protein, 104 aa, Zea mays
  misc_feature: Ceres CLONE 1554413
  misc_feature (44)..(44): Xaa is any aa, unknown, or other
  misc_feature (92)..(92): Xaa is any aa, unknown, or other
RLGTGPPLEPCSGKGSEEHPDSLARGAGQGRRRSESNRRREGSXPVGRSEGRRKVEGKGMTRGKQRSTRSGVTRANQKSQGSQLEARGVGLXIVCSIWKVQLGK

SEQ ID NO: 71969 - DNA, 796 bp, Zea mays
  misc_feature: Ceres CLONE 1554414
  misc_feature: Encodes the peptide sequence at SEQ ID NO. 71970
  misc_feature (13)..(13): n is a, c, t, g, unknown, or other
  misc_feature (16)..(16): n is a, c, t, g, unknown, or other
  misc_feature (17)..(17): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (52)..(52): n is a, c, t, g, unknown, or other
  misc_feature (53)..(53): n is a, c, t, g, unknown, or other
  misc_feature (776)..(776): n is a, c, t, g, unknown, or other
tttttttatttgnaannaaaaagtgaaagaaacnnnnnnntttttttttttnnttcgattgggtcctcgcacccccacgagccactgctttggtaaaggaagcgaagaacatccggactctctcgctcgaggggcagggcagggcaggcggcgatccgaatccaatcgccggatggaggaagccaccggtggacgcagtgagggcggcggaggtagaggcaaagggatgacgcgcgggaagcagaagatcgacgcgcagcggcgtaacgcggagcgaaaccagaaatccaaggggtctcagctcgaggcccgcgccgtcggcctcaagatcgtctgctccatctgcaaggtacaattggcaaatgaaaaacagctgaccgatcactatggatcaaagcatccaaaggagaaacctcctaccacctccaccaccaaataaccattggctggtcgtggacgcagaaatataaaatccccccccggctgggtttgaaggatcttttaagtccgttctgattccatgcccttgggagcctcaaccgtccaagtaattataactctccaaattggtgggcatttttcccttcttgttttcagggtaaattggggttggtcgctggcttcccaatatttgttctccccaaattcccaaaacttggattgttgggacccccgattgggcatttgggtatttgatgccgacaaaaaaatttctgaagcgtgtttttcttcgttctcccgaccgagaaaaaacgttacacccccccgcggcgctntttggagcaatttctcttgc

SEQ ID NO: 71970 - protein, 70 aa, Zea mays
  misc_feature: Ceres CLONE 1554414
  misc_feature (2)..(63): Pfam Name: DUF1909 Pfam Description: Domain of unknown function (DUF1909)
MTRGKQKIDAQRRNAERNQKSKGSQLEARAVGLKIVCSICKVQLANEKQLTDHYGSKHPKEKPPTTSTTK

SEQ ID NO: 71971 - DNA, 618 bp, Zea mays
  misc_feature: Ceres CLONE 1554417
  misc_feature: Encodes the peptide sequence at SEQ ID NO. 71972
  misc_feature (528)..(528): n is a, c, t, g, unknown, or other
  misc_feature (546)..(546): n is a, c, t, g, unknown, or other
  misc_feature (579)..(579): n is a, c, t, g, unknown, or other
  misc_feature (585)..(585): n is a, c, t, g, unknown, or other
cgattgggtccgggccccccctcgagccctgcagtggtaaagggtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacagcggcggtcgcggcggcggcggcggttatggtggcgggcgccgtgacggcggttatggcggcggtggcggctacggcggtcggcgcgaaggtggcggcggcggctacngaggcggtggcggctacngcggtcggcgcgagggtggcggtggcggctacngcggcngtggcggcggcggctggagaaactgatgtgtgg

SEQ ID NO: 71972 - protein, 159 aa, Zea mays
  misc_feature: Ceres CLONE 1554417
  misc_feature (10)..(81): Pfam Name: RRM_1 Pfam Description: RNA recognition motif. (a.k.a. RRM, RBD, or RNP domain)
  misc_feature (48)..(153): Pfam Name: GRP Pfam Description: Glycine rich protein family
  misc_feature: SWISSPROT Homolog: EC 5.2.1.8 Peptidylprolyl isomerase
  misc_feature (133)..(133): Xaa is any aa, unknown, or other
  misc_feature (139)..(139): Xaa is any aa, unknown, or other
  misc_feature (150)..(150): Xaa is any aa, unknown, or other
  misc_feature (152)..(152): Xaa is any aa, unknown, or other
MAAADVEYRCFVGGLAWATSNESLENAFASYGEILDSKVITDRETGRSRGFGFVTFSSENSMLDAIENMNGKELDGRNITVNQAQSRGGGGGGGGYSGGRGGGGGYGGGRRDGGYGGGGGYGGRREGGGGGYXGGGGYXGRREGGGGGYXGXGGGGWRN

SEQ ID NO: 71973 - DNA, 672 bp, Zea mays
  misc_feature: Ceres CLONE 1554424
  misc_feature: Translation starting site: 313
acgattgggtacgcgccccccctcgagccctgcagtggtaaaggatcttcgtgtcatgtgtttcgcatactgtttgttccgtagtggcaaccaaaatgcatgttgccccgccgcgacgatgaagatgagagcagaggacgatggctcgtactatgcagaccgcccggacgtcctaggggaggcaaggcccctcgctagcagatcgcctccaatgcgacgaggaagtccgcgcctacgacatgcggcttgatgaagaccacacaggtacacgcccggatatcgggtccgctccgctagatccggaagtacgcgatgagcaccgagctcctgatccgcaagctgcccttcctccacctgctgagcgtgatcgttcatgacttcaagacacacctccggttccagagccacgccgtgctgatccctccgcgaggccgccgatgcctacctcttcggcctcttcgaggacaccatactctgcgccatggacacgatgcgtgtcaccatcatgctcaaggagttccagctgcgccgccgcgtccgtggcgatcgcgcgtaaccatcatatccgaggatctgatgaatctctagttaccagatcataggccgtattatcaccgttgttctctattcgatatgttggattccgttcgcgtgaatacaccttttaccaat

SEQ ID NO: 71974 - DNA, 625 bp, Zea mays
  misc_feature: Ceres CLONE 1554425
  misc_feature: Encodes the peptide sequence at SEQ ID NO. 71975
  misc_feature (525)..(525): n is a, c, t, g, unknown, or other
  misc_feature (540)..(540): n is a, c, t, g, unknown, or other
  misc_feature (542)..(542): n is a, c, t, g, unknown, or other
cgattgggtccgggccccccctcgagccctgcagtggtaaagggcgcaaacttctgatcgtctcgctcgtggctgccctgctcatagtgcttgccctcgccgtatcgtccacccgctacgcgcaggaggattccatggccgacaacaccgggacgttggcgggcggcatcaaggtacgtgctcggggaacgagaacgaccttctcctctaggaactcgcccgcttcgccgactatgagcacatcgagaaggccaatgctcttctggggttcgagaagcttgtgaaggccaacacactagtggttgctggcacaatgtactatctcactattgcagtgaaggatggcgaattgaataagctctaccatgctaaagtctgggagaagccgtgggagaacttctcggagctgcacgaattcgagcctgatcgagagggtgctagcgcctacagatctctccttcatcatgtgcgaggcctgacgctcatacgcaagttgcagaatcacggagccacctctgcacatgnctagacatgctcccntngtgtaagttcatacgactacaacccttttacggctagatcagtatgagtctgtgactcaggaatctgaatgtgattaattttc

SEQ ID NO: 71975 - protein, 70 aa, Zea mays
  misc_feature: Ceres CLONE 1554425
MYYLTIAVKDGELNKLYHAKVWEKPWENFSELHEFEPDREGASAYRSLLHHVRGLTLIRKLQNHGATSAH

SEQ ID NO: 71976 - DNA, 715 bp, Zea mays
  misc_feature: Ceres CLONE 1554437
  misc_feature: Encodes the peptide sequence at SEQ ID NO. 71977
  misc_feature (1)..(1): n is a, c, t, g, unknown, or other
  misc_feature (205)..(205): n is a, c, t, g, unknown, or other
  misc_feature (305)..(305): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (393)..(393): n is a, c, t, g, unknown, or other
  misc_feature (398)..(398): n is a, c, t, g, unknown, or other
  misc_feature (399)..(399): n is a, c, t, g, unknown, or other
  misc_feature (400)..(400): n is a, c, t, g, unknown, or other
nactattgtgtacgggcccccctcgagccctgcagtggtaaaggcgaaaaccctaatcgcatctgcttccagagccccccgccgccgctgcgccctcctctcggtcctgccgtccgtcgaggtaaaaggacagcatggtgagggtcagcgtgctcaatgatgctctcaagtccatgtacaatgctgaaaagatagggaaacgtcnggtcatgatcaggccgtcatccaaggtgatcatcaagttcctgacggtcatgcaccgccatggctacattggccagttccagtacctggatgaccacagnactgggtatatcttggtggagctgaatgggaagactgaattaattgtttttttcccccccccacaggggggggggggggggtannnanatccnnnggattggaccgcaatagatttttccattttccccccttttgggcgcgtggggcgctaaaaaacttcccccttgaaatttttgcaccccttaaagaaggtcccccccccccaccaaagtttgggcggcaaagattcccaacgatttccttcttttaaaaacgcgcgccctctttcctctctccccccagcctcccctcaacccttcccccacccctcccctccctccctaacaaaacggcactctcccccctccctcccaccaactcctcccacaacagcccatccttatccaccttacccccgaacgagtccccc

SEQ ID NO: 71977 - protein, 107 aa, Zea mays
  misc_feature: Ceres CLONE 1554437
  misc_feature (5)..(91): Pfam Name: Ribosomal_S8 Pfam Description: Ribosomal protein S8
  misc_feature (24)..(24): Xaa is any aa, unknown, or other
  misc_feature (57)..(57): Xaa is any aa, unknown, or other
  misc_feature (85)..(85): Xaa is any aa, unknown, or other
  misc_feature (86)..(86): Xaa is any aa, unknown, or other
  misc_feature (87)..(87): Xaa is any aa, unknown, or other
  misc_feature (89)..(89): Xaa is any aa, unknown, or other
MVRVSVLNDALKSMYNAEKIGKRXVMIRPSSKVIIKFLTVMHRHGYIGQFQYLDDHXTGYILVELNGKTELIVFFPPPQGGGGGXXXPXDWTAIDFSIFPPFGRVGR

SEQ ID NO: 71978 - DNA, 667 bp, Zea mays
  misc_feature: Ceres CLONE 1554447
  misc_feature (1)..(1): n is a, c, t, g, unknown, or other
ncgattgggtaccgggcccccctcgagccctgcagtggtaaaggagcagtgacgaactcgaagcttgcgttcttgtactagaggtcggcagcaagcggtggtagagcgagaggtcgagaagatgaagagcagcactctgttggcgatcctagttctccaggcccttctggtctctgcggccgtggccaaaggacctgcagggccgacgacaaacaagcagtgctggtgcggctagtgcaccatgctggtcgggcgtgtggacctgcaactacctcctcaccaagtgcgccgccacctgcaagaactgcgtccccgtgtccacagacaagggggccatcaagtacaggtgccgcgacttcctccccgaaaactgcggctgcaagatccactagagactcatccaattccaccatggccgcgcgccacagcggcacagccgatggatccttccatgttcctccgtccgtccgccttgctacaagcatgcagccacaccaataagctagctcttgttgttgtcttgtatgcttgatagggtgtcccttccctgtcgagatggaatgaaatacatcatcatgcgccaaaatataaagaaaaagccatagctcttgggaattcctgcagcccggggggatccactagttctagagcggccgccaccgcggtg

SEQ ID NO: 71979 - DNA, 853 bp, Zea mays
  misc_feature: Ceres CLONE 1554452
  misc_feature: SWISSPROT Homolog: EC 5.1.3.18 GDP-mannose 3,5-epimerase
  misc_feature (36)..(36): n is a, c, t, g, unknown, or other
  misc_feature (853)..(853): n is a, c, t, g, unknown, or other
tattttttttttttttctctttccccccccccccangaaagaaaaaaaaaaacaaaactggagataccccgcggtggcggccgctctagaactagtggatcccccgggctgcaggaattcgtctcacccctagaaaaacccaccgcgtcttcgtcgtctcgtcttcctgcctccttcgcccgagaaaggagagaatggggagcagcgagaagaccgttaccgcttacggcgagtaccacctacgctgagctggcgagggagtcctactggccgagtgagaggctgaggatttccgacttctggggctgtgggcttcttgtgattcccacgttggctcgcctaactgaagaccgagggcccttacctccattgccctcttgtctggtaataagaccgactatcatgaacgggaggtgatttgttctggccgggaagttcccaccccctctgaatctccggggttatggggaaaactggtcctcaaaggttcaccttagggtggccaaaccatcgatccccaacacaccccgcaggctgaaaatgggggtggccccttgggcgttctttcccgggcccacacttcgttttcgcgttgattgctgtccgcacacattcgcgccgcggttgccattcataaacagaggggaggggagcgccgcgggcccgcttcttcgccccggttgatttatccagtggttaccatcctgagagccttaccttcagggtacactcgccttcattttccgggacattttccagtgcgcatatgcattacaaaccccacgggcaaaatatcttcaagtccgaacctcttatacccgccgcctatgcccaccacttttctacccctccn

SEQ ID NO: 71980 - DNA, 641 bp, Zea mays
  misc_feature: Ceres CLONE 1554453
  misc_feature: Translation starting site: 246
cgcggtggcggccgctctagaactagtggatcccccgggctgcaggaattcgtctcacccctagaaaaaaccagtcggaccgaccaacctacttctgactgaccactgtgccgcgccgtgctcaccgaacggtcgaccacgcgaagagacgatggccgcgtctgcgctgcagcgaccacccgcttcctcgggtgggccactggtcgccggcgccgccggcgtgctatgccggcggccgcatctccatgcgccgcaccgtcaagagcgttccccagagcatatggtacggccctgaccgccccaagtaccttggcccgttctccgagcagacgccgtcgtacctgaccggcgagttccccggcgactatgggtgggacaccgtcgggcctctcggccgacctggagaccttcgcgcgcaaccgggagctacaggtgatccacgtcccggtgggcgatgctgggggcgctgggctgcttgttcccggagatcctgcctaagaacggagtctagatcgccgagccggagtggctcaaggccctccctcaaatcttctccgaagggcgggcgggacaacctggggaaacccaacctggggcacgcgcaaaagatcctggccaatctggacgttgccgggggggtg

SEQ ID NO: 71981 - DNA, 653 bp, Zea mays
  misc_feature: Ceres CLONE 1554458
  misc_feature: Encodes the peptide sequence at SEQ ID NO. 71982
  misc_feature (398)..(398): n is a, c, t, g, unknown, or other
ggagctccccgcggtggcggccgctctagaactagtggatcccccgggctgcaggaattcgtctcacccctagaaaaaagagtatagggccaacgatgcagagaagaaggtggaagtactgaatgaaaagcttaatacaatccaaaaggaaagtgatgagaaaaaacgcaaaatcaagaagacagaacgtgctcttaaagtcgctgaggaggaattaatgaggttgcagttagaagtaactgctaaatcaaaacagctgtcagaggttcatggagcatggttaccaccttggctaatggcacaatatgctcgttatgcggaggttgtctcaggtcactggaatcaacatgggaaacctgctgtgcacaatgttttgcataaggcatcagaaaaatcancacaggcaaagaaatgggctgaacctcatatcgagactgctaagatgaaatggattcctgttaaacagaaattggttttcctcaagaaaaatgcagaaccttatgtacaaaaggtatcaacaagatcagtggagttttacgagtcatccaaggatgctgtgacacttcatgctgtcaaattaaaagtgttgttctttcttactaccagaaatcagaaattttctagccctacattgatcaaattgctgaaataac

SEQ ID NO: 71982 - protein, 144 aa, Zea mays
  misc_feature: Ceres CLONE 1554458
  misc_feature (61)..(61): Xaa is any aa, unknown, or other
MRLQLEVTAKSKQLSEVHGAWLPPWLMAQYARYAEVVSGHWNQHGKPAVHNVLHKASEKSXQAKKWAEPHIETAKMKWIPVKQKLVFLKKNAEPYVQKVSTRSVEFYESSKDAVTLHAVKLKVLFFLTTRNQKFSSPTLIKLLK

SEQ ID NO: 71983 - DNA, 639 bp, Zea mays
  misc_feature: Ceres CLONE 1554460
  misc_feature: Translation starting site: 186
  misc_feature: SWISSPROT Homolog: EC 2.1.1.146 (Iso)eugenol O-methyltransferase
  misc_feature (447)..(447): n is a, c, t, g, unknown, or other
  misc_feature (448)..(448): n is a, c, t, g, unknown, or other
  misc_feature (566)..(566): n is a, c, t, g, unknown, or other
  misc_feature (575)..(575): n is a, c, t, g, unknown, or other
tccccgcggtggcggccgctctagaactagtggatcccccgggctgcaggaattcgtctcacccctagaaaaaggaccttggcatagccgacgccatccacagccacggtggcaacgccaccctgccccagatagtttccagggccgcgctccacccgtccaagatcccctgcctgcgtcgcctcatgcgggtgctcacagccgccggcatcttcagcgccgcccaccgctcgccggacgacggcggcggcgagctcgtctatggactcacaccggcgtctcagctcttggttggcggctcttcaagcctggctcccttcatgtccctggtgttacaccaggtctacgtgtcgcctttccttggcctcggcacatggttacagcacgagcgctcagacccgaccctgtttgagatgacgcatgggctcactgcctgggaccctgatnngacacagccagccttcggcgagctctttcacaaggtatggtctgcgacagcagcttcgtcatgaacatcgtcgtcaaggagtgcggcgacgtcttccggggtctgagctcccttgtcnacgtcgccngagggcttgccgcggccgccctggctatctcgaccgcgttcccgcatgtccagtgcagtgtggt

SEQ ID NO: 71984 - DNA, 694 bp, Zea mays
  misc_feature: Ceres CLONE 1554461
  misc_feature: Encodes the peptide sequence at SEQ ID NO. 71985
cgcggtggcggccgctctagaactagtggatcccccgggctgcaggaattcgtctcacccctagaaaaaatagccagcgccaaccccggaaaggcggaaacccatcgcaactaatccccaaccccaaacctccaatccacccatcccctcctcatccactccgggcggccatggcctgctccttcgccgccgcgaccgtcgtctcttccgcccccaccccggccgccaggcccctcgccgctgccccgcagtccgtctctgtttcccgctccgcggtcgccaccgccgccaggccgctccgcctcgtcgcctccagatccgcgcgggccatcagactcgtcgcccgcgcccgccccctccatgacttgccgctggtcgggaacaaggcgccagactccccaccccaggccgtgttcgaccaaaaattcatcaacgtgaaagctctctgaatacatcgggaaaaaaatacgtcctttcggttcttctacccccttgaattccccctttgacctgccccaaacaaaaaattactggccttctgtggacagattttgaggaaattccgaaaaattttgaaacacgggagagttccttggatgtcctcctaattggacacaggttgagtccctcccccccctctgaaattgggctggccaacacataacccagaaaaatccttggtttggggcctttg

SEQ ID NO: 71985 - protein, 92 aa, Zea mays
  misc_feature: Ceres CLONE 1554461
  misc_feature: SWISSPROT Homolog: EC 1.11.1.15 Peroxiredoxin
MACSFAAATVVSSAPTPAARPLAAAPQSVSVSRSAVATAARPLRLVASRSARAIRLVARARPLHDLPLVGNKAPDSPPQAVFDQKFINVKAL

SEQ ID NO: 71986 - DNA, 658 bp, Zea mays
  misc_feature: Ceres CLONE 1554468
  misc_feature: Encodes the peptide sequence at SEQ ID NO. 71987
  misc_feature (463)..(463): n is a, c, t, g, unknown, or other
  misc_feature (491)..(491): n is a, c, t, g, unknown, or other
ggagctccccgcggtggcggccgctctagaactagtggatcccccgggctgcaggaattcgtctcacccctagaaaaatagcataggaggcaaagaagtacagagggagccagggaggaggcgggcagcagatacgcggcgtgacagacacccagggagggtgctgtttatccatgatgctccggctgaagatcgtcgtcggcgtccactcggtggtgctcccggttcctgttccaggcggctatggccgtggcgcctgcaacgcggcagtagagccctgctggcgccgcagccggaggccagcgctagcggcggcgggtggcctcgtcgcgaggcggccgaggcagagcgccacggtggtgatggcgctgaaggaggagccggagggcagcagccgccgcggcttcgccggcggcgggccgagctgggaccccgggctggagatccaagtccccttcgagcnaagaccggtgaacgagtactctgctctncaggatagcgccctctactcgtgggcggagctgagcccaggggtcttcttcccctcgcctcgcggcctggtgctcgtgaccttcactgtgctcgcggctccaattgccgccgcaagcttcaatcaggaaaagatccactccagtcctgctaccagctgggatcgggg

SEQ ID NO: 71987 - protein, 161 aa, Zea mays
  misc_feature: Ceres CLONE 1554468
  misc_feature (97)..(97): Xaa is any aa, unknown, or other
MMLRLKIVVGVHSVVLPVPVPGGYGRGACNAAVEPCWRRSRRPALAAAGGLVARRPRQSATVVMALKEEPEGSSRRGFAGGGPSWDPGLEIQVPFEXRPVNEYSALQDSALYSWAELSPGVFFPSPRGLVLVTFTVLAAPIAAASFNQEKIHSSPATSWDR

SEQ ID NO: 71988 - DNA, 648 bp, Zea mays
  misc_feature: Ceres CLONE 1554469
  misc_feature: Encodes the peptide sequence at SEQ ID NO. 71989
  misc_feature (368)..(368): n is a, c, t, g, unknown, or other
  misc_feature (371)..(371): n is a, c, t, g, unknown, or other
  misc_feature (374)..(374): n is a, c, t, g, unknown, or other
  misc_feature (375)..(375): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (391)..(391): n is a, c, t, g, unknown, or other
  misc_feature (518)..(518): n is a, c, t, g, unknown, or other
cgctctagaactagtggatcccccgggctgcaggaattcgtctcacccctagaaaaaaaaccaactcctacccggccgccgccgccgccggtacatgtaaaaaaaggcttcgagacctgcgagatgaacgcatcggagagcattcaacaaaccaaaaccgcataaccaaaatgttcagactagcgcgtggaacggcaaggaagctcatcctagcgctgcttacatgtctgtcgacggcgctgctgtacaggcagattctttcgctaccgcccaagatccccggcacgccgggtggtcctccggtgacggccaccattaccagggtcaattatttttccccccccccccgagggaaagaaggggggggnccnaannaaaatccccannntangtttcttcttttatacatgggaaccaacccccgcggagaggggggggctttcaaatttccacggaccttggttcaaaagctcggcggtttaacttgtggccctaccaaaagcccaccggaacgcacnaaaaaaacccccccccaggcccggacctgaggaggactttctccctcttaaattcccaaacgcctccaaaacaactttatctgggccccaattatccatccctcgattagcccccccagcgctctcaaag

SEQ ID NO: 71989 - protein, 125 aa, Zea mays
  misc_feature: Ceres CLONE 1554469
  misc_feature (68)..(68): Xaa is any aa, unknown, or other
  misc_feature (69)..(69): Xaa is any aa, unknown, or other
  misc_feature (72)..(72): Xaa is any aa, unknown, or other
  misc_feature (73)..(73): Xaa is any aa, unknown, or other
  misc_feature (74)..(74): Xaa is any aa, unknown, or other
MFRLARGTARKLILALLTCLSTALLYRQILSLPPKIPGTPGGPPVTATITRVNYFSPPPRGKEGGGPXXNPXXXFLLLYMGTNPRGEGGAFKFPRTLVQKLGGLTCGPTKSPPERTKKTPPQART

SEQ ID NO: 71990 - DNA, 651 bp, Zea mays
  misc_feature: Ceres CLONE 1554471
  misc_feature: Encodes the peptide sequence at SEQ ID NO. 71991
  misc_feature (625)..(625): n is a, c, t, g, unknown, or other
cgcggtggcggccgctctagaactagtggatcccccgggctgcaggaattcgtctcacccctagaaaaaattcgcaccaccgccgcgccgcccaaatcacagccaccgccgccatggccgcctccagccgccctctcgtctccgtgaaagccctggagggcgacatggtcacggacgcccccggcatcgccttgccgcccgtcttcggtgcgccgatccgcccggacgtggtccgcttcacccacaagctgctgtcctgcaacaagcgccagccttacgcagtctcccgccgcgctggccaccagacgtctgccgagtcctggggtacgggccgcgctgtgtcccgtatcccccgcgtccccggcggcggcacccaccgcgccggccagggagcattcggcaacatgtgccgcggcggacgcatgttcgcgcccaccaagatctggcgcaagtggcaccgccgcgtcaacgtcaacctccgccgcgtcgccgtcgcctcggcgctcgccgccaccgccgtcccggccctcgtccaggcgcgcggccaccgcatcgagaccgtcccagagatgcccctggtcatctccgactcggcggagtccatcgagaagacctccaggcgctncagatcttcagcaggtcggcgcctac

SEQ ID NO: 71991 - protein, 179 aa, Zea mays
  misc_feature: Ceres CLONE 1554471
  misc_feature (23)..(177): Pfam Name: Ribosomal_L4 Pfam Description: Ribosomal protein L4/L1 family
  misc_feature (171)..(171): Xaa is any aa, unknown, or other
MAASSRPLVSVKALEGDMVTDAPGIALPPVFGAPIRPDVVRFTHKLLSCNKRQPYAVSRRAGHQTSAESWGTGRAVSRIPRVPGGGTHRAGQGAFGNMCRGGRMFAPTKIWRKWHRRVNVNLRRVAVASALAATAVPALVQARGHRIETVPEMPLVISDSAESIEKTSRRXRSSAGRRL

SEQ ID NO: 71992 - DNA, 683 bp, Zea mays
  misc_feature: Ceres CLONE 1554473
  misc_feature: Encodes the peptide sequence at SEQ ID NO. 71993
  misc_feature (368)..(368): n is a, c, t, g, unknown, or other
  misc_feature (376)..(376): n is a, c, t, g, unknown, or other
  misc_feature (617)..(617): n is a, c, t, g, unknown, or other
gctctagaactagtggatcccccgggctgcaggaattcgtctcacccctagaaaaaacaaacaagtacaacaccatcccctctctaccttcttatctcttctcctcgtgcaccagcaacaaaggtggcaggcacagagagagctagctttggccaggcgtccacagcagccagcacaagatgtcgacggtggtcatgggggtggatcttgagtgccacaagtgctacaagaagatcaggaaggtcctctgcaaggtccaagacaacgtgagcatcaggaccatctcctacgacgagaataacaacacggtgacggtgtccgggcccttctatttctacccccccccccaagggggtcgccgggggacnccttcaanttcatcacccaaaatataccgtcaacaaggaacttccgccttccgccttggaccggggggcggagggtcaaatcccaaggtaaacaacagaaagcccggccaccttcccctcccggtaaatggggcccaaaaccaggggaaggcccaccggtcacacggcccctgccccccgacctgtgtaccaatagttctaaagcccactgcccgcttcaccaccacccgccccccggggcaaccccanacccggccccccggccctaggcgcccataccccccccccccactacttactcacccagacccttcc

SEQ ID NO: 71993 - protein, 168 aa, Zea mays
  misc_feature: Ceres CLONE 1554473
  misc_feature (66)..(66): Xaa is any aa, unknown, or other
  misc_feature (146)..(146): Xaa is any aa, unknown, or other
MSTVVMGVDLECHKCYKKIRKVLCKVQDNVSIRTISYDENNNTVTVSGPFYFYPPPQGGRRGTPSXSSPKIYRQQGTSAFRLGPGGGGSNPKVNNRKPGHLPLPVNGAQNQGKAHRSHGPCPPTCVPIVLKPTARFTTTRPPGQPXTRPPGPRRPYPPPPLLTHPDPS

SEQ ID NO: 71994 - DNA, 659 bp, Zea mays
  misc_feature: Ceres CLONE 1554474
  misc_feature: SWISSPROT Homolog: EC 3.6.3.14 H(+)-transporting two-sector ATPase
  misc_feature (60)..(60): n is a, c, t, g, unknown, or other
  misc_feature (62)..(62): n is a, c, t, g, unknown, or other
  misc_feature (100)..(100): n is a, c, t, g, unknown, or other
  misc_feature (117)..(117): n is a, c, t, g, unknown, or other
  misc_feature (121)..(121): n is a, c, t, g, unknown, or other
  misc_feature (125)..(125): n is a, c, t, g, unknown, or other
cggtggcggccgctctagaactagtggatcccccgggctgcaggaattcgtctcaccccntngaaaaaaaaaaaaaaaaaaaaaaaaaaaaaaaaaaaanaaaaaaaaaaaaaaaanaaanaaanaacctccagggcccttgagtccttttatgaaaagtttgatccaaatttcattgatattaggacaaaagcccgtgaggtgttgcaaagggaggacaatctaaatgaatttgtgcactttgttggaaaaaatgccctggcaaaatctgacaaaattaccctggagacagcaaagctactgaaagaaaattatttggcacaaaatgcatttaccccatatgataagttctgcccattctacaaatccgttgggatgaggcgcaatattattcacttcaacactttggcaaatcaggctggggaagcgggcacttggtactgaagggccaaaaaaaaacataaggggggtcaaaaaaaaaccgttggggggaactatttttatcccccaaaaatcccaaaaaattcgaaggaacctcgcccaaaagggaaaaaaaccttttgggccgggcaaaatttaaaaaaaccgggtttggaaggaccccccccccccggggtttttccccaaattctccaaaaaaaaaaaaggccccggtggaa

SEQ ID NO: 71995 - DNA, 646 bp, Zea mays
  misc_feature: Ceres CLONE 1554475
  misc_feature: Encodes the peptide sequence at SEQ ID NO. 71996
  misc_feature (646)..(646): n is a, c, t, g, unknown, or other
cgcggtggcggccgctctagaactagtggatcccccgggctgcaggaattcgtctcacccctagaaaaagctgcctccatcaaggagggacttcaaagatatctatgttgtatttgagctgatggatacagatctccaccaagtcatcaaggcaaatgatgatttaaccagagagcatcatcagttctttctctatcagatgctccgtgcactgaaatacattcatactgctaatgtttatcatcgtgatttgaagccaaagaatatattggccaatgctaactgtaaacttaaaatatgtgattttggattggcaagagtggcattcaatgacactcctacaacagtattctggacggattatgttgctacaagatggtatagggcccctgaactgtgtggatctttcttttctaagtattcaccagctattgacatatggagtatcggttgcatttttgcggaagtcttaactgggaagcctttgtttcctggaaaaaatgtggtccaccagttggatttgatgactgatctcttgggtactccatcacttgatacagtttctcgaaatcggaatgagaaggcaaagaaggatttgaatagcatgaggaaaaaacagccagtatcatttcccggaaggttcccn

SEQ ID NO: 71996 - protein, 175 aa, Zea mays
  misc_feature: Ceres CLONE 1554475
  misc_feature (1)..(174): Pfam Name: Pkinase Pfam Description: Protein kinase domain
  misc_feature: SWISSPROT Homolog: EC 2.7.11.24 Mitogen-activated protein kinase
MDTDLHQVIKANDDLTREHHQFFLYQMLRALKYIHTANVYHRDLKPKNILANANCKLKICDFGLARVAFNDTPTTVFWTDYVATRWYRAPELCGSFFSKYSPAIDIWSIGCIFAEVLTGKPLFPGKNVVHQLDLMTDLLGTPSLDTVSRNRNEKAKKDLNSMRKKQPVSFPGRFP

SEQ ID NO: 71997 - DNA, 644 bp, Zea mays
  misc_feature: Ceres CLONE 1554478
  misc_feature: Encodes the peptide sequence at SEQ ID NO. 71998
  misc_feature (614)..(614): n is a, c, t, g, unknown, or other
acccgcggtggcggccgctctagaactagtggatcccccgggctgcaggaattcgtctcacccctagaaaaagcggtgtgcaagtgcatgcagtcgtccatcacatcgatcgactggacacactgacaggatcgcaggattgacagcaagagccgcccgcaatggcctccgcctcgcgcctcgtgtccttcgccgcgctctgcctgtgcctgggggcggcgctccaggcggtccggggcgccaacgcggccgcccgcgccttcttcgtcttcggcgactccctcgtcgacaacggcaacaacaactacctgctcacggaggcgcgcgccgactcgccgccctacggcatcgacacgcccgaccaccgcgccacgggccggttcagcaacggcaagaacgtgccggacatcatcagtgagcacctcggcgcggagcccgtgctgccgtacctgagcccggagctcgacggcgacaagatgctcgtcggcgccaacttcgcgtccgccggcgtcggcatcctcaacgacaccggaatccagttcgccaacatcatccatatctccaagcagctgcgctacttcgagcagtaccagaagcgcctggccgcgctgatncgcccggaagcggcgtcccgcgtggtgcgc

SEQ ID NO: 71998 - protein, 161 aa, Zea mays
  misc_feature: Ceres CLONE 1554478
  misc_feature: SWISSPROT Homolog: EC 3.2.1.51 Alpha-L-fucosidase
  misc_feature (151)..(151): Xaa is any aa, unknown, or other
MASASRLVSFAALCLCLGAALQAVRGANAAARAFFVFGDSLVDNGNNNYLLTEARADSPPYGIDTPDHRATGRFSNGKNVPDIISEHLGAEPVLPYLSPELDGDKMLVGANFASAGVGILNDTGIQFANIIHISKQLRYFEQYQKRLAALXRPEAASRVVR

SEQ ID NO: 71999 - DNA, 710 bp, Zea mays
  misc_feature: Ceres CLONE 1554479
  misc_feature: Encodes the peptide sequence at SEQ ID NO. 72000
  misc_feature (710)..(710): n is a, c, t, g, unknown, or other
cgcggtggcggccgctctagaactagtggatcccccgggctgcaggaattcgtctccccctaaaaaaaaagagggtggagcccaagcttgctctggtccaggtggagttgccgccggaggacttccctgagaactggcaccccacgcccgatgacaacctggttatcagagcacccggaatgtacacactgaagatacctctaataacggaacacaccgcaatcgatgatgtctctgtctgggaatggactggctctgcccatgatgaatgggccccaagcgcctgaaaggttctccccttactttgggaagcccagtcgaataatgcgcgttaaaaaatttttttaacccccccccccccgggggggggggggggggaaaggttaaaaaaacaatgtttcccaaattggtttcccatatcatagaaaaccttcccccggggtgcccgggggggcccccacatgaaattcctttaaagaaccccgtatccattggaacccctctctaaaacaaaaattttttaaggggaaggggggcccccccccctatcctcataagagagcttgtgggtaaaacccctatatggataaaacaaccctcaaaattctcccaggggtggcgggaaatttgtgccccccccctgtcttgcgtgggccccatttttaaattcgctggtagttatggcgcggtacacccgctgtacagagatn

SEQ ID NO: 72000 - protein, 35 aa, Zea mays
  misc_feature: Ceres CLONE 1554479
MYTLKIPLITEHTAIDDVSVWEWTGSAHDEWAPSA

SEQ ID NO: 72001 - DNA, 660 bp, Zea mays
  misc_feature: Ceres CLONE 1554481
  misc_feature: Translation starting site: 171
  misc_feature (383)..(383): n is a, c, t, g, unknown, or other
  misc_feature (393)..(393): n is a, c, t, g, unknown, or other
  misc_feature (660)..(660): n is a, c, t, g, unknown, or other
gacggtggcggccgctctagaactagtggatcccccgggctgcaggaattcgtctcacccctagaaaaaaccctgttcccccgaagtcagagggggagaggaggctagggatagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggctgtggcggtggcggccgctctgtaccacgttgtgtcggggctcttcgcgggcccgcccccgccgccgccgcgtccaagggaggagcccgagacatatcccctccctcctcccgggggggggggggagggnctccgaggangacctcccgcagtacaacggctcccaacctaagaagcccttcctcatgggcctcaaaggccagaactacaacttcccccagagcaaagtggtccttgggacctggggggaacttaaccccctgttccccgggcaaaaagcccatcaaaactcctaccgaaaaatgcctttcccaccccccggaccctcctcggccaaattttctgggccctaggtcccttttgaacctccaaccccccggagggatggggggacacaagatcccaan

SEQ ID NO: 72002 - DNA, 641 bp, Zea mays
  misc_feature: Ceres CLONE 1554484
  misc_feature: Encodes the peptide sequence at SEQ ID NO. 72003
  misc_feature (641)..(641): n is a, c, t, g, unknown, or other
cgcggtggcggccgctctagaactagtggatcccccgggctgcaggaattcgtctcacccctagaaaaaaacacaaactaaaccacgcaatgcatgcagtggtcaagtcgtaccagtacacgtcgttgacgagcgtgatgctgctggactgctggtcgatcccgtgcgtcatcctgctcacctgggtgttcctcaagaccaagtacggggcgaggaagttcctgggcgtcggggtctgcgtgcttggcctcatcctggtcgtgttctcggacgtccacgcctccgaccgagccaaagggcctaacccgttgaagggcgacctgttcgtgatccttggttcgatgctctacgcctgcagcaatgtcaccgaggagttcgtcatcaagaaaagcaacagggtggagctgatggcgatgctggggcttttcggagcgcttgtcaacgccatacaaattagtgtacttgagcgagaagagcttcactccattacatggactagtggtgctgtgctccctttttctcgggttcgcggtagcaatgttcccgttctactcggcttgtgccagtaatatttgaagttatgccggggcgacccttgctgaacctctcggcccttgacctccgaacatgtggggctgtcn

SEQ ID NO: 72003 - protein, 159 aa, Zea mays
  misc_feature: Ceres CLONE 1554484
  misc_feature (1)..(160): Pfam Name: DUF914 Pfam Description: Eukaryotic protein of unknown function (DUF914)
MHAVVKSYQYTSLTSVMLLDCWSIPCVILLTWVFLKTKYGARKFLGVGVCVLGLILVVFSDVHASDRAKGPNPLKGDLFVILGSMLYACSNVTEEFVIKKSNRVELMAMLGLFGALVNAIQISVLEREELHSITWTSGAVLPFSRVRGSNVPVLLGLCQ

SEQ ID NO: 72004 - DNA, 642 bp, Zea mays
  misc_feature: Ceres CLONE 1554487
  misc_feature: Encodes the peptide sequence at SEQ ID NO. 72005
  misc_feature (574)..(574): n is a, c, t, g, unknown, or other
  misc_feature (591)..(591): n is a, c, t, g, unknown, or other
ggagctccccgcggtggcggccgctctagaactagtggatcccccgggctgcaggaattcgtctcacccctagaaaaaagatcgtctctcatccaacctgatcccattcacatccccttccgattctccgtcgcctgagcggctgagccaacttgccaagccaagcaagccaagtcgtcgcctccccgacccaacgccgcgacccccttgcccgtccgcgaccgctgcagcacctcggatcccgccccaatggcaacagcgtgtccgccgctctcgctgccgtccacctccctcttccgcggcaggtccgcccgcgccgggcccagacgcaggcagctcacggccgtccgctgcagcgccgtcggagaggcggtagtggaggaggcctcgcccaggacggcggaagagccgctgctggtgagcgcaatcagagggaggaaggtcgagaggccacccgtctggctcatgaggcaggccgggaggtacatgaagagctaccaattgctctgcgagcggtatccttcgttccgtgaaagatcagaaaatgtcgacctagttgttgagatctctttgncaccatggaaagttttncagcctgatggagtcatcttgttctcggacatccttactccacttcctggg

SEQ ID NO: 72005 - protein, 131 aa, Zea mays
  misc_feature: Ceres CLONE 1554487
  misc_feature: SWISSPROT Homolog: EC 4.1.1.37 Uroporphyrinogen decarboxylase
  misc_feature (109)..(109): Xaa is any aa, unknown, or other
  misc_feature (114)..(114): Xaa is any aa, unknown, or other
MATACPPLSLPSTSLFRGRSARAGPRRRQLTAVRCSAVGEAVVEEASPRTAEEPLLVSAIRGRKVERPPVWLMRQAGRYMKSYQLLCERYPSFRERSENVDLVVEISLXPWKVXQPDGVILFSDILTPLPG

SEQ ID NO: 72006 - DNA, 681 bp, Zea mays
  misc_feature: Ceres CLONE 1554490
cgcggtggcggccgctctagaactagtggatcccccgggctgcaggaattcgtctcacccctagaaaaaaggcctccctctcctctcgtccatccgttcctcccttcccctgcttcccggctctaccctcccccccatccctgcacgccccttttcgtgcgcgaggaggggccgtggggaccactaccagctgctccatccgcgcgcatctcgcggtggtgctcctcctcctcctccccctgctccgaggacggacgctctcctgtccctccctcctcctgctgatggtgccagggccgggagggcaccacgaacatgtcactcatgtagctcgcctgatacggatcggcagacaacgccaacctcagtactaagtgaaaatgggctgttcagttatggatgccccagatctccccggcaaagagcatcgagggaaggatcttctattaaagcaaggatagacgacgttgacggagagaaagttggaatgtatggggtgtaagatggccaaggaagaatcaaattaagtgaaataggttaggcaacaccttttcctgggattttagtcgaaacccccaaaggtttcttcactggatacccaaggcccggtttttgcttaaaacctttccaacccgaacaaaatttccaaaatttccggaaaagcctggataggaaccccca

SEQ ID NO: 72007 - DNA, 674 bp, Zea mays
  misc_feature: Ceres CLONE 1554495
  misc_feature: Encodes the peptide sequence at SEQ ID NO. 72008
  misc_feature (1)..(1): n is a, c, t, g, unknown, or other
ncgattgggtactcgagcgcccccgagccctgcagtggtaaaggagacgcaatacacatacagcccctcttgcccacagccccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccggtgctgccggtagcgccagtagcaacagcaccgtggattcgagcggtggcggtagcggctgtggcatccaggcgcctatgcaggccatgccgcttcctccggctctcgatctcgacctcttccatcggggcgccgccgtgaacgcagtctccaccggcatgcgggtttccgttcaagggctatcctgtcgcctgcccgaccccacagcagtacttttttctacaagcagggcggctgccgca

SEQ ID NO: 72008 - protein, 180 aa, Zea mays
  misc_feature: Ceres CLONE 1554495
  misc_feature (32)..(83): Pfam Name: AP2 Pfam Description: AP2 domain
MAPRVADKSPLPPATGLGLGVGGGVGGVGMGPHYRGVRKRPWGRYAAEIRDPAKKSRVWLGTYDTAEEAAKAYDSAAREFRGAKAKTNFPFPSQCSVASGAAGSASSNSTVDSSGGGSGCGIQAPMQAMPLPPALDLDLFHRGAAVNAVSTGMRVSVQGLSCRLPDPTAVLFSTSRAAAA

SEQ ID NO: 72009 - DNA, 671 bp, Zea mays
  misc_feature: Ceres CLONE 1554496
  misc_feature: Encodes the peptide sequence at SEQ ID NO. 72010
cgattgggtaccgggccccccctcgagccctgcagtggtaaaggtgaagagatatcacagggacctcttcaggcttcaaggcagatccgcagcagatggaggggaagagcaggctgccggaggtgaccatcgtcccggcggcacggccgttggctggcgatggcacaggcgacgcggcgaaggcggcggcgggcaaggagcccgtaagcccgggcactccgtcctcggtggccgccggccgcagcagctgtgaggagaggcgcgcggtggacggcgtcaccctgcctgggtggaagctcgacgccctctgccaggagtcctgcccgtcgccggccatgagggcgcgcttcccctactacttctgaagctttcccgttgcagtcatgcgtgagttcttgagcggcgacatctggtgcatgctcttgacgactgatggtgttcttgggtgttttccttgctcacgggttcccttacgttcatgtatgtatgtatggatgtattggggggtttaaagatctgtggatcttttgtgtataacgcaaacgatgaaccttcgggtaactgcgtggtatgggttgtatacggtctatcctgacataaatttgagcaaaaaaaaaaaaaaaaaccagaagctctggggaattcctgccagcccggggggaatccactat

SEQ ID NO: 72010 - protein, 89 aa, Zea mays
  misc_feature: Ceres CLONE 1554496
MEGKSRLPEVTIVPAARPLAGDGTGDAAKAAAGKEPVSPGTPSSVAAGRSSCEERRAVDGVTLPGWKLDALCQESCPSPAMRARFPYYF

SEQ ID NO: 72011 - DNA, 544 bp, Zea mays
  misc_feature: Ceres CLONE 1554498
  misc_feature: Encodes the peptide sequence at SEQ ID NO. 72012
  misc_feature (416)..(416): n is a, c, t, g, unknown, or other
cgattgggtacgtggccccccctcgagccctgcagtggtaaaggcgccgccacttccctcccgacccactatcccaaaaccgtagcgccctcgcctgctcgccgccgccgtcgttgcgagctccccatcttcctccgtcaaccatggcgacccagatcagcaagaagaagaagttcgtcagcgacggcgtgttctacgccgagctcaatgagatgctgacgcgggagctcgcggaggacggctactccggcgtggaggtgcgcgtcacaccgatgcgcacggagatcatcatccgcgccacgcgcacgcagaaagtgctcggcgagaagggcgcaggatcagggagctcacgtctgtcgtccagaagagggtcacttccccgagacggcgtcgagctctacgccgagaaggtcgtncaccggcggcctctggcgcattgggggaggggttgagtccctcccgcttacaagcctccttcggaagggcctttgccttcccgggagggggcccggcccttggggggggtcccttcccccttttgggt

SEQ ID NO: 72012 - protein, 102 aa, Zea mays
  misc_feature: Ceres CLONE 1554498
MATQISKKKKFVSDGVFYAELNEMLTRELAEDGYSGVEVRVTPMRTEIIIRATRTQKVLGEKGAGSGSSRLSSRRGSLPRDGVELYAEKVVHRRPLAHWGRG

SEQ ID NO: 72013 - DNA, 663 bp, Zea mays
  misc_feature: Ceres CLONE 1554500
  misc_feature: Encodes the peptide sequence at SEQ ID NO. 72014
cgattgggtacggggcccccctcgagcactgcagtggtaaggggtgggacggcgagaccgtggtgtatgcgcaccgcacgcgggagctagtgcgactgccgcggggcgtcgcgctgcccgtgacgctaggcccactccagtatgaggtgttccatgtgtgcccgctccgcgccgtcgtgccgggggtctcgttcgcgccccgtcgggctgctcgacatgtttcacgccggggggcgccctttgagagtgcgacgtgatcagcgatgacggcggcaagggcatgggctctcaggtttcgcggtgcggtcggtttcgcgcttactgctcgcgggagcccggcgaggtgcctattggactcggcggaaggtggagtttcagctacgatgcccgacacccgggctcgtgtccgtcgacctgcccgtgccggagcaggagctatcccggtggacgctggagattatggtctaggccgtgacgctgtgcgccgacgccaacgcttgccttcgcgtctgacccattctgagccggacgacactgtcatttgctatgtgcacgagagatagatgtattgtggtgttgtataattagtatggagagcctgctcggtcggccagtggatgagcgcgctgcccaccgagcgcgtgccgtcgaaacgcagcgggc

SEQ ID NO: 72014 - protein, 84 aa, Zea mays
  misc_feature: Ceres CLONE 1554500
IGYGAPLEHCSGKGWDGETVVYAHRTRELVRLPRGVALPVTLGPLQYEVFHVCPLRAVVPGVSFAPRRAARHVSRRGAPFESAT

SEQ ID NO: 72015 - DNA, 607 bp, Zea mays
  misc_feature: Ceres CLONE 1554507
  misc_feature: Encodes the peptide sequence at SEQ ID NO. 72016
  misc_feature (244)..(244): n is a, c, t, g, unknown, or other
  misc_feature (269)..(269): n is a, c, t, g, unknown, or other
  misc_feature (586)..(586): n is a, c, t, g, unknown, or other
cgaattgggtaccgggccccccctcgagccactgcagtggtaaaggtcctgcatatcgacgcagagtcgcagtcgcagcacacactgatattctctttagctagctaagagagggtagccacaccaagacaggatgcacacagcgaaggtgaaggcgaaggacatggtgagctcggcgaacgagaaggtgaaggaggcgtctgccaagatgcagggtcagacgggcgaggcgactgcagccacncaccgcgagaaggagatgggctacngagcggccccgcacaataaaggaccaaggccacgccttatcagcccatgaagaagcccgaccaaccaagcggaccccggccctgggccacccagggaacagggggttggcccctttacagttcccccagggggcaaccacgggggttgggggggggccccttaaacccccccgtatgcccctcctccggggggaaaaaaaaaaacccccgggggtttggggggaaaaaaaaactttttggggagaaaatttctcccctttataaaaaaacaaaagcccccgggggttttttgggggtccccccccccccctcccggnttttttttttttggggggggc

SEQ ID NO: 72016 - protein, 61 aa, Zea mays
  misc_feature: Ceres CLONE 1554507
  misc_feature (46)..(46): Xaa is any aa, unknown, or other
MHTAKVKAKDMVSSANEKVKEASAKMQGQTGEATAATHREKEMGYXAAPHNKGPRPRLISP

SEQ ID NO: 72017 - DNA, 662 bp, Zea mays
  misc_feature: Ceres CLONE 1554516
  misc_feature: Encodes the peptide sequence at SEQ ID NO. 72018
ccgattgggtacgtggccccccctcgagccctgcagtggtaaagggcaagaatttccctgcccgaaatcgaaagcacccgcaccaatctctgcgtctcttcgtcttcggctgcgcggcgggcggcagcagcggaggaggttgaggagatgctgtccggcgacatccccccgaaccagaccatctacctcaacaacctcaacgagaaggtcaagaaagaagaattgaagagatcgctttatgccttgtgctcacagtatggaaggatactggatgtggtggccctgaaaacacaaaaattgagagggcaagcatgggtggcgtttagcgaaattacagctgctaccaatgctttccgtggattgcaagatttcgatttctatggcaaaaaaatgcgagtacaatatgcaaaaacaaaatcagactgtattgcaaaagaagatggtacttatgcacctaaggagaaaaggaagaagcaagaggagaaagctgctgagaaaaaacgacgaacagaagaggcacaacaagctggcctcaatgctgctgctgcccaaagcaatggaactgacaaggaagctttcagaagtaaggaaaaaattactcgagttcttgggagctgatcaaccgtggggcaggaactgcagcttcttttagtgaaactacc

SEQ ID NO: 72018 - protein, 156 aa, Zea mays
  misc_feature: Ceres CLONE 1554516
  misc_feature (12)..(84): Pfam Name: RRM_1 Pfam Description: RNA recognition motif. (a.k.a. RRM, RBD, or RNP domain)
MLSGDIPPNQTIYLNNLNEKVKKEELKRSLYALCSQYGRILDVVALKTQKLRGQAWVAFSEITAATNAFRGLQDFDFYGKKMRVQYAKTKSDCIAKEDGTYAPKEKRKKQEEKAAEKKRRTEEAQQAGLNAAAAQSNGTDKEAFRSKEKITRVLGS

SEQ ID NO: 72019 - DNA, 561 bp, Zea mays
  misc_feature: Ceres CLONE 1554527
  misc_feature: Encodes the peptide sequence at SEQ ID NO. 72020
  misc_feature (446)..(446): n is a, c, t, g, unknown, or other
  misc_feature (482)..(482): n is a, c, t, g, unknown, or other
cgaattgggtaccgggccccccctcgagccctgcagtggtaaaggtagctccatcagtttcagttccaccctcacgcttcattcacgatttagctccacctcaaagtcctcggcttgtcaccgtccttctgccgacctccatcggtcgtcgacacacaggccgcgatcgaatcagttgaattgaagccgaaatcctgaaacggcgcgcatggcgggctacggcgacgacggcgtggacctcaccgagctgacgctggggccacccggcgtcagtgcgcgcaaggcgagacgagcgaggaagaacggccagcagccgtcgtcgtccgccatgacgatgcaagcgttcgtgaaggtgagcatgacgggacgccgtacctcaggaagtggacgtggccgcgtacgacgactacggcgagctcgtggaagcgctcaacgagttgttctgnctgctgcctccatcggggctggatggacggcttacnggcgaagtggggaagcacgcccttgggtgtaccaaggaaccggcgaacggccaacggggatgcctcgttcgggcgaacc

SEQ ID NO: 72020 - protein, 117 aa, Zea mays
  misc_feature: Ceres CLONE 1554527
  misc_feature (80)..(80): Xaa is any aa, unknown, or other
  misc_feature (92)..(92): Xaa is any aa, unknown, or other
MAGYGDDGVDLTELTLGPPGVSARKARRARKNGQQPSSSAMTMQAFVKVSMTGRRTSGSGRGRVRRLRRARGSAQRVVLXAASIGAGWTAYXRSGEARPWVYQGTGERPTGMPRSGE

SEQ ID NO: 72021 - DNA, 697 bp, Zea mays
  misc_feature: Ceres CLONE 1554529
  misc_feature: Encodes the peptide sequence at SEQ ID NO. 72022
  misc_feature (452)..(452): n is a, c, t, g, unknown, or other
  misc_feature (461)..(461): n is a, c, t, g, unknown, or other
  misc_feature (485)..(485): n is a, c, t, g, unknown, or other
  misc_feature (497)..(497): n is a, c, t, g, unknown, or other
cgattgggtaccgggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggatgcggcggcggcggctacggtggtggccgtggtagcngcggctacngcggtggcgggcgccctgatggcngcggcggctacngcggtggccgcggcggctaccgtgccggcggtggctacggtggtgggtggtgggggctaccggcgtggcaaacggtgcggggggctacggcaactccgaaggggaactgagagaactgagcggggggggccccccccggccaattttcccgggtcccctaccggggtgttttcccctagtccaaagggttttccttcctc

SEQ ID NO: 72022 - protein, 154 aa, Zea mays
  misc_feature: Ceres CLONE 1554529
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (104)..(104): Xaa is any aa, unknown, or other
  misc_feature (107)..(107): Xaa is any aa, unknown, or other
  misc_feature (115)..(115): Xaa is any aa, unknown, or other
  misc_feature (119)..(119): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSRGGRGCGGGGYGGGRGSXGYXGGGRPDGXGGYXGGRGGYRAGGGYGGGWWGLPAWQTVRGATATPKGN

SEQ ID NO: 72023 - DNA, 639 bp, Zea mays
  misc_feature: Ceres CLONE 1554530
  misc_feature: Encodes the peptide sequence at SEQ ID NO. 72024
cgattgggtacgggcccccctcgagccactgcagtggtaaaggggacttccgccgcgcttcgccctctcgctccagccgcttcacagcgccgccgctcgcctctccgaccgccgcgagaatgccgttcaagaggttcgtggagatcgggcgcgtggcccttgtgaactacggcaaagactacggccgcctcgtcgtcatcgtcgatgtggtcgaccagaacagggcacttgtggacgcccctgatatggtcaggtgccagattaacttcaaacggctctcacttaccgacatcaagattgacatcaaacgtgtccccaagaagtcaaccttgatcaaggctatggaggaagctgatgtgaagacgaagtgggagaacagctcatggggcaagaagctgattgtccagaagaggagggctgcgctcagtgactttgacaggttcaaggtcatgctggcaaggatcaagaggggtggtgctatcaggcaagagctcgccaagctgaagaaggcgtccacggcttaagtccattttggtggatgacatgttagtttttggtttcatgttggatcagcaatttgttttgagtgttgtcaaagccagaattagtaatatgtttcctgtgtacccgtttcaaact

SEQ ID NO: 72024 - protein, 134 aa, Zea mays
  misc_feature: Ceres CLONE 1554530
  misc_feature (44)..(120): Pfam Name: Ribosomal_L14e Pfam Description: Ribosomal protein L14
MPFKRFVEIGRVALVNYGKDYGRLVVIVDVVDQNRALVDAPDMVRCQINFKRLSLTDIKIDIKRVPKKSTLIKAMEEADVKTKWENSSWGKKLIVQKRRAALSDFDRFKVMLARIKRGGAIRQELAKLKKASTA

SEQ ID NO: 72025 - DNA, 853 bp, Zea mays
  misc_feature: Ceres CLONE 1554531
  misc_feature: Encodes the peptide sequence at SEQ ID NO. 72026
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (78)..(78): n is a, c, t, g, unknown, or other
  misc_feature (80)..(80): n is a, c, t, g, unknown, or other
  misc_feature (81)..(81): n is a, c, t, g, unknown, or other
  misc_feature (83)..(83): n is a, c, t, g, unknown, or other
  misc_feature (306)..(306): n is a, c, t, g, unknown, or other
acaaccaacagcttgatgagggaaaagaaggagcccacctgcaagggaagtaaagattggggaannnnnntttttttntnntnccgattgggtacgggccccccctcgagccctgcagtggtaaaggactcgctcccccacacagaaaaccctagccgccgccaccgaagcggcctcccaggtaagcaagagcgtccaccccgccgccgccatgaagcgcaatccccgcgtcacgagctctcgccggaagtgccgcaaggcgcacttcacggccccgtcctccgtccgccgtcgttctccatgtcngccgggctgtcgaagagctcgcacagtacaagtgcgctcatcccatcgcaagaccagagtgcaggtcggcgcggaccttcaagggcctgaagggaagggggtgcaggggtaccccccccccgggggcattcccccccccagcgggatccccccgggaaaggggggaaagggggtttccgccccccccaccggggggggaattcccacccccctccaacaggggggaatgttgtaaaaccccaaaagcgggtggagagacctcggccaccaagggggcccccccccggaaagggggggggttccctcccttgtgcacaccccaaaaaaaggggtctttgggggggggcgccccccccccccccccgagaaaaaaagagggttcttaaagggggcgactatttttttttgtggggcgccgaaaaaaaaagagggtaacattctcacaacccccaccgcggtggggggggggacgcccccccccccaagggggggagtacttcttcttccgtgggagaaaagacaacaaataaaggcgcccctccccccc

SEQ ID NO: 72026 - protein, 109 aa, Zea mays
  misc_feature: Ceres CLONE 1554531
  misc_feature (32)..(32): Xaa is any aa, unknown, or other
MKRNPRVTSSRRKCRKAHFTAPSSVRRRSPCXPGCRRARTVQVRSSHRKTRVQVGADLQGPEGKGVQGYPPPGGIPPPSGIPPGKGGKGVSAPPTGGGIPTPLQQGGML

SEQ ID NO: 72027 - DNA, 666 bp, Zea mays
  misc_feature: Ceres CLONE 1554532
  misc_feature: Encodes the peptide sequence at SEQ ID NO. 72028
cgattggggtccgggccccccctcgagccactgcagtggtaaaggccgagtccgccggcgcatggcaaccccaccacaacccagcgccggcagtcgccgtcatcgatcgatcgccggaaaactaacccctaacgatgtctggagccggcgaggaggacaagaagcccgcggagggcggcgcccacatcaaccttaaggtcaagggacaggatggcaatgaggtgttctttcgcataaagaggtccacccagctgaagaagctgatgaacgcttattgtgaccgccagtctgtggacatgaatgccattgcgttcctgtttgatggccgcaggcttcgcggcgagcagacccctgatgagctggagatggaggacggcgacgagatcgacgccatgcttcaccagaccggaggcagcgttcctagcaccacctaaaagcctcgttttgctctccgtcctgcgtagtactaaacaaaagggaaaaagtctttttaaggaacttgtgatgctctggctccttgtgccattgctgagggacatccttagcctttgtttagtagtatggtttggtactttgttctgtcatcactcgtttatctatccctaatacatgccgccatgattgtactcccaaaaaaaaaaaaaaaaaaccagagctctgggaatt

SEQ ID NO: 72028 - protein, 99 aa, Zea mays; identical to SEQ ID NO: 19564
  misc_feature: Ceres CLONE 1554532
  misc_feature (21)..(91): Pfam Name: ubiquitin Pfam Description: Ubiquitin family

SEQ ID NO: 72029 - DNA, 654 bp, Zea mays
  misc_feature: Ceres CLONE 1554536
  misc_feature: Encodes the peptide sequence at SEQ ID NO. 72030
  misc_feature (13)..(13): n is a, c, t, g, unknown, or other
cgattgggtacgngccccccctcgagccactgcagtggtaaaggggtcgaacggaccaggccatcacgttatctagaaagctctcatgctcttccatttctaggctagcctaggtctggaccaagtatcaatcgattcataagaggaggaggccatcgaaacaagtagaaggcagtcacggcaatacaacgaaagctggtgaacaactttgtcaagcctcaagagctcatggaagatggcagtgctccaagacggtctactccacccacccgcagaagcagatctgctgagttccacaatttttcataaaggaggagaagggataagatcaacgagaagctgacagcattacaggagcttcttccaaactgcaacaagaccgacaaagtttcgatgctagacgaagcaatcgactacctaaaatcacttcagctacagcttcacatgctggtcatggggaagggaatgtcaccagtggttcctcttgagctgcagcaatacatgcattacatcacggctgaccctgcccagttgcctccgttgagcccctccggccagcagccccgacaattacagataactcaagccgatcctcagcgacaatctaacgtcgagtcggatttcttgagccagatgcagaacttgcactcttct

SEQ ID NO: 72030 - protein, 87 aa, Zea mays
  misc_feature: Ceres CLONE 1554536
MLDEAIDYLKSLQLQLHMLVMGKGMSPVVPLELQQYMHYITADPAQLPPLSPSGQQPRQLQITQADPQRQSNVESDFLSQMQNLHSS

SEQ ID NO: 72031 - DNA, 637 bp, Zea mays
  misc_feature: Ceres CLONE 1554538
  misc_feature: Encodes the peptide sequence at SEQ ID NO. 72032
cgattgggtaccgggccccccctcgagccactgcagtggtaaagggaagcattcaagcatcggcagtcgacgctgcagcaggaagccaaagaggagagaatccatcgagtcgaccaccgagcacggtcagggcggcggggctcgccgtggccacagctcaggaatccaatcccccactcctcaccggcgcccgcgctctggctacttcctacgccaccaccgcccgctccggcctcgggctcctcgagcaagctgccatggctgccgccgcgctgagggagcagctcaacgccctcctctcctccatgttcgcctcgggtctggtggacgagcagttccagcagctgcagatgctgcaggaagacgggggcacgccgggcttcgtcgccgaggtcgtcaccctcttctgcgacgacgccgacaggatcatctccgagctcgccgctctgcttgagcagcccatcgtggactttgataaggtggacgcctacgtgcatcagctcaaagggagcagcgccagtgttggcgcccagaaagtgaagtttacttgcatgcagttccgtcagttatgtcaggataagaacagagacgggtgcatcatggcattggctgttgtgagaaatgagttctatgatct

SEQ ID NO: 72032 - protein, 126 aa, Zea mays
  misc_feature: Ceres CLONE 1554538
  misc_feature (45)..(123): Pfam Name: Hpt Pfam Description: Hpt domain
MAAAALREQLNALLSSMFASGLVDEQFQQLQMLQEDGGTPGFVAEVVTLFCDDADRIISELAALLEQPIVDFDKVDAYVHQLKGSSASVGAQKVKFTCMQFRQLCQDKNRDGCIMALAVVRNEFYD

SEQ ID NO: 72033 - DNA, 788 bp, Zea mays
  misc_feature: Ceres CLONE 1554545
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (279)..(279): n is a, c, t, g, unknown, or other
  misc_feature (317)..(317): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttttttttnggcgaattggggtaccgggtccccccctcaagccacgncagtgagtaaaggtcgctagtcacggaaacggaactcatcccgctgtgcgcttcgtttcgtggcggcgaacggccggtcgagcgccgccgcccttggctgggtcttcactcagtccttcgccggcgacgagcgtccacctggtgtctactgaactgagcagacagtagcaagagccactatgctgttcttctcctacttcaaggagctccgtgggggaaaggaggtgacggtgggaaactcaagaaatgaacctggccgattccccggggaaagcttcaatttgggtaaaaaccagtacccctcaaaattcaaaagcctgggaaaaaacccccccccccttttttccgacccgggaaaaaagtttttccccccccaaatgccttgtccaagggggcgaaaaaatggggtttaaatctccggggggcccctcctggggggggcccaaaaaaagggggggggggtccccccca

SEQ ID NO: 72034 - DNA, 694 bp, Zea mays
  misc_feature: Ceres CLONE 1554549
  misc_feature: Encodes the peptide sequence at SEQ ID NO. 72035
  misc_feature (171)..(171): n is a, c, t, g, unknown, or other
  misc_feature (313)..(313): n is a, c, t, g, unknown, or other
  misc_feature (694)..(694): n is a, c, t, g, unknown, or other
cgattgggtaccgggccccccctcgagccactgcagtggtaaagggctgctgtctgtttgttgtgttagggtttcgtctcgtgtataaggcgttcggagctcgcaaatcctttcctctctcgcgttcgaggctaggtagccgttaccatgagccgctcggggcagcctccnggatctcagaagtacatggacaagaagcttcagattaagatgaatgcaaaccgtgttgttatcggcacacttcgtggattcgaccagttcatgaatctggtggtggacaacattgtggaggtcaatggaaatgacaaaacanatattggaatggtggttatcaggggaaacagtgttgtaatgatcgagggtcttgtagccccctccgaggggggggggagggattgttctttaccactagcaccctgaaaactgatgtaaaagatatcattggaccctgttgtatttgaataatgcttttgcccagcaacctaaccttccaaggtggaaatggctatcccctttttcttaggggatgctttgtacctaaaaaaaaaaaaaaaaaaaccccgaaccgctcgggaatttccctcccgccccggggggaatcccctttttttcgtaaagcgcgccccccccccccgcgtggagaacctccccccctttctggttcccccccttaaggacggacggataaattttn

SEQ ID NO: 72035 - protein, 90 aa, Zea mays
  misc_feature: Ceres CLONE 1554549
  misc_feature (8)..(72): Pfam Name: LSM Pfam Description: LSM domain
  misc_feature (56)..(56): Xaa is any aa, unknown, or other
MSRSGQPPGSQKYMDKKLQIKMNANRVVIGTLRGFDQFMNLVVDNIVEVNGNDKTXIGMVVIRGNSVVMIEGLVAPSEGGGRDCSLPLAP

SEQ ID NO: 72036 - DNA, 657 bp, Zea mays
  misc_feature: Ceres CLONE 1554550
  misc_feature: Encodes the peptide sequence at SEQ ID NO. 72037
cgattgggtaccgggcccccctcgagccctgcagtggtaaaggctgcgcctgcgtgcgtgtgctcgcctcccaccctccccgcactagctctgcgctttccctggcagtcgtcccttgttcctgacttcctgcctgtgcgcatccggccaccttctatccgcccgccagtccccgctggcctccgcggatcatctgcctgggatcaagatccgtcgaggccgaggcacccgcgcaccaaagatcgtttcttgatctaaatttgggtggtcgtagggatcaaagctcggttctctgcggtgcagttgagagggcaccaatattcttggcatggtggctgacacggaaagctcagattcactgcctggcagttcaaatgctgcttctgagatgcctgctaatgggtctattcaccgaaagtctcaggaaaagccccccaaaaaaacacataaagctgaacgagagaagcttaaacgtgatcagttgaatgacctttttgttgagctcggcagtatgctaggatcgctgcctggcagatcgtgaaccatttcttctgattacgtctatggttgttgccatgaaaagaactgctaatctctctacaaaattcttcaaaattaatgtatggttaagctattaatactacgctgtactttgaa

SEQ ID NO: 72037 - protein, 70 aa, Zea mays
  misc_feature: Ceres CLONE 1554550
MVADTESSDSLPGSSNAASEMPANGSIHRKSQEKPPKKTHKAEREKLKRDQLNDLFVELGSMLGSLPGRS

SEQ ID NO: 72038 - DNA, 667 bp, Zea mays
  misc_feature: Ceres CLONE 1554553
  misc_feature: Encodes the peptide sequence at SEQ ID NO. 72039
cgattgggtaccgggccccccctcgagccctgcagtggtaaaggatgaatccgttaagtagatagaccgacccgtcactcctgtgatgaaagaagcccgatgcttggtgcgttctgctgccaaggatgttcgtcacggccgcctgctgggaacagccactggacttggccagtcagccatcgtccccccacagcctaatggctcaggagctctacacttcttctacgaacctgtgccagaactgcgtgcccccgaggcataggtagtcctgaagcttctgcctctggtgccctcggtcacgagtggcatcctccccactgacagacatctctcagccagtgactattccagcggtgcgacatggtgtccactgcgcgaacgctctgcacatctatctccttcttgtgcccactgagcggctcccccgcctgttcaagtaccccgtggcacaagttgctgaaacaccagatatgcagccttttccttcacatctaacatgagatgcaatgtgaactgcataaaccaatatacagaaccatcactgtgtgttaccgcttcataccttatcgtgaactcctgcctgactacagatagcctcattcgtttttgttgtgctcaccctacaagaattactctttgctttatcgctaacatatctaacattatt

SEQ ID NO: 72039 - protein, 58 aa, Zea mays
  misc_feature: Ceres CLONE 1554553
MKEARCLVRSAAKDVRHGRLLGTATGLGQSAIVPPQPNGSGALHFFYEPVPELRAPEA

SEQ ID NO: 72040 - DNA, 649 bp, Zea mays
  misc_feature: Ceres CLONE 1554556
cgattgggtccgggccccccctcgagcctgcagtggtaaaggtttccgcttgtgcttttgcatgggccgagaaaaaaaatgacttccatattgtctcacccttctcacatcatacaaagagatgttcaaagagttcgtcgtccgtacaagttaagggaagctatgcttttgcactgccgtgatatctcagcatgctgtcagtgttggaatgaccattgtttaatttgcccgagtttcgttttaatggctgagcccatgctgtcagtggtgagaatgatcgttgtttattctgcccgagtcccgtttcaattgtgcgcatttcggtgggatgtttaacaaaaaaacgttgtcttcgaccgacgggtagtttgcactactgatgacttgtactgttttttatcttgatcaagggcttgctgcatgggttctttcaaaaaaaaaaaaaaaaaaacccgagctctggaaattcctgtagcccggggggaccccttttttttaaagggccccccccgggggggacccccccctttttttcccccttttaaggggtttatttcaagcgtggggaaaaaggggaaaaagtgttttcccgggggaaaaattttttccccccaaaattccccccccaaaatgggggggggaattttat

SEQ ID NO: 72041 - DNA, 554 bp, Zea mays
  misc_feature: Ceres CLONE 1554559
  misc_feature: Encodes the peptide sequence at SEQ ID NO. 72042
  misc_feature (288)..(288): n is a, c, t, g, unknown, or other
cgattgggtaccgggccccccctcgagccactgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgacactccctcacaacgccttcagcactacggcgaggtctcgagtccagatatcctcgatcggagacgcaaggtccgcggctcngcttctcacttctcagcgaggaggcgatgcggaacgcctcgagggcctgaaccgcaaggacttgacggccccacatcacgtcaacgaggcccatcccgcggggccccgaagcggcggggcggttccgtggtgcccttgaaggcgcggttccgcggggcgggccccttatggggcggcgcttccggggggcggggggggctccgggggggggggggctccggggggggggggggcgctccccgggggggaaaccgtgggggggggtt

SEQ ID NO: 72042 - protein, 136 aa, Zea mays
  misc_feature: Ceres CLONE 1554559
MAASDVEYRCFVGGLAWATDDTPSQRLQHYGEVSSPDILDRRRKVRGSASHFSARRRCGTPRGPEPQGLDGPTSRQRGPSRGAPKRRGGSVVPLKARFRGAGPLWGGASGGRGGLRGGGGSGGGGGAPRGGNRGGG

SEQ ID NO: 72043 - DNA, 641 bp, Zea mays
  misc_feature: Ceres CLONE 1554562
  misc_feature: Encodes the peptide sequence at SEQ ID NO. 72044
  misc_feature (277)..(277): n is a, c, t, g, unknown, or other
cgattgggtaccgggccccccctcgagccactgcagtggtaaaggtgaggcctgctcccctgccgccgccgccatgggacactccaacgtgtggaactcgcaccccaagaactacggccctggatctagggtttgccgtgtgtgcgctaacccccacggcttgatccgaaagtacgggctcatgtgctgcagacagtgcttccgcagcaacgccaaggacattggcttcatcaagtaccgctgagacttggggagctccaagcatggcaataatggnagcatggatggggacctaaaagatagtctgtactcttatttctactataaaaccatggaattgatttgttgggcttgggttgaccaagttgggtggattccggatgggacccttggaatcttgaagcctccctggccatggctactgagcctggccaaaccccttttgatccaaaacatccgtttcccggtgtccccctttaaaaaaaaaaaaaaaaaaccccaaatcctggggaatttcccggaccccgggggaccccctatattttaaaagggccccccccccgggggggaaccccgctttttttcccccttttgggggggtttatttttgggggtgggggggaaaaaaggggcataatttt

SEQ ID NO: 72044 - protein, 56 aa, Zea mays; identical to SEQ ID NO: 1999
  misc_feature: Ceres CLONE 1554562
  misc_feature (3)..(56): Pfam Name: Ribosomal_S14 Pfam Description: Ribosomal protein S14p/S29e

SEQ ID NO: 72045 - DNA, 609 bp, Zea mays
  misc_feature: Ceres CLONE 1554566
  misc_feature: Encodes the peptide sequence at SEQ ID NO. 72046
gggtaccgggccccccctcgagccactgcagtggtaaagggctaggggagcttgggttcagttatggtgatatgcctgttcacaatcttctgtggagggagtgtgcaaagtcctcaagtgacgtttctgcacgattggcagtgattcctttggtccaggaagccagaggcctcgatgctggaccaaggttagtccaaaggttatctggttttggggaccatcgatctgcagacatcgtggcaagagtagcagaggaagagcttgcacatgtttctgtaggtttgtattggtttctcaaagtatgccaaatgatgggtcgtgaaccaggcgatactttcaaagacttgataaaggaatacggtgttgtactgaagggtccatttaactatccggctcgtgatgaagctggtataccccgagaatggtatgacgagaagttcaaacaagaagcagcacaaaaactttcagaggtccatgatagattagcttgtattgttgagatggagaaagagagtgcaagtttgaatgactaagtggcacttatgtacatgggagattgggttttgtctggctggagtggaaactgggaagattacgaatcatcaaagt

SEQ ID NO: 72046 - protein, 176 aa, Zea mays
  misc_feature: Ceres CLONE 1554566
  misc_feature (1)..(150): Pfam Name: DUF455 Pfam Description: Protein of unknown function (DUF455)
VPGPPSSHCSGKGLGELGFSYGDMPVHNLLWRECAKSSSDVSARLAVIPLVQEARGLDAGPRLVQRLSGFGDHRSADIVARVAEEELAHVSVGLYWFLKVCQMMGREPGDTFKDLIKEYGVVLKGPFNYPARDEAGIPREWYDEKFKQEAAQKLSEVHDRLACIVEMEKESASLND

SEQ ID NO: 72047 - DNA, 656 bp, Zea mays
  misc_feature: Ceres CLONE 1554571
  misc_feature: Encodes the peptide sequence at SEQ ID NO. 72048
cgattgggtccgggccccccctcgagccctgcagtggtaaaggtgctttctcagaggcgggttggcttctcctcccccaccggttcgtgttcaggttctggttcgtgggcgagagggaagagatggcggcgtccgacgttgagtaccgttgcttcgttggcggcctctcctgggccaccgacgaccactccctcaacaacgccttcagcacctacggcgaggtcctcgagtcgaatatcatcctggatcgggagacgcacaggtcccgcggcttcggcttcgtcaccttctcctcggaggacgcgatgcgcagcgccatcgagggcatgaacggcaaggagctcgacggccgcaacatcaccgttaacgaggcccagtcccgcggcggccgcggaggcggcggtggcggatactgtggcgggcgccttgatggaggcggctacagcggtggcggtggcggctactgaggtggtcgtggaggctaccgcggcggcggtgggggatacggtggtggaaaccgctgcggcagctaccgcaacaacgactggaactggaggaactgagcggtgaggtccgctgaggcctagttatcttgttcgcttctgctaccgtgttcaccctagtctagatggggtttatcttcgtctgtggtcgtc

SEQ ID NO: 72048 - protein, 114 aa, Zea mays
  misc_feature: Ceres CLONE 1554571
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLSWATDDHSLNNAFSTYGEVLESNIILDRETHRSRGFGFVTFSSEDAMRSAIEGMNGKELDGRNITVNEAQSRGGRGGGGGGYCGGRLDGGGYSGGGGGY

SEQ ID NO: 72049 - DNA, 654 bp, Zea mays
  misc_feature: Ceres CLONE 1554577
  misc_feature: Encodes the peptide sequence at SEQ ID NO. 72050
  misc_feature (431)..(431): n is a, c, t, g, unknown, or other
gggtaccgggccccccctcgagccctgcagtggtaaaggctgccactccactcctaccccacacagaagcggcggcggcggagcaaaagcaggcgaaggcgagggtgcgagggaaggtgcaccagccatggtgcacgtcaacttctaccgcaactatggtaagacgttcaagaaaccaaggcgtccttatgagaaggagcgtcttgatgctgaactgaagctggtcggtgagtatgggctgaggtgcaagcgtgagcttttggaggtccagtatgcactgagcaggatccgtaaatgctgcaggcacttgctcacccttgacgagaagaacccccctcgtatctttgaaggttgaggcgcttctttcgcgcatgaaacccttatgggctgcttgctgaagggtcaaaaccagctttgattaagtccttggnctctcccgctgaaaaatttcctcggagggggggtttcaaacccttttctttcaaggttgggatggggcaaaggccaattccccagggtccgggtttttgaacaaccaccggtcccctccaggggttggggggggcaaatttgccacacttccatcattcctgggggagggggggggaggctttagaaaagaccctttggcttttttcctcgggaaaagcccct

SEQ ID NO: 72050 - protein, 75 aa, Zea mays
  misc_feature: Ceres CLONE 1554577
  misc_feature (7)..(76): Pfam Name: Ribosomal_S4 Pfam Description: Ribosomal protein S4/S9 N-terminal domain
MVHVNFYRNYGKTFKKPRRPYEKERLDAELKLVGEYGLRCKRELLEVQYALSRIRKCCRHLLTLDEKNPPRIFEG

SEQ ID NO: 72051 - DNA, 934 bp, Zea mays
  misc_feature: Ceres CLONE 1554579
  misc_feature: Encodes the peptide sequence at SEQ ID NO. 72052
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (33)..(33): n is a, c, t, g, unknown, or other
  misc_feature (38)..(38): n is a, c, t, g, unknown, or other
  misc_feature (89)..(89): n is a, c, t, g, unknown, or other
  misc_feature (90)..(90): n is a, c, t, g, unknown, or other
  misc_feature (96)..(96): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (696)..(696): n is a, c, t, g, unknown, or other
  misc_feature (809)..(809): n is a, c, t, g, unknown, or other
  misc_feature (810)..(810): n is a, c, t, g, unknown, or other
  misc_feature (811)..(811): n is a, c, t, g, unknown, or other
  misc_feature (812)..(812): n is a, c, t, g, unknown, or other
  misc_feature (813)..(813): n is a, c, t, g, unknown, or other
  misc_feature (828)..(828): n is a, c, t, g, unknown, or other
tttttttcnnnccttccnnnnnnnnnnncttcncttcnctgtcttcccggtcacggtgaaaggaaggggaaggagagagagaataaaanntttttntnnnnncccgaattgggtacggggccccccctcgagccactgcagtggtaaaggagacgcccaagtcgatcgccatggcgatgaagccggcggcggcggctccccctaccccggccgcggcgcacagcgtgttcgtctacggcagcctgatggcggacgaggtggtccgcaccatcctcaagcgcgtcccgcccgccgccccggccctcctcccaaactaccaccggttcaacatcaagggccgcatttacccggcgatcctgcccgttgagagcaagagagttgctgggagggttatcatgggtgttactgatgaagagctccagcttcttgacgcgtttgaagacgtggagtacacgaaggacaagagttgagatatcatttggctggactctttccgagaaacatgctgggctgacacccccccctgtggaagtggaatgcagaagggaacctcaaaatccttttattggaaaaaaatgggaaatttttttgaagggaagtggggaaaagaaaaacctggccccccattggaaatgggggatttttttccctttggggccaaaattgggaacccaaaaaacagggggtttttttttntttggggacacccacaaaaccactcctcaaagacacagaacccatattaaaataccccgcaaaagaaacacccccccggggggagggggaaaaaaaaacacccactccccccnnnnnggggggaaagtattntgtatttgggccaaaaaaatcaacccagggtggaaaaaataaagactctcttggaccgccccccggggggtggaaacaccccaatgggtttttgattataaagagg

SEQ ID NO: 72052 - protein, 99 aa, Zea mays
  misc_feature: Ceres CLONE 1554579
  misc_feature (19)..(100): Pfam Name: AIG2 Pfam Description: AIG2-like family
MAMKPAAAAPPTPAAAHSVFVYGSLMADEVVRTILKRVPPAAPALLPNYHRFNIKGRIYPAILPVESKRVAGRVIMGVTDEELQLLDAFEDVEYTKDKS

SEQ ID NO: 72053 - DNA, 664 bp, Zea mays
  misc_feature: Ceres CLONE 1554584
  misc_feature: Encodes the peptide sequence at SEQ ID NO. 72054
cgattgggtacgggcccccctcgagccctgcaatggtaaaggggtcacccggttggctgaccccgctgctctcgtctcctctcctcggagactgcggtgacggcgtctgccgaggagaccgacagctccccgcccacactggtgcgagcacgtgatatcgggtctgcttggcggcccgtctgcgaatgtatataacgctgccgaccgtcagccgcatgacctgacttgtgcctcactgctcaaacctctccgatcccctgcccccgcccccggtctcccgccgccgagcagcatgctaatggcgctgcctggaatggcactggagtcggctcctatcgcctggaccacgctaccaagatgttcctcccctcacggcgcgcgcggactgcggctgggctgcacgacacggggctggggctcactccactccttcttcgccagtctgccatgagtcgcatctgcgagattgggatgagacattcatcatgccgccgctgatgggatgcggaaccctagtcgacggtgctctctcgcgcactgtcgtagcttgtatgtatgacagtgctgtctactggactaggcgcgattgttccgaatttgaaaccatagaaccgcacgaccgtcgggacgacaggccactgcggattttttgggctcccggtgc

SEQ ID NO: 72054 - protein, 46 aa, Zea mays
  misc_feature: Ceres CLONE 1554584
MFLPSRRARTAAGLHDTGLGLTPLLLRQSAMSRICEIGMRHSSCRR

SEQ ID NO: 72055 - DNA, 650 bp, Zea mays
  misc_feature: Ceres CLONE 1554591
  misc_feature: Encodes the peptide sequence at SEQ ID NO. 72056
cgattgggtaccgggccccccctcgagccctgcattggtaaaggggagacgagacacgtcacgttacgatccccaacttaacgccgaccggaggccggagagaccggctcagcctcgctccgccgccgctggcgaacatgtccatggcggctatcttcgtcttcctcatcgtgtccgcgctgcagctgctcgatcgctacctcgacctcgccagagagagcggaggacttagtgatgagcagatcaaagtgcggcttgaaatcaagcaacttctcaaggaggctgatcagttgtcaacgccgtccacatttgcacaagctgctaaactcaagcgcctggctgctgccaaggagaaggaactggcaaaaatgcacgaacatgaccttaaagggaagcaatccttatacgacaaatacacaaaatttttgttggttactaaggtcataatttatgctgtgctcgttctgtgcttttggagtactcctgtaactgcagttccacaacatcttctacagaccttctgaaaaatgttttcctggaggagtgttgatactgccccccgcaatgttgtgggtaggatactccccgtggctgttttttgacctctcaggtcagcaagatgctgtgccagaaactccgctttcatgctt

SEQ ID NO: 72056 - protein, 128 aa, Zea mays
  misc_feature: Ceres CLONE 1554591
MSMAAIFVFLIVSALQLLDRYLDLARESGGLSDEQIKVRLEIKQLLKEADQLSTPSTFAQAAKLKRLAAAKEKELAKMHEHDLKGKQSLYDKYTKFLLVTKVIIYAVLVLCFWSTPVTAVPQHLLQTF

SEQ ID NO: 72057 - DNA, 633 bp, Zea mays
  misc_feature: Ceres CLONE 1554595
  misc_feature: Encodes the peptide sequence at SEQ ID NO. 72058
cgattgggtccgggcccccctcgagccctgcagtggtaaaggggttattgacgattggtccccgtttcggtggagcaattgatgatgcagcccgatacttcaaagatgcatgtgataggagcctcacgccatacgagtttgttgaaggcatgaaaaagaagggaatccgtgtgcctgggattggtcacaggattaagagcagagacaacagggataagcgtgtgcagcttctacagaaatatgctcacacacatttcccttcagtcaagtacatggaatacgctgttcaggttgagacctacaccttgtcaaaagccaacaatttggttatgaatgtcgatggtgcgatcgggtcccttttcttggatcttctatctggaagtggaatgttcaccaaacaggagatcgatgagattgtggagatcggttatctcaatgggctctttgtgcttgcacgatcaattggcctgatcgggcataccttcgaccagaagaggctcaagcagccactctaccgtcacccatgggaggatgtactttacaccaagtgagaaagccattctttgcaaggcataataaagtattattatcgcctagagcttccagttgcctgtacacttcattaaatcgagc

SEQ ID NO: 72058 - protein, 182 aa, Zea mays
  misc_feature: Ceres CLONE 1554595
  misc_feature: SWISSPROT Homolog: EC 2.3.3.8 ATP citrate synthase
IGSGPPSSPAVVKGLLTIGPRFGGAIDDAARYFKDACDRSLTPYEFVEGMKKKGIRVPGIGHRIKSRDNRDKRVQLLQKYAHTHFPSVKYMEYAVQVETYTLSKANNLVMNVDGAIGSLFLDLLSGSGMFTKQEIDEIVEIGYLNGLFVLARSIGLIGHTFDQKRLKQPLYRHPWEDVLYTK

SEQ ID NO: 72059 - DNA, 634 bp, Zea mays
  misc_feature: Ceres CLONE 1554598
  misc_feature: Encodes the peptide sequence at SEQ ID NO. 72060
tgggaccgggccccccctcgagccactgcagtggtaaaggtcgcgccgccgctcctctcacaacccagtcgctcaaaaccctagagctctcgcctgctcgcctccgccgccggagcgagctccccatcttcatccgtcaaccatggcgacccagatcagcaagaagaagaagttcgtcagcgacggtgttttctacgccgagctcaatgagatgctgacgcgggagctggcggaggatggctactctggcgtggaggtgcgcgtcacgccgatgcgcacggagatcatcatccgcgccacgcgcacgcagaacgtgctcggcgagaagggccgcaggatcagggagcttacctccgtcgtccagaagaggttcaacttccctgagaatggcgtcgagctttacgccgagaaggtcgtcaaccgtgggctctgtgccatcgcgcaggccgagtccctccgttacaagctcctcggaggccttgccgtccgcagggcttgctatggtgttcttcgttatgttatggagagtggtgccaagggttgtgaggtgattgtgagtggaaagctcagggcccaaagagccaagtccatgaagttcaaggatggctacatgatctcatctggtcagccagtg

SEQ ID NO: 72060 - protein, 164 aa, Zea mays
  misc_feature: Ceres CLONE 1554598
  misc_feature (45)..(102): Pfam Name: KH_2 Pfam Description: KH domain
  misc_feature (104)..(164): Pfam Name: Ribosomal_S3_C Pfam Description: Ribosomal protein S3, C-terminal domain
MATQISKKKKFVSDGVFYAELNEMLTRELAEDGYSGVEVRVTPMRTEIIIRATRTQNVLGEKGRRIRELTSVVQKRFNFPENGVELYAEKVVNRGLCAIAQAESLRYKLLGGLAVRRACYGVLRYVMESGAKGCEVIVSGKLRAQRAKSMKFKDGYMISSGQPV

SEQ ID NO: 72061 - DNA, 694 bp, Zea mays
  misc_feature: Ceres CLONE 1554599
  misc_feature: Encodes the peptide sequence at SEQ ID NO. 72062
  misc_feature (281)..(281): n is a, c, t, g, unknown, or other
  misc_feature (303)..(303): n is a, c, t, g, unknown, or other
cgattgggtacgggcccccctcgagccctgcagtggtaaagggagaaagtaaagcggtcgagcagcggtagccggtaggcgagagagtcaggattcaggacgcggcgaggccaccatgagcactctcaagttctgccgggaatgcaacaacatgctgtacccgcgggaggacaaggagacgcgcaccctcctgtacgcgtgccaaacatgcgagcatgaggagattgccactgatacttgtgtgtacaaaagggttatcccgtagcctggtggtgagcccnaagatgtcctgaaggatgcagncactgatcctagcctgcctcgcaccagaagcgtcagatgttatcactgcaaacaatcagaaaactgtctttttttcaggcccccaacttaagggaaaacaagcccttgacccctgtactttcatctggctggaaaaccaaagcttgggggccccaggttggaagggaccttaaaaaagaattctgggctttgggtctttcccctggaaaaacctgccccctttttgtttacccccttaggaacaaaatttttggcccccaccaccagtaaattttttgctcgccaaccctttttataaacccccttttataaacccccccaaaaaaaaaaaaaaaatatgtgttttgggggttggagaaaacaaaaaaattttttgttttttttccctctt

SEQ ID NO: 72062 - protein, 49 aa, Zea mays
  misc_feature: Ceres CLONE 1554599
  misc_feature (4)..(48): Pfam Name: RNA_POL_M_15KD Pfam Description: RNA polymerases M/15 Kd subunit
MSTLKFCRECNNMLYPREDKETRTLLYACQTCEHEEIATDTCVYKRVIP

SEQ ID NO: 72063 - DNA, 635 bp, Zea mays
  misc_feature: Ceres CLONE 1554603
  misc_feature: Encodes the peptide sequence at SEQ ID NO. 72064
  misc_feature (1)..(1): n is a, c, t, g, unknown, or other
ncgattgggtaccgggccccccctcgagccctgcagtggtaaaggcgaatcctccaatctgcccttgccgccgccaccgcaaccgcccgatccaggtccgcagactgctcactcctcctctccgctccgaatggcccgcacgaagcagacggcgcgcaagtcgaccggcggcaaggcgccgcggaagcagctggccaccaaggcggcgcgcaagtcggccccggccacgggcggcgtgaagaagccgcaccgcttccgccccggcaccgtcgcgctccgcgagatccgcaagtaccagaagagcacggagctgctcatccgcaagctccccttccagcgcctcgtccgcgagatcgcacaggacttcaagacggacctgcggttccagtcctcggccgtggcggcgctgcatgaggccgcggaggcgtacctggtggggctcttcgaggacaccaacctctgcgccatccacgccaagagggtcaccatcatgcccaaggacatccagctcgcccgccgcatcatgggcgagagggcttgagctgtcgcgctgctgctgttcgtcgttgtaacgtctgaagtagatgatggtgggtgctttctatgccgtgcctatttggctatttcggacgtgt

SEQ ID NO: 72064 - protein, 136 aa, Zea mays
  misc_feature: Ceres CLONE 1554603
  misc_feature (58)..(132): Pfam Name: Histone Pfam Description: Core histone H2A/H2B/H3/H4
MARTKQTARKSTGGKAPRKQLATKAARKSAPATGGVKKPHRFRPGTVALREIRKYQKSTELLIRKLPFQRLVREIAQDFKTDLRFQSSAVAALHEAAEAYLVGLFEDTNLCAIHAKRVTIMPKDIQLARRIMGERA

SEQ ID NO: 72065 - DNA, 654 bp, Zea mays
  misc_feature: Ceres CLONE 1554607
  misc_feature: Encodes the peptide sequence at SEQ ID NO. 72066
cgattgggtacgggccccccctcgagccctgcagtggtaaagggttatttacacattttcaatttcgtactgggcgactgggcgtagggcgagctgagctcccaagtcgacgtggcggggatggctgcgacggccggcgtcggcggtggtggaggggctaacgcggcggtggcagagcagatagcacaggcagtgcggtccacctccaatctcctccagctcatggagcagtcctcccccgctcaggttcacttggcaaaactacccaagaacctgttggaaaaagcatcctttgcaaagaacacggagcatgtactgcaccagctacctcaagtaatttcatccttggatgcttatatggacaggagtttgcaaagtgcatctcaaattaagactgtcacacagctcttgtcaaacatggagaagacacagctgaagtccatgttgccttcctctcgaaggaaggaagatcagaagagtactgaacccttaagaactcagggttgattgacgtcaccgagacatagtggaaggataagcttttgccgtcttatgctagagagatctgagtatgatggtttggctgattggctctatgcatctatctggcataaggatccatcgctgcctaccgtttgcgccacattttaaaat

SEQ ID NO: 72066 - protein, 128 aa, Zea mays
  misc_feature: Ceres CLONE 1554607
MAATAGVGGGGGANAAVAEQIAQAVRSTSNLLQLMEQSSPAQVHLAKLPKNLLEKASFAKNTEHVLHQLPQVISSLDAYMDRSLQSASQIKTVTQLLSNMEKTQLKSMLPSSRRKEDQKSTEPLRTQG

SEQ ID NO: 72067 - DNA, 557 bp, Zea mays
  misc_feature: Ceres CLONE 1554610
  misc_feature (116)..(116): n is a, c, t, g, unknown, or other
cattgggtccgggcccccctcgagccctgcagtggtaaaggggggcgccagcgtctcgcctcgccgtcagcagcagcagcagctgcacctccattccacggcttccgtcgtgcgcnttcgtctgcaccccacaaaggctgactggcgtacgggcaagggggaagagatgagctgaagcactggaggcctctttggtgcctgaccagtctccgacccaaagctgagcttgagcatatgcgacggccctcacatcgcgtcccggatgctctacatgcagagaaatggttcaatgacctaactggcaaagggggtacctgaccttccggcttgggctgtggcactttggctttgggcaaaggcttttatcgggatgcctaaaaaggtttcttgggaatttgaaatttgcccccccacttccttttaaatttttcttcaaaaaaattctcttttattttgggagtcgggaaacccctttttttttttgggcccggccaaaaaaaaatttttttttttttaagggggccccctttttaaaagttggtgcgacaaaacccccc

SEQ ID NO: 72068 - DNA, 651 bp, Zea mays
  misc_feature: Ceres CLONE 1554611
cgattgggtacggggcccctcgagccctgcagtggtaaaggtttgctggtaaattatctcttggctccgtgtgttccctgtggctgtctgtctataatttatgttcattattttgttccggagaccgaagaatctgaggacttgtatgtatctgggatcaagatgtgaatctcgcatgtaccagatgacagaactgttaagacttatatttgtctgaggttaaactgcaagacttttatttaagctagaactttgatcactataggatatggcatgatatagcagggctcttgagatgcattctcttgtgcgtgcttggtaactgtagtcgtgcaactgttgacggcgtttgttcagaacaagtggttgatgaatttgaagatggtttagggagtgggaatgattttgtttgtgtgcgtgcgaacttgtaaaatctccgtgtatgaactggcaatgcttttatggtattgatcatctgcggtgtgttaactgagtgcaaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgttt

SEQ ID NO: 72069 - DNA, 721 bp, Zea mays
  misc_feature: Ceres CLONE 1554614
  misc_feature: Encodes the peptide sequence at SEQ ID NO. 72070
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (580)..(580): n is a, c, t, g, unknown, or other
  misc_feature (611)..(611): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnntttttttttttttcgattgggtacgggccccccctcgagcccgcagtggtaaagggcggtggaataatatgccaaccatctctctccggtccggtccggagcggttgaagctaagcgagagtcaactaccgccgccctctctctagtccagatttccagcggtccagaccgagagctcggctccctacacgacatcatcatggacgccgccccgctcctcgctctcctcctcgcggccgtgtccctctccgcggcggcggcgggcgacggcgcgcacccgggctactccgacgagggcacctgcacggtggacgccgccggagcgggcgtgggctcgggcccggagctgcggcgcctggaggagcgccggcccgggcgcatcatcgacatcacgcacgcgtacgtgccggaccttctggcgttcgcgccgggggctgtcacggggcccttggtccacctcaaggagtccatggcgaacgggtccgagtacaacctgtcggagctngcggttaggagtgccacatggggcacccacngtcgtacgcgcccaggcccacatgaaaccaaagggcctactttccgcccgcccgggcccttcgaaccgtgggacaaccgctcccgaacccttcgtaccgtccccttcaaa

SEQ ID NO: 72070 - protein, 149 aa, Zea mays
  misc_feature: Ceres CLONE 1554614
  misc_feature (113)..(113): Xaa is any aa, unknown, or other
MDAAPLLALLLAAVSLSAAAAGDGAHPGYSDEGTCTVDAAGAGVGSGPELRRLEERRPGRIIDITHAYVPDLLAFAPGAVTGPLVHLKESMANGSEYNLSELAVRSATWGTHXRTRPGPHETKGPTFRPPGPFEPWDNRSRTLRTVPFK

SEQ ID NO: 72071 - DNA, 671 bp, Zea mays
  misc_feature: Ceres CLONE 1554618
  misc_feature: Encodes the peptide sequence at SEQ ID NO. 72072
  misc_feature (402)..(402): n is a, c, t, g, unknown, or other
acgattgggtacgggccccccctcgagccctgcagtggtaaagggagagcaaacgagaaggacgccggagaccgagaagcaatctctcctccccccggccagccgaccgaccgaccgaccgaccgacccatggaccgccgtcctgctctcgccgtctctccgcgccgcctccgcccgcgcccgccccgggtgccccgcccgcccctcgtgccagcctcctccgtgcaaacgcctccaggatcgatgaagaaggcggcggctccgatgcgcgcgtccgtctgcgcgatcccgtcgccggtccgcttcgagcccagcccgatgcgcgcctccatctccgctctcccgtcgccgatccgcgccgaaccgagccctatgcgcgcgcgcgtgaccgccgcgctccanccaccaagtcgcgtcaagctcgacctggctgcgtcgtcgcctcctccggcaagggcggcggccgacaaggagaacttcctcctcgccgcggctccgtcgtccccctcggcgagggtggggttcgacaaggagaacctcctcccggccggcgcggacgcccacgacgagcttgtggcgctcaacctcgccgcgattgccaggacagcgggcacgccgtctggtggcccgctcttcgtgcggggcagactctacgacctctactcggcgcg

SEQ ID NO: 72072 - protein, 180 aa, Zea mays
  misc_feature: Ceres CLONE 1554618
  misc_feature (91)..(91): Xaa is any aa, unknown, or other
MDRRPALAVSPRRLRPRPPRVPRPPLVPASSVQTPPGSMKKAAAPMRASVCAIPSPVRFEPSPMRASISALPSPIRAEPSPMRARVTAALXPPSRVKLDLAASSPPPARAAADKENFLLAAAPSSPSARVGFDKENLLPAGADAHDELVALNLAAIARTAGTPSGGPLFVRGRLYDLYSA

SEQ ID NO: 72073 - DNA, 581 bp, Zea mays
  misc_feature: Ceres CLONE 1554619
  misc_feature (54)..(54): n is a, c, t, g, unknown, or other
  misc_feature (151)..(151): n is a, c, t, g, unknown, or other
  misc_feature (156)..(156): n is a, c, t, g, unknown, or other
  misc_feature (157)..(157): n is a, c, t, g, unknown, or other
  misc_feature (162)..(162): n is a, c, t, g, unknown, or other
  misc_feature (196)..(196): n is a, c, t, g, unknown, or other
  misc_feature (212)..(212): n is a, c, t, g, unknown, or other
  misc_feature (213)..(213): n is a, c, t, g, unknown, or other
  misc_feature (219)..(219): n is a, c, t, g, unknown, or other
  misc_feature (220)..(220): n is a, c, t, g, unknown, or other
  misc_feature (351)..(351): n is a, c, t, g, unknown, or other
cgattgggtccgggccccccctcgagccctgcagtggtaaaggaagttgctccnggtcgtcaccgtctccgaggagccggcgccggaagcggcgaaggaggtggtggagaagccggaggaggggaagaagcccgacgaggagggtgacgangaggnnaaagnaaaaagggggcccccggaaaccccccccccgggnccccgggcccgggagnnaagggnnagaagaaggcgagtaagccgcggtagcaggaaagccccaaggtcccgcccggggcttgcaccacccccgccctattttcgagatgatcaaggaggcgatccttgtcccaagacggcggtgaagtcggggcnagccctttcccatttcccagccaatggggggaaaccccccgggatctttttccccccccattttccccccaagggtgcttgggatgttaaattttgcgggttttttccccccacaggggccgccccttcccaagaggaaagggtttttcttttaaaccccccccccccccaggaagaagaaaaccccccccccgccccccccaaagggaaaaaaaaaagggggccccccg

SEQ ID NO: 72074 - DNA, 667 bp, Zea mays
  misc_feature: Ceres CLONE 1554643
  misc_feature: Encodes the peptide sequence at SEQ ID NO. 72075
cgattgggtacgggccccccctcgagccctgcagtggtaaagggctggcgctgacggcctccgtggtggggctggccgtggccacgccggtgttcctgatcttcagccccgtgctggtccccgccgcgctgctcatcgggacggccgtcatggggttcctcacgtcgggcgcgctggggctcgggggcctgtcctcgctcacgtgcctcgccaacacggcgccgcaggcgttccagcgcaccccggactacgtggaggaggcgcgccgcaagatggcggaggccgcggcgcacgcgggccacaagaccgcgcaggcaggccaggccatccagggcagggcgcaggaggccggcgccgggggaggagcaggtgccggcgctggcggcggcggcagggcttcctcgtaagcaagtcatccatgcatggatggatgcgcccttgcgtgtctgtcagtatcagcagggtcgtcgcggaatgctgtgttcctgtacgtgtgggtgaccgtcctttggtcgtctttctccctcgagtgtgtgttacgtatgtcctggtgttcgtcgtgtgtgtgcatcgccgctccagttgaattccggtgtgtgttcatcgccgctccaggtcggagatgtgaatatactttgctaggggaataagtcataagtctgtctgc

SEQ ID NO: 72075 - protein, 134 aa, Zea mays
  misc_feature: Ceres CLONE 1554643
  misc_feature (7)..(109): Pfam Name: Oleosin Pfam Description: Oleosin
IGYGPPLEPCSGKGLALTASVVGLAVATPVFLIFSPVLVPAALLIGTAVMGFLTSGALGLGGLSSLTCLANTAPQAFQRTPDYVEEARRKMAEAAAHAGHKTAQAGQAIQGRAQEAGAGGGAGAGAGGGGRASS

SEQ ID NO: 72076 - DNA, 528 bp, Zea mays
  misc_feature: Ceres CLONE 1554647
  misc_feature: Encodes the peptide sequence at SEQ ID NO. 72077
tgaagagatactgtatcacaggaacctcttcaggcttcaaggcaggtccgcagcagatggaggcgaagagcaggctgccggaggtgaccatcgtcccgacggcacggccgttggctggcgacggcacaggcgacgcggcgaaggcggcggcgggcaaggagcccgtaagcccgggcactccgtcctcggtggccgccggccgcagcagctgtgaggagaggcgcgcggtggacggcgtcgccctgcctgggtggaagctcgacgccctctgccaggagtcctgcccgtcgccggccatgagggcgcgcttcccctactacttctgaagctttcctgttgcagtcctgcgtgagttcttgagcggcgacatctggtgcatgctcttgacgactgatggcgttctcttgggtgttttccttgctcaggattttcctttcgtgcacgttcatgtatgtatgtatatgtatgtatttatgtattgtggggtataaagatctgtgagctttgtgtaaaaaaaaaaaaaaaaaa

SEQ ID NO: 72077 - protein, 89 aa, Zea mays
  misc_feature: Ceres CLONE 1554647
MEAKSRLPEVTIVPTARPLAGDGTGDAAKAAAGKEPVSPGTPSSVAAGRSSCEERRAVDGVALPGWKLDALCQESCPSPAMRARFPYYF

SEQ ID NO: 72078 - DNA, 720 bp, Zea mays
  misc_feature: Ceres CLONE 1554657
  misc_feature: Encodes the peptide sequence at SEQ ID NO. 72079
ccactgcagtggtagtacacagcatcatcaatcgacgcaagcgcaaccacctcctcccctcgtgatccagccctgccccgcttcgtctagttgacatcatttcccttgcgccttcttgccagcaatccatccaatccatccatcgtgatcacctggcaaccaaaatgtcaaccgccatcgccccaagattgtccgtccccaaatcctccggggcaagctaccggaccgccgctccggcgcccaagacggccctctccttcgtcgccggccacaagaggcagcaggcgctgccccgcgcgcgtctgtccagcaggaggaccggcactgcggacggcgcggagcacgagttcgaggcccccgaggacacctacatcctggaggcggccgagagcgccggcgtggagctgcccttctcctgccgcgccgggtcctgctccacctgcgccgggaagatgtcggccggcgaggtcgaccagtcggagggctcgttcctcgacgacggccagacggccgagggctacctcctcacctgcatctcctaccccagggcggactgcgtcatccacacccacaaggaggaggagctgtactagtagagttttgagtcgcttatatatgcgcgagtcagtgtttgtggcgaatgcagtgaactgatttgcataccaaggtcacatacgagaaataatttattccaacaattccatacaaaaaaaaaaaaaa

SEQ ID NO: 72079 - protein, 142 aa, Zea mays
  misc_feature: Ceres CLONE 1554657
  misc_feature (53)..(129): Pfam Name: Fer2 Pfam Description: 2Fe-2S iron-sulfur cluster binding domain
  misc_feature: SWISSPROT Homolog: EC 1.14.13.7 Phenol 2-monooxygenase
MSTAIAPRLSVPKSSGASYRTAAPAPKTALSFVAGHKRQQALPRARLSSRRTGTADGAEHEFEAPEDTYILEAAESAGVELPFSCRAGSCSTCAGKMSAGEVDQSEGSFLDDGQTAEGYLLTCISYPRADCVIHTHKEEELY

SEQ ID NO: 72080 - DNA, 628 bp, Zea mays
  misc_feature: Ceres CLONE 1554667
  misc_feature: Encodes the peptide sequence at SEQ ID NO. 72081
cgattgggtaccgggccccccctcgagctactgcagtggtaaaggcgtttgtctttcgctgactgattggtgtggttcttccagaggatcaccgagatggccggaatcgtcctctccctcgacccgaagccgatcaagggcgactggaacggcgccggcgcccacaccaactacagcaccaagtcgatgagggaggccgggggatacgaggtcatcaaggcggcgatcgacaagctggggaagaggcacaaggagcacatcgccgcgtacggcgagggcaacgagcgccgcctcacgggccgccacgagaccgccgacatcaacaccttcaaatggggcgtggcgaaccgcggcgcgtccatccgcgtcggccgcgacaccgagagggagggcaagggctacttcgaggaccgcaggccggcgtccaacatggacccctacgtcgtcaccggcatgatcgccgagaccaccatcctgtggaatggaaactgatcaagcatgtgcattctcgagggagcccactgtttctcttctgcacaacgcatcccgccgtggtgtcgctttggttttgaaatttagattccgttgtcctaaaatttatcactacgggtctccgggtgtattgctc

SEQ ID NO: 72081 - protein, 131 aa, Zea mays
  misc_feature: Ceres CLONE 1554667
  misc_feature (1)..(129): Pfam Name: Gln-synt_C Pfam Description: Glutamine synthetase, catalytic domain
  misc_feature: SWISSPROT Homolog: EC 6.3.1.2 Glutamate--ammonia ligase
MAGIVLSLDPKPIKGDWNGAGAHTNYSTKSMREAGGYEVIKAAIDKLGKRHKEHIAAYGEGNERRLTGRHETADINTFKWGVANRGASIRVGRDTEREGKGYFEDRRPASNMDPYVVTGMIAETTILWNGN

SEQ ID NO: 72082 - DNA, 647 bp, Zea mays
  misc_feature: Ceres CLONE 1554669
  misc_feature: Translation starting site: 103
ccgattgggtaccgggccccccctcgagccctgcagtggtaaagggaggaggcggaccaggtaagcagcatgaggaaccctaggaccgccgcatccgcagccatgggtatcgacctcgttgccggtgggaggaacaagaagaccaagcgcacagcgccgaagtccgacgatgtttatctcaagctccttgtcaagctctaccgtttcttggtctggaggaccaagagcaacttcaatgctgtcattctcatgaggctcttcatgagcaaaaccgatcacccaccattctccatgcgccgccttgtcaagttcgtggaaggaaaggagaagaacattgctgtgattgttggcacagtcacagatgacaagaggatccaagaggttcctgcaatgaatgtcactgccctgaggttcaccgagacggcgagggccaggattgtcaatgctggtggggagtgcctcacatttgaccagcttgctctccgtgctccacttggcgagaacacagtcctcttgaggggccccaagaatgcccgctgtgacggtgaggcacttcagcaaggctcctggagtgccgcacagccacaccaagccatatgtgcgctccgagggaaggaagttcgagaaggctcgtggcaagatgcaca

SEQ ID NO: 72083 - DNA, 690 bp, Zea mays
  misc_feature: Ceres CLONE 1554673
cgattgggtaccgggccccccctcgagccactgcagtggtaaaggtttaaagcgaaggcacagaaaggcgcgataggaggatcaggtctgaagaaagtggatagaaatgatactggtcacccgtctcctatacctagaggatgatgagaacgcagctgtctatctgctgttgagcttcactaagcgtgattgtaacaatggtacctcttgagttctatgttacgcgatgtcgcaattggttgcttgatataaagatgttacaacctcccatctgctaactatgatacagacgggcccccgacaataaggcatgacatatgctgtgaacaaaaaacattaaaaatcgcaacctctggaaattccagcaaaccgggggatccactaattctagattgtacgccacctgctgtgacctccagctctcgtacccttgtatggaaggtctactcctagcttacttgtaatcctggtcataactgtttcctgatgcgagatatagttatgccacccaaagtccatggatattgcctaccggagacatagtctgtaaaggctgcggtgcctatgcagagatgaaactcactttatgtggtttgggatctctgaccgctttgctggcgtgaaaccagtcttgccttctgccttaatgaacctgccaacgctatcggtagaagcgggtatgcgcatggg

SEQ ID NO: 72084 - DNA, 664 bp, Zea mays
  misc_feature: Ceres CLONE 1554675
  misc_feature: Encodes the peptide sequence at SEQ ID NO. 72085
  misc_feature (423)..(423): n is a, c, t, g, unknown, or other
cgattgggtccgagccccccctcgagccctgcagtggtaaaggtttcatcacccccgacgacgggagtgaggatctcttcgtccaccagtcctccatcaagtccgacggctaccgcagcctaaacgacggcgatgccgtcgaatacaccgtcggcagcggcaacgacggccgcgccaaggccctggatgtcaccgcgcccggcggcggcccgcttgccggcggggaacgtcccgacggcggcaacggcggtgggcgcggcggatacggcggcggcgaccgcggatacggcggcggcggtgaccgcggctacgggggaggaggcgaccgcggctacggcggcggcgaccgtggttacggtggaggtggcgaccgcggctacggcggcggcggcgaccgtggctacaggggaggcggcggctacngcggcgggtacagtggaggtggcggcggcagcggccgcggctgcttcaagtgcggcgaggagggccacatgggaagggactgctcccagggcggcggctaccgtaggggaaggcgggcggccccggcaccgagtgctacaaactgccgggcaggaagggccacattctcccgccgactggccccaaacaaaaagggggttagggggcggggcgccacccttcgcccctctgaacccagggc

SEQ ID NO: 72085 - protein, 220 aa, Zea mays
  misc_feature: Ceres CLONE 1554675
  misc_feature (7)..(66): Pfam Name: CSD Pfam Description: 'Cold-shock' DNA-binding domain
  misc_feature (153)..(170): Pfam Name: zf-CCHC Pfam Description: Zinc knuckle
  misc_feature (141)..(141): Xaa is any aa, unknown, or other
IGSEPPLEPCSGKGFITPDDGSEDLFVHQSSIKSDGYRSLNDGDAVEYTVGSGNDGRAKALDVTAPGGGPLAGGERPDGGNGGGRGGYGGGDRGYGGGGDRGYGGGGDRGYGGGDRGYGGGGDRGYGGGGDRGYRGGGGYXGGYSGGGGGSGRGCFKCGEEGHMGRDCSQGGGYRRGRRAAPAPSATNCRAGRATFSRRLAPNKKGVRGRGATLRPSEPR

SEQ ID NO: 72086 - DNA, 799 bp, Zea mays
  misc_feature: Ceres CLONE 1554676
  misc_feature: Encodes the peptide sequence at SEQ ID NO. 72087
  misc_feature (19)..(19): n is a, c, t, g, unknown, or other
  misc_feature (33)..(33): n is a, c, t, g, unknown, or other
  misc_feature (34)..(34): n is a, c, t, g, unknown, or other
  misc_feature (36)..(36): n is a, c, t, g, unknown, or other
  misc_feature (39)..(39): n is a, c, t, g, unknown, or other
  misc_feature (40)..(40): n is a, c, t, g, unknown, or other
tgaacgcctaatcccgctncgtcgctcccctcnnanaannaccataataaaaaaaaatggagctccccgcggtggcggccgctctagaactagtggatcccccgggctgcaggaattcgtctcacccctagaaaaaacactcccatccagccgccaccaggtgcagagtctttcgtcatctcttctccggcgaagaacccccagtcgcccaccagatcacttgttaaactttgttgagggttgatggcggtttctttcgcaaacctcaactccgaggcagggcttaaaaagcttgatgagtaccttctcactcgcagctacatcactggctaccaagcttccaaggatgacttggctgtctacacttccgttccggctgctccctcggccaagtatatcaacggacgcaaggtgggttaaaccacatttgatgccctccgtgaggctgaaccgcaattacttgcacaggggccaagggtgtgaaaggtttgaatccttcaggcagtttccctttcaccccccaaattccaggatggttgtctgaaaacaaccaggccccccaattttgcctggagggaggcacaactaacaaaggaatgtttgaccctttttttggtgtgaaggaagaccgcaacaattgaagaaaaaagggttgggtttgaaaaaaacggtgtgctgccagctgcctcaagggagtttcttgggaaaaaaaaaaaaaagaaatccggggaaaaattccctccagatttttacctttggctggggtaaccccccgtgggtgaccgaagaaaaacactta

SEQ ID NO: 72087 - protein, 58 aa, Zea mays
  misc_feature: Ceres CLONE 1554676
MAVSFANLNSEAGLKKLDEYLLTRSYITGYQASKDDLAVYTSVPAAPSAKYINGRKVG

SEQ ID NO: 72088 - DNA, 638 bp, Zea mays
  misc_feature: Ceres CLONE 1554678
  misc_feature: Encodes the peptide sequence at SEQ ID NO. 72089
  misc_feature (593)..(593): n is a, c, t, g, unknown, or other
  misc_feature (599)..(599): n is a, c, t, g, unknown, or other
  misc_feature (601)..(601): n is a, c, t, g, unknown, or other
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (630)..(630): n is a, c, t, g, unknown, or other
  misc_feature (632)..(632): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (638)..(638): n is a, c, t, g, unknown, or other
cgcggtggcggccgctctagaactagtggatcccccgggctgcaggaattcgtctcacccctagaaaaaacagccgtgccgcaacacacagcagcaggccagccggaaggaacagccacgcaccgatcgacgacggcgcccagctagctagctctcgctccatcgctctcattagccagcgaccacatacatatggccaccgtggacgccacgacgccgacggagtccggcggcaagcagcaggcgccgtcccttccggcgtgcagaagcttctccggcgccaacccggcccttcgggtgctcctgttcgcggtgacgctcgcggggctggtcctgctggccaccgccaagcagacggtgcgcgtgccaatcccgcagttcccggggctcctcctctcccgacccgccaagttcacggactcgccggcgctcatatatctgctggtggctctcgtcgtgacgtgcttctacagcttgctgacggccctcgcctcgcttaagctcgtctccggctcgtttcccgccaccaagactctcctcctgcttgttctgctcgaggtgttatacgcagctatcatggcttcgacgacgtngggggnangtgttttttcgnnnnnnnnnnnnnnnntngngnnntn

SEQ ID NO: 72089 - protein, 140 aa, Zea mays
  misc_feature: Ceres CLONE 1554678
  misc_feature (134)..(134): Xaa is any aa, unknown, or other
  misc_feature (136)..(136): Xaa is any aa, unknown, or other
  misc_feature (137)..(137): Xaa is any aa, unknown, or other
MATVDATTPTESGGKQQAPSLPACRSFSGANPALRVLLFAVTLAGLVLLATAKQTVRVPIPQFPGLLLSRPAKFTDSPALIYLLVALVVTCFYSLLTALASLKLVSGSFPATKTLLLLVLLEVLYAAIMASTTXGXXVFS

SEQ ID NO: 72090 - DNA, 645 bp, Zea mays
  misc_feature: Ceres CLONE 1554689
  misc_feature: Encodes the peptide sequence at SEQ ID NO. 72091
  misc_feature (579)..(579): n is a, c, t, g, unknown, or other
agtggatcccccgggctgcaggaattcgtctcacccctagaaaaagaaggccgagctcatccaatccagtcgcctgattgcattgggatcccatggccaagctcgccgtcctcctcctcctcctcgccgtggccgcgtccgccacagtgccggtgcacggccgcgataccccgactgagatcaagctcatcaaaggcacggacgcctccggcgtgggcgacgacagcatggagtgcgtgtacacggtgttcatccggacggggtcgatcctgaaggccgggacggacgcgaacgtcacgctggagctggccgccgcggacggcaacggcgtggggatctcgaacctgcccgcctggggcgggctcatggggcagggctactcctacttcgagcgcaccaacctggacttcttcaccggtcgcgtgccctgcatggaaaaagcgccttgctggaaggggttggccactgaacggcactggggaacaccaaggggtgggactgcaactacgtggaaggtttaccaccccggggcccgcacaaaggggtggcggggaagcaacctggttcaccattgcacgnaaggggttctccccacccaaaaacccccgcccctttaaagctttcaagggccgttttcctagaata

SEQ ID NO: 72091 - protein, 174 aa, Zea mays
  misc_feature: Ceres CLONE 1554689
  misc_feature (163)..(163): Xaa is any aa, unknown, or other
MAKLAVLLLLLAVAASATVPVHGRDTPTEIKLIKGTDASGVGDDSMECVYTVFIRTGSILKAGTDANVTLELAAADGNGVGISNLPAWGGLMGQGYSYFERTNLDFFTGRVPCMEKAPCWKGLATERHWGTPRGGTATTWKVYHPGARTKGWRGSNLVHHCTXGVLPTQKPPPL

SEQ ID NO: 72092 - DNA, 640 bp, Zea mays
  misc_feature: Ceres CLONE 1554692
  misc_feature: Encodes the peptide sequence at SEQ ID NO. 72093
cgcggtggcggccgctctagaactagtggatcccccgggctgcaggaattcgtctcacccctagaaaaaattgctcaggctgctcccaactcccatcctccccctcccggagtacgaagtactagaaagagagcggctttcctctaagaatggcgggtggcggcgccggcgacgacgacgtggtggtggtgagctgcggcggcagaggcggcggcgaccccggcgcatacgccgcggtgctcaagaggaagctcgacctgtactgcgccgccgtcgccaaatccatggtgacatagatggggcaagcctagttacaaactctaatgtcatagaagatgatgattttcaaggcaagccaaccaacagtggcacatcaaaggaactgtcagacgatgatggtgaccttgaagagaatactgaccccgctaacgccaagaagatgaggagaatggtgtcaaaccgggaatcggctaggcgatcaagaaagaggaagcaagcacacttgaccgatcttgaatcacaggtttccaggttaacgtctgaagatgcatcttttgctgaagcgactggctgatatgactcagaaatacaaggacgcttccgttggacataaaaatctaacagttgatgttgagactag

SEQ ID NO: 72093 - protein, 44 aa, Zea mays
  misc_feature: Ceres CLONE 1554692
  misc_feature: The sequence is a functional homolog of SEQ ID NO 1120 in the 11/479,226 US patent application
  misc_feature: The sequence is a functional homolog of SEQ ID NO 486 in the 10/412,699 US patent application
  misc_feature: The sequence is a functional homolog of SEQ ID NO 410 in the 10/412,699 US patent application
  misc_feature: The sequence is a functional homolog of SEQ ID NO 960 in the 11/479,226 US patent application
  misc_feature: The sequence is a functional homolog of SEQ ID NO 1232 in the 10/412,699 US patent application
  misc_feature: The sequence is a functional homolog of SEQ ID NO 926 in the 10/374,780 US patent application
  misc_feature: The sequence is a functional homolog of SEQ ID NO 1116 in the 11/479,226 US patent application
  misc_feature: The sequence is a functional homolog of SEQ ID NO 2406 in the 10/374,780 US patent application
  misc_feature: The sequence is a functional homolog of SEQ ID NO 42 in the 10/225,066 US patent application
  misc_feature: The sequence is a functional homolog of SEQ ID NO 484 in the 10/412,699 US patent application
  misc_feature: The sequence is a functional homolog of SEQ ID NO 248 in the 10/225,066 US patent application
  misc_feature: The sequence is a functional homolog of SEQ ID NO 2508 in the 10/374,780 US patent application
  misc_feature: The sequence is a functional homolog of SEQ ID NO 74 in the 10/286,264 US patent application
  misc_feature: The sequence is a functional homolog of SEQ ID NO 2518 in the 10/374,780 US patent application
  misc_feature: The sequence is a functional homolog of SEQ ID NO 252 in the 10/225,066 US patent application
  misc_feature: The sequence is a functional homolog of SEQ ID NO 526 in the 11/435,388 US patent application
  misc_feature: The sequence is a functional homolog of SEQ ID NO 1112 in the 11/479,226 US patent application
  misc_feature: Functional homolog of the protein sequence given in SEQ ID NO 96885
  misc_feature: Useful for making plants with modulated endosperm cell number
  misc_feature: Useful for making plants with modulated endosperm size
  misc_feature: The sequence is a functional homolog of SEQ ID NO 1343 in the 10/374,780 US patent application
  misc_feature: The sequence is a functional homolog of SEQ ID NO 1542 in the 10/412,699 US patent application
  misc_feature: The sequence is a functional homolog of SEQ ID NO 2140 in the 10/374,780 US patent application
  misc_feature: The sequence is a functional homolog of SEQ ID NO 286 in the 10/666,642 US patent application
  misc_feature: The sequence is a functional homolog of SEQ ID NO 12 in the 11/375,241 US patent application
  misc_feature: The sequence is a functional homolog of SEQ ID NO 182 in the 10/225,066 US patent application
  misc_feature: The sequence is a functional homolog of SEQ ID NO 402 in the 10/374,780 US patent application
  misc_feature: The sequence is a functional homolog of SEQ ID NO 456 in the 11/435,388 US patent application
  misc_feature: The sequence is a functional homolog of SEQ ID NO 1761 in the 10/374,780 US patent application
  misc_feature: The sequence is a functional homolog of SEQ ID NO 1762 in the 10/374,780 US patent application
  misc_feature: The sequence is a functional homolog of SEQ ID NO 366 in the 10/412,699 US patent application
  misc_feature: The sequence is a functional homolog of SEQ ID NO 855 in the 11/479,226 US patent application
  misc_feature: The sequence is a functional homolog of SEQ ID NO 338 in the 10/374,780 US patent application
  misc_feature: The sequence is a functional homolog of SEQ ID NO 770 in the 10/225,066 US patent application
  misc_feature: The sequence is a functional homolog of SEQ ID NO 812 in the 10/412,699 US patent application
  misc_feature: The sequence is a functional homolog of SEQ ID NO 1225 in the 10/412,699 US patent application
  misc_feature: The sequence is a functional homolog of SEQ ID NO 922 in the 10/374,780 US patent application
  misc_feature: The sequence is a functional homolog of SEQ ID NO 1836 in the 10/412,699 US patent application
  misc_feature: The sequence is a functional homolog of SEQ ID NO 2524 in the 10/374,780 US patent application
  misc_feature: The sequence is a functional homolog of SEQ ID NO 60 in the 10/286,264 US patent application
  misc_feature: The sequence is a functional homolog of SEQ ID NO 706 in the 10/412,699 US patent application
  misc_feature: The sequence is a functional homolog of SEQ ID NO 916 in the 10/225,066 US patent application
  misc_feature: The sequence is a functional homolog of SEQ ID NO 2034 in the 10/374,780 US patent application
  misc_feature: The sequence is a functional homolog of SEQ ID NO 38 in the 10/225,066 US patent application
  misc_feature: The sequence is a functional homolog of SEQ ID NO 382 in the 10/412,699 US patent application
  misc_feature: The sequence is a functional homolog of SEQ ID NO 933 in the 10/374,780 US patent application
  misc_feature: The sequence is a functional homolog of SEQ ID NO 114 in the 10/374,780 US patent application
  misc_feature: The sequence is a functional homolog of SEQ ID NO 36 in the 10/225,066 US patent application
  misc_feature: The sequence is a functional homolog of SEQ ID NO 1342 in the 10/374,780 US patent application
  misc_feature: The sequence is a functional homolog of SEQ ID NO 140 in the 10/286,264 US patent application
  misc_feature: The sequence is a functional homolog of SEQ ID NO 364 in the 10/412,699 US patent application
  misc_feature: The sequence is a functional homolog of SEQ ID NO 851 in the 11/479,226 US patent application
  misc_feature: The sequence is a functional homolog of SEQ ID NO 100 in the 10/286,264 US patent application
  misc_feature: The sequence is a functional homolog of SEQ ID NO 378 in the 10/412,699 US patent application
  misc_feature: The sequence is a functional homolog of SEQ ID NO 614 in the 11/435,388 US patent application
  misc_feature: The sequence is a functional homolog of SEQ ID NO 874 in the 11/479,226 US patent application
  misc_feature: The sequence is a functional homolog of SEQ ID NO 839 in the 11/479,226 US patent application
  misc_feature: The sequence is a functional homolog of SEQ ID NO 912 in the 10/374,780 US patent application
  misc_feature: The sequence is a functional homolog of SEQ ID NO 913 in the 10/374,780 US patent application
  misc_feature: The sequence is a functional homolog of SEQ ID NO 110 in the 10/374,780 US patent application
  misc_feature: The sequence is a functional homolog of SEQ ID NO 1104 in the 10/225,066 US patent application
  misc_feature: The sequence is a functional homolog of SEQ ID NO 362 in the 10/412,699 US patent application
  misc_feature: The sequence is a functional homolog of SEQ ID NO 847 in the 11/479,226 US patent application
  misc_feature: The sequence is a functional homolog of SEQ ID NO 911 in the 10/374,780 US patent application
  misc_feature: The sequence is a functional homolog of SEQ ID NO 1477 in the 11/479,226 US patent application
  misc_feature: The sequence is a functional homolog of SEQ ID NO 708 in the 10/412,699 US patent application
MRRMVSNRESARRSRKRKQAHLTDLESQVSRLTSEDASFAEATG

SEQ ID NO: 72094 - DNA, 648 bp, Zea mays
  misc_feature: Ceres CLONE 1554698
  misc_feature: Encodes the peptide sequence at SEQ ID NO. 72095
  misc_feature (376)..(376): n is a, c, t, g, unknown, or other
  misc_feature (385)..(385): n is a, c, t, g, unknown, or other
tggcggccgctctagaactagtggatcccccgggctgcaggaattcgtctcacccctagaaaaaatcccattctcgaagccgctgcggcacgcgtcccgcttctggtttgcttgcctcccagatcttgccaactaattggaggcacgcatcccgcaacgcgccgtctcgacggcggatcgttttcttctgcttctactgcgtgatctttgggcaagaagataagacacgtccaagcgtcgccacaaccaagggcggcttggttgcagtcaagatggggaaggacggagaatctgccaagctgaaggaggagaagaagtccaaggaagagatccatctgaaggtcaacaccccggacggaggggggggggggaggangacggccangaagaagtcaaggtagagattgaggccaagtttgttgagaaagaaaaggtcaaagactcgggtgacggtgcgggaggaaagggtaccaagaaaaaagggaaccaaggagaaagaccagaaaaaagaaggaagtgggggaggaattcagggaagggcaaagaaacaaaaaaagggattaagcgaaggaattcgaaagggcaaggggcccaggtagacaaaaggaaaacgaaggatggtggcctggaaacacaccagaagcaaaa

SEQ ID NO: 72095 - protein, 42 aa, Zea mays
  misc_feature: Ceres CLONE 1554698
  misc_feature (35)..(35): Xaa is any aa, unknown, or other
  misc_feature (38)..(38): Xaa is any aa, unknown, or other
MGKDGESAKLKEEKKSKEEIHLKVNTPDGGGGGRXTAXKKSR

SEQ ID NO: 72096 - DNA, 794 bp, Zea mays
  misc_feature: Ceres CLONE 1554700
  misc_feature: Encodes the peptide sequence at SEQ ID NO. 72097
  misc_feature (18)..(18): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (198)..(198): n is a, c, t, g, unknown, or other
  misc_feature (276)..(276): n is a, c, t, g, unknown, or other
  misc_feature (455)..(455): n is a, c, t, g, unknown, or other
  misc_feature (456)..(456): n is a, c, t, g, unknown, or other
  misc_feature (457)..(457): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (464)..(464): n is a, c, t, g, unknown, or other
  misc_feature (465)..(465): n is a, c, t, g, unknown, or other
  misc_feature (466)..(466): n is a, c, t, g, unknown, or other
  misc_feature (467)..(467): n is a, c, t, g, unknown, or other
  misc_feature (470)..(470): n is a, c, t, g, unknown, or other
tcccccgtcattcccccntaataaatccccccnnnnnnnnnnnntttcactttnnnaggccatcaccaccccaagaaatgatttacgctctaaaatagtggatcccccgggctgcaggaattcctctcacccctagaaaaacgtctccaccgctgcaggaaactccccccctccccgggggcccgcgcgcccaccaancatggcagtcgcagccgccgcccaccacctggggggtgtgccccaccgccttgtcccggtccggcacaccaataacancccgccgccccatccggccttccgctgttcccccccggggaaaccgcccgtcctactccaatcggttttcgccaggggggaggggggtccactcccccttcttttttttttcttccggaaataaaaatatgacaatatttttttttttcccccataccccgggggaaaagaaagggggnnntnnnnnnnnnaantttattcttttttcttttaaaaaaaaaacaaaaaaaacaaaaacacgacggcggggggggcgcctgacctacaccaacacacccccccccagaatccccccgaacacacatccataatcctccctataacgccacaccaccgctccaaacccctctcccccggcggatttctcacataccgcttcgccaagacaggcgtgccttccctttaccaaactcctcgcaagcccccactaacaaatgtcaatcccaatttatcgacgtagcgacaggtccggatagacccgcgtcccgcctcgtgatcaaatccccctccatgtcatg

SEQ ID NO: 72097 - protein, 66 aa, Zea mays
  misc_feature: Ceres CLONE 1554700
  misc_feature (26)..(26): Xaa is any aa, unknown, or other
MAVAAAAHHLGGVPHRLVPVRHTNNXPPPHPAFRCSPPGKPPVLLQSVFARGEGGPLPLLFFFFRK

SEQ ID NO: 72098 - DNA, 848 bp, Zea mays
  misc_feature: Ceres CLONE 1554706
  misc_feature: Encodes the peptide sequence at SEQ ID NO. 72099
  misc_feature (45)..(45): n is a, c, t, g, unknown, or other
  misc_feature (848)..(848): n is a, c, t, g, unknown, or other
gttattttagtttttttcttaccctccacttgcattgcatatatnaaaaaagattaaaaaaaaacgactccccgcggtggcggccgctctagaactagtggatcccccgggctgcaggaattcgtctcacccctaaaaaaactcaaagttcggagtctaggccgccgcccagaccgcctccccttccccgcctccggtgcccaaggccaggccaacagttttgaggtggtaatggcggaccaggctaaccaacccactgtccttcataagctaggtggtcagttccacctgagctccaccttctctgaaggcgtacgggcccgtaaaaatctgcccatctttctcaccttatgaaaaggagatttgccacgaggaactacatgatctcagagccttttggggccctttaatgtctgaataccggagacaaccaatgtacacccgtgatgcctaaaatccccgcctttctttccacaatgtatttatcccgtttaaagaggttggcacatacactatcaatgaaactgattttaaaaaaattggaacacgcaggttcccattattcgctcgctctaaaaaaaaaattggaacccttgccacccaccaattgaacacaacaacagaatcactagcttatattttccacaaccacctaggaaattaaaaattaattaccaattctcttggtatacccatcaactcacaacgcccctcacaacaagggtcattttgatctcaaattgacctacccaaattctctcaccctttattcaggatttgagggggcttctttatttcccatacatgcgggagataggggacaatacacctggcttgaccggagctan

SEQ ID NO: 72099 - protein, 40 aa, Zea mays
  misc_feature: Ceres CLONE 1554706
MADQANQPTVLHKLGGQFHLSSTFSEGVRARKNLPIFLTL

SEQ ID NO: 72100 - DNA, 758 bp, Zea mays
  misc_feature: Ceres CLONE 1554710
  misc_feature (22)..(22): n is a, c, t, g, unknown, or other
  misc_feature (44)..(44): n is a, c, t, g, unknown, or other
  misc_feature (45)..(45): n is a, c, t, g, unknown, or other
  misc_feature (55)..(55): n is a, c, t, g, unknown, or other
  misc_feature (56)..(56): n is a, c, t, g, unknown, or other
  misc_feature (441)..(441): n is a, c, t, g, unknown, or other
  misc_feature (758)..(758): n is a, c, t, g, unknown, or other
agtgtttttgttttgttttggntaggaggtgtaaattctttatnngggggttttnntcaattttggagctccccgtggtggcggccgctctaaactagtggatcccccgggctgcaggaattcgtctcacccctagaaaaaaggaggagcagaagaagcgcggtttgctgacgtctccatcccatcatgtattatcctcagcctaccgtctccttggaggaggcggttgccctcctccgcccctcactccgccgccactctcaaagggcgtcatcccttctccgctcctccacgccgcctccatgggttagtgcgaggaggaggacggccgtctccgacgacttcttcaccgtcgagttggacgctactggagtggaaccggaaccggattccatcgacgacgggctcccctctccatgggagggagctgtcgtctaccgncgcgacgctgccggccagcacctcgagtaccccagcacgctggagcgcctcggcctagggggaactctcctcccccgactccccgcgcgcgcgccgctgaaccttgggccttgggctggagggaccctgggaaagcacttggggcggcagccttcggaaccccccgtgcttcgtctcccagtcgaacgtgaaacaaggagccacgcggggccgccctgggggcccttggaaacgggacatcagtagccgacaacccgttcattccacccactttcgggcttgaccacttccgagggtgggtgatctgataaaccatn

SEQ ID NO: 72101 - DNA, 865 bp, Zea mays
  misc_feature: Ceres CLONE 1554712
  misc_feature (36)..(36): n is a, c, t, g, unknown, or other
  misc_feature (37)..(37): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (51)..(51): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (73)..(73): n is a, c, t, g, unknown, or other
  misc_feature (75)..(75): n is a, c, t, g, unknown, or other
  misc_feature (76)..(76): n is a, c, t, g, unknown, or other
attcccagatttttcgtgtaggaggcgcgcttcgcnnccgccccnnnnaantctaaaaanncccccccnncgncnnccgctctatactagtggatcccccgggctgcaggaattcgtctcacccctagaaaatctcgagtctcgtccacccgtcgtcctcctagctcctctactcgccagtcgccatgggcaagattaagatcggaatctccggcttcgggaaggatcggcaggttcgcggcctcggtccctcctccccagcgaggatgttcagctcgcccccgcttgcgacctcttccttacaccgactaaatgacccacccggttctaacccgatcccggtcgcttggtgccgggcagatccttgcgacccccccctccttgtgacatcctttcacagcgtatcctgcgtagcacccatgttttgatgcccccccccccgcgtgggggggggggggggggggaccttttctttcgcccgccgagggggggggggctggatgttaggtgcgcgggacggggccccccgccccgctgtttccgcggcaactctttattagccgcgcggctggcgatcccctgtctcaccggggtgggcgcgcttaattaccgccgcgtgacggcccgtcggatccctcccgccggagatatggcggaaacaccgattgttgtaggtcgagaaaaccccccccctcaaatagcggagaaattaacttgcggaccaccacccgctgccaattcggccagagccaccgaccgcctcagacggacccaggggggggtgatttccgcctactagcgtccacgctcatggcacccccatcttgcgcgatcggggtcccgaaactgccgcccaacagccgag

SEQ ID NO: 72102 - DNA, 648 bp, Zea mays
  misc_feature: Ceres CLONE 1554714
  misc_feature: Encodes the peptide sequence at SEQ ID NO. 72103
cgcggtggcggccgctctagaactagtggatcccccgggctgcaggaattcgtctcacccctagaaaaaacttcaccccagttcgccgtctacgcgctccgtctcccccaaaccccacctcctcgccggaaccctagcccccgccgacgcggcgccatgagggagatcctccacattcagggcggacagtgcggtaaccagatcggtgcgaagttctgggaggtgatctgcgacgagcacggcatcgaccacaccggcaagtatgccggcgactccgacctccagctcgagcgcatcaacgtctactacaacgaggccagcggcggccgcttcgtcccgcgcgccgtcctcatggaccttgagcccggcaccatggactccgtgcgctcggggcccttcggccagatcttccgccccgacaacttcgtcttcggccagtccggcgccggcaacaactgggccaagggccactacaccgagggcgccgagctaatcgactccgtgctggacgtcgtgcgcaaggaggccgagaattgcgactgcctccaagggttccaggtctgccactcgctgggaggagggactggttcaggaatgggcaccctgctcatctctaagatcagggaggagtacccggatcggaagatg

SEQ ID NO: 72103 - protein, 164 aa, Zea mays
  misc_feature: Ceres CLONE 1554714
  misc_feature (45)..(164): Pfam Name: Tubulin Pfam Description: Tubulin/FtsZ family, GTPase domain
MREILHIQGGQCGNQIGAKFWEVICDEHGIDHTGKYAGDSDLQLERINVYYNEASGGRFVPRAVLMDLEPGTMDSVRSGPFGQIFRPDNFVFGQSGAGNNWAKGHYTEGAELIDSVLDVVRKEAENCDCLQGFQVCHSLGGGTGSGMGTLLISKIREEYPDRKM

SEQ ID NO: 72104 - DNA, 690 bp, Zea mays
  misc_feature: Ceres CLONE 1554717
  misc_feature: Encodes the peptide sequence at SEQ ID NO. 72105
  misc_feature (690)..(690): n is a, c, t, g, unknown, or other
ggagctcaccgcggtggcggccgctctagaactagtggatcccccgggctgcaggaattcgtctcacccctagaaaaagaatgcccagtcctgaatcacgtcttcacccgtgctcgtgcgctgcgcccatcccttccgcctccacgctccccacgtgcaccgtgcaccgtgcacagcaccacacagccaggtccccatggcggcggcggcggcggttgcgtctgcgacgacggcggaagacgaagcgcgcctgctgcgcctggaggagcaagcggagcacggcggcggcggcgcctgggaatacctctgcctcgcccgccggctccgcgcccgccgccccgctcacgtcctccgcgtcggcctcgccctccgcagggagggcctccgcgcgctccggccttgcctcagaaaagtggacgctctacgaacaggtggccacggcgggccatggattgccaacctctccatgtgggaaaagaccgtattggaaatcctttccaaacaattttcctgggaaccaaccgggttgccccggctaaaaactccccctggttgaaacaaaaacgtgaatggggcttaaaacctaaaaaaagccttacgcgtttaaaccttgggaaaaaaaattcccattttaaccccaaattgtccacacaaaagaaaaaaatttggttatcgccaaaaaaaccctan

SEQ ID NO: 72105 - protein, 119 aa, Zea mays
  misc_feature: Ceres CLONE 1554717
MAAAAAVASATTAEDEARLLRLEEQAEHGGGGAWEYLCLARRLRARRPAHVLRVGLALRREGLRALRPCLRKVDALRTGGHGGPWIANLSMWEKTVLEILSKQFSWEPTGLPRLKTPPG

SEQ ID NO: 72106 - DNA, 813 bp, Zea mays
  misc_feature: Ceres CLONE 1554720
  misc_feature: Encodes the peptide sequence at SEQ ID NO. 72107
  misc_feature (1)..(1): n is a, c, t, g, unknown, or other
  misc_feature (2)..(2): n is a, c, t, g, unknown, or other
  misc_feature (53)..(53): n is a, c, t, g, unknown, or other
nnttttttttgttttatttttcctccctccctccccccccccaatctctcttnaaaaaactggaactccccgcggtggcggccgctctagactagtggatcccccgggctgcaggaattcgtctcacccctagaaaaaaactcttctcttctccccgggcggaccggagtcaggcagccgaagcaagaaaagcaagtggccttggaagttggaatccatggcgtcaacctcgtgcttactccaccagtccaccgcccgcgtggccgcgtggtcgtcgcggggcgttcccgggccgccgtgcagcgtgcaattgttcgtctgcaaggcccagaacgcagcaggcctccgcggcaaaaagcgacgtgacgacgcagagccaagcataggttcttaggcggcgttgcggcccgccgggaccaaggacgagccgcgaacgccctccgccaaacgggaaaatcagcccaacatggttcgggtagtgacgaattaaagaaccccggcggctttcatcgaacttacaggtatggggaactgggatttccaagaccttcacttgactttttggttcccacacgcggaaaatctccaagggactgggccatcggggactgttacccgggaggggacgcggggttcccgcgcgaaaaaacgtacgatcctagtagacccctaaaaggctccctgggtaccgcacaaagaatttcccggccctcccttcataaaaaaaagagacacccggggtgcgggggccccccgaaagaacagtcctcttagtaggggccgaaaaactttgcttcctgcaaggaaaggggg

SEQ ID NO: 72107 - protein, 58 aa, Zea mays
  misc_feature: Ceres CLONE 1554720
MASTSCLLHQSTARVAAWSSRGVPGPPCSVQLFVCKAQNAAGLRGKKRRDDAEPSIGS

SEQ ID NO: 72108 - DNA, 674 bp, Zea mays
  misc_feature: Ceres CLONE 1554722
  misc_feature: Encodes the peptide sequence at SEQ ID NO. 72109
tggcggccgctctagaactagtggatcccccgggctgcaggaattcgtctcacccctagaaaaaactcgccattcctaagtcctaactacctccaaccccgcacgcacaactggccgcgccaaggcaaagctagaagaagacaacgcaaagggagaggacagaggaggagcagaggacgatgggcagcggcggcgctaacactgcccccctcctcaccccctacaagatgggaaaattcgatgttacccacagggtagtcctcgcacaactgacgagacagcggtcctacggcaacgttccccagcctcatgccatactgtactatcagcagagggcgactaaaggaggtcttctgatcgctgaggccgcgggggtttcagacactgctccaggggacaaggacactcctggcatttggacccaggagcaagtcgaagcatggaagccgatcgtagacggggttcccccgaaaagggagggatattttttctgtccaatttgggcccgaggggagaggcctcccattcccccgtttcgcccctaaggggccgggctcccaattttcaggcaccggaagtaaccccctctaagccctccgggggggaggcgcagggggggtgaggcgggggggctacctttctcgccggttgccccgaacggtctttggaggatg

SEQ ID NO: 72109 - protein, 121 aa, Zea mays
  misc_feature: Ceres CLONE 1554722
  misc_feature: SWISSPROT Homolog: EC 1.3.1.42 12-oxophytodienoate reductase
MGSGGANTAPLLTPYKMGKFDVTHRVVLAQLTRQRSYGNVPQPHAILYYQQRATKGGLLIAEAAGVSDTAPGDKDTPGIWTQEQVEAWKPIVDGVPPKREGYFFCPIWARGERPPIPPFRP

SEQ ID NO: 72110 - DNA, 818 bp, Zea mays
  misc_feature: Ceres CLONE 1554724
  misc_feature (7)..(7): n is a, c, t, g, unknown, or other
  misc_feature (21)..(21): n is a, c, t, g, unknown, or other
  misc_feature (22)..(22): n is a, c, t, g, unknown, or other
  misc_feature (34)..(34): n is a, c, t, g, unknown, or other
  misc_feature (45)..(45): n is a, c, t, g, unknown, or other
  misc_feature (49)..(49): n is a, c, t, g, unknown, or other
  misc_feature (714)..(714): n is a, c, t, g, unknown, or other
  misc_feature (762)..(762): n is a, c, t, g, unknown, or other
ataaaantactaaacaaaaanngagaaaaaaacntatagtttatntttnaaagatggaactccccgcggtggcggccgctctataactagtggatcccccgggctgcaggaattcgtctcacccctagaaaaaactcgcttgagcatcgtgtgctcttctcttcctcttccagttggtattctttatctgaaagactgaaacatagtacagaggaggagaggagagcgagagctaataagatgaccggcaaggtcctgcttgtggccgtcctcttggtgggcgtggcctctcgatgctcgggcaataggggcctgcagggcgatcacgttgctgaacagaaattcggtgggggtggatacggaggtggtcctggctacggaagtcttttgtggtggtcggaacaaggattttgtttgtgggccacccccgggggggggggggggggcgcgtgccaccacaccccccccgccgggtatttggcctgtggtgtattaggacacagcggtcctcggtaactacttgttaagaaaccatcctagcgaaccccatttgcagcacagaaccttttctgctcgttttggggttgacttccctaccgagcgacgcatgggagatacgatggtggatttgtccctgttgtatgttgaagaggtaacggcgcatacaatctggtatgaacactcacctattatcacaattcgaatacaggactncgcttttcggcgaataaactcggccatactacatagctacgcacacgngattacaatcctagtccctcattagacacgagtaaagcgactcactattattctct

SEQ ID NO: 72111 - DNA, 608 bp, Zea mays
  misc_feature: Ceres CLONE 1554731
  misc_feature: Translation starting site: 80
  misc_feature (35)..(35): n is a, c, t, g, unknown, or other
  misc_feature (53)..(53): n is a, c, t, g, unknown, or other
  misc_feature (254)..(254): n is a, c, t, g, unknown, or other
cgaattgggtacccgggcccccccctcgagccacnttgcagtggtaaaggggnattcggttccaacaccagccgccgtcatgtcgaagcgaggtaggggaggttcggctgggaacaagttccgcatgtcactgggtctaccggtggcggccacggtgaactgcgcggacaacacgggcgccaagaacctctacatcatctccgtcaagggcatcaaggggccgccctcacccgctccccgtcgcctgtgtcggncacatggtcatggccaccgtaaagaagggaaaagcccacctcaggaagaaagtgatgcccggcgtcatcgtccggcagggcaaggccgtggcttccaagggacggggtcttcatgtcttcgaaaaatatgctgggatgattgggaattccaagggtggaatgaaaggtctctccatccctggccttttctggaagaaaggggcctaaccttttgccccagaatcccccctgccccaaaagccccccttttaaaaccttttggaaaagtttttttaaccctcgagaaaaaaccccccccaatatttgggtttcccagggttttttaaaggggcgttttttaaactattaggcccc

SEQ ID NO: 72112 - DNA, 627 bp, Zea mays
  misc_feature: Ceres CLONE 1554733
  misc_feature: Encodes the peptide sequence at SEQ ID NO. 72113
  misc_feature (627)..(627): n is a, c, t, g, unknown, or other
tcgagccctgcagtgtaaaggacgcgacgcctcaaatcgctccctgcctctggtcacctcgcttccgctcccggctcccctccggctacccagacatcgtccgtgcgctcgccaagagacaggaccggagaccatggcggaccagctcaccgacgaccagatcgccgagttcaaggaggccttcagcctcttcgacaaggacggcgacggttgcatcacaaccaaggagctcggaactgtcatgcgatcactgggtcagaacccaaccgaggctgagctccaggacatgatcaacgaggtcgatgcggacggcaacggcaccatcgacttcccggagttcctcaacctcatggcccggaagatgaaggacaccgactcccaggaggagctcaaggaggcgttcagggtgttcgacaaggaccagaaacggcttcatctctggcggcggagctcccgccgcctgatgaccctacctccggcgaagaaacttgacccaaccaggagggtcgatgaaaatgaatccggggaaggcccaacactcgaatggcgaatggccctgaattaacccccacaagagaatcccctccaagggtccatggatgggcccaggtggagagaaaagacccn

SEQ ID NO: 72113 - protein, 143 aa, Zea mays
  misc_feature: Ceres CLONE 1554733
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDGDGCITTKELGTVMRSLGQNPTEAELQDMINEVDADGNGTIDFPEFLNLMARKMKDTDSQEELKEAFRVFDKDQKRLHLWRRSSRRLMTLPPAKKLDPTRRVDENESGEGPTLEWRMALN

SEQ ID NO: 72114 - DNA, 679 bp, Zea mays
  misc_feature: Ceres CLONE 1554739
  misc_feature: Translation starting site: 163
ccgattgggtaccgggccccccctcgagccctgcagtggtaaaggggaggcagccttaaaccgtccgcacgccgtcttccccatctcgcgcagcgctactgccggctgtccggagtcccgaccaccgtcctcggctccccgccgtgaatccatcatcccgtaatggagacctgcccgtcggtgaagaacatcctcttgctggactcggagggaaagcgcgtcgccgtaaagtactacagcgatgactggcctactctatccgcgaagctggccttcgagaagtcggtatttaccaaaacccagaaagcgaatgctggaacggaagttgagattgtaatgtttgacggtcaaattgtggtatacaagttcatccaagacctgcacttttttgttactggaggagaagaagagaacgagcttattttagcatcagttcttcagggattctctgatgctgtcgaacgacttctcaaaacatggttgacaaaaggacagcactcgagaatttggatatgatcctattgtgccttgatgaaattgttgatggaggggatgtacttgaaacagaaggaagagagtttgctgaaaaggtggtctggtcatgggattgggaggggggcttcctccagctgaaccagacttttagtccaacgccccctaaccccaagcaaagaaaaga

SEQ ID NO: 72115 - DNA, 669 bp, Zea mays
  misc_feature: Ceres CLONE 1554746
  misc_feature: Encodes the peptide sequence at SEQ ID NO. 72116
  misc_feature (669)..(669): n is a, c, t, g, unknown, or other
cgattgggtaccgggccccccctcgagcactgcagtggtaaaggcagcgtctctgctggcaaaatttatgttgagatagagagagcaagattgatcaaaaggcttgcaaatatcaaagaggagcagggaaagattgacgaggctgctgatttgatgcaagaagttgctgtcgaaacatttggctccatggcaaagacggagaaaattgctttcattcttgagcaggtccggctatgcctagatcgtcaagattatgttcgagcacaaattttatcaaggaaaatcagtactagagtatttgacgcagatccatcaaaggaaaaaaagaaaccaaaggagggtgacaacattgttcaggatgctcctgcagatattccttccctcctagaattgaagcgtatctactatgaactgatgattcgatattacttgcacaacaatgattacctggaaatctgtcgttgttacaagtctatttatgatatcccagcaataaaggaagatccaaccaagtggataccgattcttaggaagatctgttggtacttggtgctagcacctcatgatcctatgcaatcgagccttctcaatgctacactagaggataaaaacctttcagaaatcccaaatttcaggttattgctgaagcagctggttaccatggaggtn

SEQ ID NO: 72116 - protein, 223 aa, Zea mays
  misc_feature: Ceres CLONE 1554746
RLGTGPPLEHCSGKGSVSAGKIYVEIERARLIKRLANIKEEQGKIDEAADLMQEVAVETFGSMAKTEKIAFILEQVRLCLDRQDYVRAQILSRKISTRVFDADPSKEKKKPKEGDNIVQDAPADIPSLLELKRIYYELMIRYYLHNNDYLEICRCYKSIYDIPAIKEDPTKWIPILRKICWYLVLAPHDPMQSSLLNATLEDKNLSEIPNFRLLLKQLVTMEV

SEQ ID NO: 72117 - DNA, 592 bp, Zea mays
  misc_feature: Ceres CLONE 1554749
  misc_feature: Encodes the peptide sequence at SEQ ID NO. 72118
  misc_feature (483)..(483): n is a, c, t, g, unknown, or other
  misc_feature (592)..(592): n is a, c, t, g, unknown, or other
cgattgggtaccgggccccccctcgagccactgcagtggtaaagggtagccgccgccggcctccaactctaaccccgttgcttccggctcccgcagcgtcgccgaccttcacagccggttccttcctccgccaccatggggaagacacgtggtatgggagctgggcgcaagctcaagacccaccgcaggaaccagaggtgggctgacaaagcatacaagaagagccacttgggcaatgagtggaaaaaaccttttgctggatcatctcacgccaagggcatcgttctggagaagattggtattgaggccaagcagccaaattcggccatccgtaagtgtgcccgtgttcagctggtgaagaatggaaagaagattgctgcctttgtgccgaatgatggttgctaactcatcgagagatgatgaggtgttgatgctggatttgtcgtagggtatgctgtgggagacatcctgtgtcagggtcangggtgtaggtgtctggtgtgtcgctgcttgcactctttcagggagagaaggagaagcaaggtcttagatcactttcggtagtcaagaatggtggtaactgcccaaggcn

SEQ ID NO: 72118 - protein, 89 aa, Zea mays
  misc_feature: Ceres CLONE 1554749
  misc_feature (8)..(89): Pfam Name: Ribosomal_S12 Pfam Description: Ribosomal protein S12
MGKTRGMGAGRKLKTHRRNQRWADKAYKKSHLGNEWKKPFAGSSHAKGIVLEKIGIEAKQPNSAIRKCARVQLVKNGKKIAAFVPNDGC

SEQ ID NO: 72119 - DNA, 677 bp, Zea mays
  misc_feature: Ceres CLONE 1554750
  misc_feature: Encodes the peptide sequence at SEQ ID NO. 72120
cgattgggtacgtggccccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctacggtggtggccgtggaggcggcggctacggcggtggcgggcgccgtgatggcggcggcggctacggcggtggcggcggcggctacggtggcggcggtggctacggtggtggtggtggcggcttcggcggtggcaaccgtggcggcggctacggccactcccgacggggactggggggaactggaacggggggggcccccgcgcggcccaagtttatcctggtttcccctacccgtggtatgttt

SEQ ID NO: 72120 - protein, 178 aa, Zea mays
  misc_feature: Ceres CLONE 1554750
  misc_feature (10)..(81): Pfam Name: RRM_1 Pfam Description: RNA recognition motif. (a.k.a. RRM, RBD, or RNP domain)
  misc_feature (48)..(153): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYGGGRGGGGYGGGGRRDGGGGYGGGGGGYGGGGGYGGGGGGFGGGNRGGGYGHSRRGLGGTGTGGAPARPKFILVSPTRGMF

SEQ ID NO: 72121 - DNA, 679 bp, Zea mays
  misc_feature: Ceres CLONE 1554753
  misc_feature: Encodes the peptide sequence at SEQ ID NO. 72122
cgattgggtacgggccccccctcgagccctgcagtggtaaaggggacgatggcgtccaattccgcaggccccggctgccgccgacgggggcgacgacctcgaccagctcctcgacagcgcgctcgacgacttcaccagcctcgacctctccgcatctgccgcccccaaaagcgccggtgaggcatctgggtcaggatctggaggcaatgggccggtcaaggggctggggctggggcttccggacccaaacgtgaccaagcggcgcacgaggaagcagccaccgccgaggggcgcgtgcgccaaataggcgcttgaggagctgactcgcgagacgcaggaggctgtgctcgagctcgagacggccactgagggtgttccgtacactggacgatgactccatgatggacgacttcgtctaacatttcgaggagttctcaggggcacaggatatggactccattgttgaaacaatgatgcagcagcttttgtccaacgagattcttcatgaacccatgaatgacattgtggaaaaatatccaaaatggctggaggataatcaaaacaagatacgcaaagaagaatatgagcgttataataatcacctagaactcatggtgaagcttattgaggtctatgataatgatcctgagaacatgactaagattgttgacatcatgca

SEQ ID NO: 72122 - protein, 76 aa, Zea mays
  misc_feature: Ceres CLONE 1554753
MDSIVETMMQQLLSNEILHEPMNDIVEKYPKWLEDNQNKIRKEEYERYNNHLELMVKLIEVYDNDPENMTKIVDIM

SEQ ID NO: 72123 - DNA, 735 bp, Zea mays
  misc_feature: Ceres CLONE 1554765
  misc_feature: Encodes the peptide sequence at SEQ ID NO. 72124
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (449)..(449): n is a, c, t, g, unknown, or other
  misc_feature (486)..(486): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnttttgccaattgggtaccgggccccccctcgagccctgcagtggtaaagggggatagcataacaccgccgaggaagcagcaagcagcaaggtcgacatgtcgtctccgccgccggtgaagctgatcggcttcttcggcagcccgtacgcgttccgcgcggaggcggcgctgtgcctgaaaggcgtgccgtacgagctgatcctggaggacctgttcggcagcaagagcgagctcctgctccaccacaaccccgtgcacaagaaggtgcccgtgctcctccacggcgacggccgggccatctccgagtccctcgtcatcgccgagtacgtcgacgaggcctttcgacgggccgccgctgctccccgncgacccctacgcgcgcgccgcgggccggctttctggnccgacttcatcgaagaccaggctcacccaaggcccttccttcatggcaattctgggttggaagaaaccccaaaccccccccctgcgggtttcggggaagaaggcccaaggaaacttccggggcccctttcttggaagccccccccccccaaggggaaaaaaaagggtttttttccccccggggaaaaaaagggccggggggtaccccccctaaaagtgggggcccggggttttccccccccctcggggg

SEQ ID NO: 72124 - protein, 185 aa, Zea mays
  misc_feature: Ceres CLONE 1554765
  misc_feature (5)..(80): Pfam Name: GST_N Pfam Description: Glutathione S-transferase, N-terminal domain
  misc_feature: SWISSPROT Homolog: EC 2.5.1.18 Glutathione transferase
  misc_feature (103)..(103): Xaa is any aa, unknown, or other
MSSPPPVKLIGFFGSPYAFRAEAALCLKGVPYELILEDLFGSKSELLLHHNPVHKKVPVLLHGDGRAISESLVIAEYVDEAFRRAAAAPRRPLRARRGPAFWXDFIEDQAHPRPFLHGNSGLEETPNPPPAGFGEEGPRKLPGPLSWKPPPPKGKKKGFFPPGEKKGRGVPPLKVGARGFPPPSG

SEQ ID NO: 72125 - DNA, 640 bp, Zea mays
  misc_feature: Ceres CLONE 1554774
  misc_feature: Encodes the peptide sequence at SEQ ID NO. 72126
  misc_feature (1)..(1): n is a, c, t, g, unknown, or other
ncgattgggtaccgggccccccctcgagccactgcagtggtaaaggatagatgttatatggcatatattagaaatccgatccccgaccgcaatcatcaattcatcacggcatcacccccaatttcttctactccaccgaaacataaatccgtagcctggtcttctgcttcgcagaaagatcttgcggaaggtggcagacgcatagatgagggtgagagcatttggcggtagcgcttgacgagcgacgagtaaaccctaatgctttgatcgcggcggcgtcgtttgagacactcccgaatcgatccgcctacatgcctatgaatcctcctcccccgccgcctcctgggtcggcgtcttcgacgccggcgggggccagctacttccctctccctttccacctgcagcagcaccagccgcagccgcagatgccgccgcctatggcggcgagcagctaccagcagtatcagcaacagctgcatcaggcgcatcagctcttccagcgggacgcgcagaccatcacccccgaggcgctgcagagcgtcaaggctgctctcgccaccagcgacgtcctcgaccccgccgccgccgcgaacgccaggccctccgatccctctaccagcaagaagcccatccccccgcg

SEQ ID NO: 72126 - protein, 109 aa, Zea mays
  misc_feature: Ceres CLONE 1554774
MPMNPPPPPPPGSASSTPAGASYFPLPFHLQQHQPQPQMPPPMAASSYQQYQQQLHQAHQLFQRDAQTITPEALQSVKAALATSDVLDPAAAANARPSDPSTSKKPIPP

SEQ ID NO: 72127 - DNA, 646 bp, Zea mays
  misc_feature: Ceres CLONE 1554787
  misc_feature: Encodes the peptide sequence at SEQ ID NO. 72128
cgattgggtccgggcccccctcgagccactgcagtggtaaagggtggtttcttagaggtgggttggcttctcctccccctccggttcgggttcaggttcgtgaggttctccggggttcggtttcgtgggtgagcagatccagatcgctccctcggatgttgagtacctctgcttcgtcagcgagctctcctgggccacggacgacgactccatcctggacgtcttctgcactctaggagaggtcctcgagtccatcattatcctcgatcgggagactgagaggtcccgcgacttcggcttcgtcaccttctccaagaacgaggtgatgctcaactccgtcgaaggcttcaacagcaatgatctggcccgccgcaacaggggggggggggagccccctcccggcggcagtcgtaaggccggttcgtcgcaacaggggcggaccgggtagggggcgccccccctgaggcttggccccaaaaaagcgggaagaaattaaagtgggtggccccggccctaacggtggcgggcggggctcccggggttgggggggcgggccccgccggttgccaaaatgggccggggttttgggggggcccaggggggaattcgaaaaaacctatggggggtgggccccccgccgaacaaa

SEQ ID NO: 72128 - protein, 40 aa, Zea mays
  misc_feature: Ceres CLONE 1554787
MLNSVEGFNSNDLARRNRGGGEPPPGGSRKAGSSQQGRTG

SEQ ID NO: 72129 - DNA, 664 bp, Zea mays
  misc_feature: Ceres CLONE 1554788
  misc_feature: Translation starting site: 169
  misc_feature: SWISSPROT Homolog: EC 1.11.1.15 Peroxiredoxin
  misc_feature (1)..(1): n is a, c, t, g, unknown, or other
ncgattgggtacgggccccccctcgagcactgcagtggtaaaggaggggccttttaaccccagcccggccctgcgagcgagaccaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaagctca

SEQ ID NO: 72130 - DNA, 686 bp, Zea mays
  misc_feature: Ceres CLONE 1554793
  misc_feature: Encodes the peptide sequence at SEQ ID NO. 72131
ccgattgggtacggggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcacccgtcacgaggcccagtccccgcggcggccgtgaaagcggcggcggccgctacggtggtggccgtggaagcggcggctaccgcggtggcccggcgccctgatggcggcgggcgctaccgcggtggccggcggcgcctacggtggcgggggtggctacggggggggggtgggggcggcttacgcggggggcaacctgggggggggggttccggaaactcccaaggggaactgggggaaacttgggggggggggccccccccggcccaaatttttcccggttccccccccggggggttgtttcccc

SEQ ID NO: 72131 - protein, 90 aa, Zea mays
  misc_feature: Ceres CLONE 1554793
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITRHEAQSPRRP

SEQ ID NO: 72132 - DNA, 559 bp, Zea mays
  misc_feature: Ceres CLONE 1554796
  misc_feature: Encodes the peptide sequence at SEQ ID NO. 72133
cgattgggtacgggccccccctcgagccactgcagtggtaaagggtgcgaacgatccagaagcagaagccaccgatcggcgtgccgcgtgcgtgaggcgatcggagcatcccgtcccgaggaggaagacaaccggcgacgcggggggaacatggggaagacgccggtgcggatgaaggcggtcgtgtacgcgctgtcgcccttccagcagaaggtaatgccggggctgtggaaggacatcaccaccaagatccaccacaaggtcaccgagaactggatctccgccacgctcctcctcacccccgtcgtcggcacctaccaatacgccatgtggtacaaggagcaggagaagctttcccacagatattaaatgcgctgccctttgacagacagcactcgggagttttcctgatgggttttcaaaatccctccccgggaggattttaacccttgtgttttgggaaaaaattttcggggggggggccccctttttttttttttttttgtcccccccgggggagaaaaattggggggcacccccgccggggggggggggaaaa

SEQ ID NO: 72133 - protein, 72 aa, Zea mays; identical to SEQ ID NO: 46899
  misc_feature: Ceres CLONE 1554796

SEQ ID NO: 72134 - DNA, 628 bp, Zea mays
  misc_feature: Ceres CLONE 1554801
  misc_feature: Encodes the peptide sequence at SEQ ID NO. 72135
caattgggtaccgggccccccctcgagcactgcagtggtaaaggggactaccgtctcctctcctttcctctcctgcaactgcaagcgaccaccccccacccccatccacccacccacccgcccgccgacgcttggatcccctcccttgctttgccgtgtccccgcccaaaccccgtagccgccgccacagcaatcgctgccgccgctggaggccgggccgtgggggctgaaatgaaggaggtggtgctccacgtgtatgacgtgaccaacagtgactccgagaagacgaacaacaccatcctccagatcaaccgcatcttcaaggaccgcatcggcctcggcggcatcttccacagcgccgtgcaggtctatggcgaggacgagtggtcgttcgggttctgcgagtccggcagcggcgtgtttagttgccccataggcaagaaccccatgtacacctaccgggagcgcatcgtcctcggggagaccgagtgcggcatcgccgccgttaaccggatcctgcgggagctcagccgcgagtggccggggcactcgtacgatctcctctccaggaattgaacccatttctgcgacgtgctctgcgagaagctcggcgtccccaaactcccag

SEQ ID NO: 72135 - protein, 114 aa, Zea mays
  misc_feature: Ceres CLONE 1554801
  misc_feature (2)..(115): Pfam Name: DUF862 Pfam Description: PPPDE putative peptidase domain
MKEVVLHVYDVTNSDSEKTNNTILQINRIFKDRIGLGGIFHSAVQVYGEDEWSFGFCESGSGVFSCPIGKNPMYTYRERIVLGETECGIAAVNRILRELSREWPGHSYDLLSRN

SEQ ID NO: 72136 - DNA, 674 bp, Zea mays
  misc_feature: Ceres CLONE 1554804
  misc_feature: Encodes the peptide sequence at SEQ ID NO. 72137
ccgattgggtaccgggccccccctcgagccactgcagtggtaaaggggtcggcctcccgcactagcacacgcccggtcctctctgctctagcttcgcctcatccgtcacatgattcagctgccatgggcagacgcgactcacacaaatcctagatggcgcccaacaggaacgccgagagaaacactggcgacaaagacagacagctccaggccctccctaaagccatgatcatccagtggttgatctgcctgcagacgttcatctgcaccacctcctacgccaatcgcccacaacatgccgaggctaggcatccctacaactacctctactgctgcttcccccacctcattaactagtaagccgtgcaagcatatgctctgctcacctaacagacaagtaccacgtatgtatagatacgctgcgtgtcaattcatcggcctctaggctgactgctcatgcagctagcatcgttcgtgttgccccgtccgattatgtactgtaacactaggctgccagcctgctgtgctacaagcagttggtgcctcagtactccaagaaaccagatctcttggatttcctgtcacgcgggcgatccactaattctaagatcgccccccacacaagaggagctccctctcctagttccttgtatggaggattaacttcaaacgct

SEQ ID NO: 72137 - protein, 67 aa, Zea mays
  misc_feature: Ceres CLONE 1554804
  misc_feature (1)..(63): Pfam Name: DUF1909 Pfam Description: Domain of unknown function (DUF1909)
MAPNRNAERNTGDKDRQLQALPKAMIIQWLICLQTFICTTSYANRPQHAEARHPYNYLYCCFPHLIN

SEQ ID NO: 72138 - DNA, 633 bp, Zea mays
  misc_feature: Ceres CLONE 1554808
  misc_feature: Encodes the peptide sequence at SEQ ID NO. 72139
cgattgggtaccgggccccccctcgagccactgcagtggtaaaggcgggggggccctacgccagctcccgcgccttcttctccaacgtagccaccatcctcatcatcctggcatgcgtctccctgctcgccttcaccctccacgccgccgcgcgcttcctcctccgctgcctcgcgcgccgccgcgccgcgcgggaggaggcgcaggcgccggggcagcagcccaagctcccctccggcgccgccgccgccagcgccgccgccggctcggagcgcgccggcgccaccggtgcgggcgtgtgggcggaggcggagtgcgccatctgcctgtccgagctgctggaaggcggcgagcgcgtccgcgtgctcccggcgtgcggccacgggttccacggcgcctgcgtggagggctggctcgcggcgcgagcgtcctgccccacctgccgcgcgccgtcgcgggcgggagagccgtagccacgccgagccatggctgctgccgactgccgtgccgtgccacaggctctggagcaagctctgctccgatccgtcctccatgattcccagttggaggggcttgtttcagttattattatgggcgtagtatgtataaaaaatgcaaattggatggtggcgg

SEQ ID NO: 72139 - protein, 156 aa, Zea mays
  misc_feature: Ceres CLONE 1554808
  misc_feature (105)..(147): Pfam Name: zf-C3HC4 Pfam Description: Zinc finger, C3HC4 type (RING finger)
  misc_feature: SWISSPROT Homolog: EC 6.3.2.19 Ubiquitin--protein ligase
IGYRAPPRATAVVKAGGPYASSRAFFSNVATILIILACVSLLAFTLHAAARFLLRCLARRRAAREEAQAPGQQPKLPSGAAAASAAAGSERAGATGAGVWAEAECAICLSELLEGGERVRVLPACGHGFHGACVEGWLAARASCPTCRAPSRAGEP

SEQ ID NO: 72140 - DNA, 660 bp, Zea mays
  misc_feature: Ceres CLONE 1554812
  misc_feature: Translation starting site: 300
cgattgggtacgggccccccctcgagccctgcagtggtaaagggtgctttctcagaggtgggttggcttctcctcccccaccggttcgtgttcaggttctggttcgtgggcgagagggaagagatggcggcatcggacgttgagtaccgttgcttcgttggcggcctctcctgggccaccgacgaccactccctcaacaacgcattcagcacctacagcgaggtcctcgagtcgaagatcatcctggatcgggagacgctgaggtcccgcggcttcggcttcttcaccttctccacggtatggacgcgatgcgcagcgccgtcgagggcatgaacggcaaggagctcgacagccgcaacatcaccgttaacgaggcccactcccgcggcggccgtggaggccgcggtggccgatacggtggcgggcgccgtgatggaggcggctacggaggtggcggtggaggctacggcggtggtcgtggaggctacggcggctgcgggggatacggtggtgcaaaccgcggcggcggctactgcaacaacgactggaactggatgaactgagcggtggggtccgctgaggcctagttatcttgttcgcttctgctaccatgttcaccctagtctagagggggtttatcttcgtctgtggtcgtctcat

SEQ ID NO: 72141 - DNA, 697 bp, Zea mays
  misc_feature: Ceres CLONE 1554819
  misc_feature: Encodes the peptide sequence at SEQ ID NO. 72142
acgattgggtacgggccccccctcgagcactgcagtggtaaaggggcagtcagtccatccaccaaaccagcactcgcttcgctccaccaccagctcgaaacccatggaagcggaggcgttcccgatacggttcacgcggggcgtgcgcgcctactggcggcgccacaagtaccaccgcctggcgggcggcgccgacggcaagcagccccgctcgcggcagctgggctccggcggcggcggcgcgcgcgtgcggcggcgggtgcgcgtgctcctggcgggcccgcggcgcgcgctggcgcgggcgcgggacgcgtacgtgggcggcatgctggcgctgggcaggcgcgcgtcggcgctcgcgctgccgggcaccgtcgaggcgctctgggccaagcgggtgccgccccacaagcagcagcagcagcagctcccggcgcccggcaagcccacggagttcgagcagcgcctcatcttcgagatctacaaatccatcgtcgcgtccaaggagctcaacacaatgctccactcctacggcgcgcacctgccgccccgccgcctttggcggggggactccgcgttacaccctcctccttcgaaaaatgtgaatgagaccgcgcgccgctggattagggagtaaggaaaacaagaaaaccccccgcggccacggccgagtttattcaaatttggtaaaacgaac

SEQ ID NO: 72142 - protein, 177 aa, Zea mays
  misc_feature: Ceres CLONE 1554819
MEAEAFPIRFTRGVRAYWRRHKYHRLAGGADGKQPRSRQLGSGGGGARVRRRVRVLLAGPRRALARARDAYVGGMLALGRRASALALPGTVEALWAKRVPPHKQQQQQLPAPGKPTEFEQRLIFEIYKSIVASKELNTMLHSYGAHLPPRRLWRGDSALHPPPSKNVNETARRWIRE

SEQ ID NO: 72143 - DNA, 634 bp, Zea mays
  misc_feature: Ceres CLONE 1554823
  misc_feature: Translation starting site: 194
  misc_feature (634)..(634): n is a, c, t, g, unknown, or other
cgattgggtaccgggccccccctcgagccactgcagtggtaaagggtacccaacagaagagcggcggcgcggacggacaaggagcaggcggaagaggagttgtgccaaggcacaatgggtatctcgcgtgactcgatgcacaagcgccgagccaccggtggaaagcagaaggcctggaggaagaagcgaaagtatgagcttaggtcgccagccagccaacaccaagttgtcaagcaataagacagttaggagggtccgtgttcgtggaggtaatgtgaaatggagggctcttcgccttgatactggtaactactcatggggaagtgaagctgttacccgcaagacccgtatcctcgacgtggtctacaatgcatcaaacaatgagcttgtgaggacactaacccttgtgaagactgccattgtgcaagttgatgctgccccattcaagcagtggtacatcactcactatggagctgacattggtaggaagaagaacaccctgctgcaaagatgataatgctgagggacacgaggttgatgcagcagctgacgaaacgaaaaagagcaaccatgtcacgaggaagcttgagaagcgcagggagggacgtacccttgatccacacattgaggagcn

SEQ ID NO: 72144 - DNA, 675 bp, Zea mays
  misc_feature: Ceres CLONE 1554824
  misc_feature: Encodes the peptide sequence at SEQ ID NO. 72145
caattgggtacgggcccccctcgagcactgcattggtatatgcgctttcttagaggtgggttggcttatcctccccctccagttctggttctggttcgtgaggttctccggggttcggtttggtgggtgagcggatcgagatggcggcttctgatgttgatgtacggctgctgtgcgctgcggcctcgcctgtgccacagaccaccactccctccacaacgtcttcaacaccttaccgtgaggtccttctatgctccaagcattatcctctatcgggtagacacagacgtcccgcggcttctgcttctgtctccttctccacggaggaggctatgcgccaacgctcctcgatggcatgaacggcaacgagctggacggccgccacatcaccgttcgactaggcccagtccctcatctgccctgcaggcatgctggcatgctgctactgtgcgtggtcgtgaacgcagccgctaccgcggtggcggactccttgatgactgcctccgctaccgcggtcggctgcgcggctactgtggctgcggtggctaccgtcgtggtggtggcgcctactgccgtggcaaccatgtccgcggctacagcaactccgaaggtaactgcacgaactgaccggtggggccacctctgccaagttatcctgttcgctaccgagatgtt

SEQ ID NO: 72145 - protein, 79 aa, Zea mays
  misc_feature: Ceres CLONE 1554824
MLLLCVVVNAAATAVADSLMTASATAVGCAATVAAVATVVVVAPTAVATMSAATATPKVTARTDRWGHLCQVILFATEM

SEQ ID NO: 72146 - DNA, 622 bp, Zea mays
  misc_feature: Ceres CLONE 1554828
  misc_feature: Encodes the peptide sequence at SEQ ID NO. 72147
cgattgggtaccgggccccccctcgagccctgcagtggtaaaggggaggagtcagagctggaacgataaaccagagcccggcctaaatgtgacggccgctctagtggaagcgcgtataaattgggggaaggaaaattccagcggacgagcgctctaagccgtttttcctcgttctcgatcccccctgccgcttccagctccgatcgatctgatccctccccaccaccacgcccatggcggaccaactcaccgacgaccagatcgccgagttcaaggaggccttcagcctcttcgacaaggacagggatggttgcatcacgaccaaggagctgggaactgtcatgcgttcactggggcaaaaccctacagaggctgagctccaggacatgatcaatgaggtcgatgccgatggcaacggcaccatcgattttccagagtttctgaaccttatggctcgcaagatgaaggacactgactctgaggaagagctcaaggaggcctttcgtgtgtttgacaaggaccagaacggcttcatctccgccgccgagctccgccatgtcatgacaaatcttggggagaagctaactgatgaggaggtagacgagatgatccgtgaggctga

SEQ ID NO: 72147 - protein, 129 aa, Zea mays
  misc_feature: Ceres CLONE 1554828
  misc_feature (85)..(113): Pfam Name: efhand Pfam Description: EF hand
  misc_feature (12)..(40): Pfam Name: efhand Pfam Description: EF hand
  misc_feature (48)..(76): Pfam Name: efhand Pfam Description: EF hand
  misc_feature: SWISSPROT Homolog: EC 2.7.11.1 Non-specific serine/threonine protein kinase
MADQLTDDQIAEFKEAFSLFDKDRDGCITTKELGTVMRSLGQNPTEAELQDMINEVDADGNGTIDFPEFLNLMARKMKDTDSEEELKEAFRVFDKDQNGFISAAELRHVMTNLGEKLTDEEVDEMIREA

SEQ ID NO: 72148 - DNA, 662 bp, Zea mays
  misc_feature: Ceres CLONE 1554831
  misc_feature: Encodes the peptide sequence at SEQ ID NO. 72149
ccgattgtgtacctggccccccctcgagccctgcagtggtaaaggagtcgtagccgactggtcgccgcgtccccctttccccgcgcagcagcagagcaccatccggacatccggtgaccgagcaatggaggcggggggcgtgggcctggcgctgcagacgcgggcggcggccttcggctccggccagcgccgggacggcctacagtcgcccatcgggaggctgagagtcgctgaaccggcgggagctgcggttgccgtgcgggctcgcgggtccaagcctgtcgtaccgctccgtgcgaagaaatcatccggaggtcatgaaaacttgcataactccgttgacgaagctctcctgttgaagagaaatcagaagaagttctgttctacttaaacgggaggtgtatttacttagtgagaatgatggggtcctggaaaaagtactgtggggaagatcatgtctgaagtctgggggtattcgttctttgatagtgacaaattagtggaaccagctgtttgaaatgcccttcagtttgctcaaatattcaaaggtccccagtgaaaccttcctttcgggaaaaatggaaaataaccgccctttgaggaattgggcccccccaggcaaacaaatttaattgttgcccccccggaagggtgggggcctt

SEQ ID NO: 72149 - protein, 88 aa, Zea mays
  misc_feature: Ceres CLONE 1554831
MEAGGVGLALQTRAAAFGSGQRRDGLQSPIGRLRVAEPAGAAVAVRARGSKPVVPLRAKKSSGGHENLHNSVDEALLLKRNQKKFCST

SEQ ID NO: 72150 - DNA, 595 bp, Zea mays
  misc_feature: Ceres CLONE 1554835
  misc_feature: Encodes the peptide sequence at SEQ ID NO. 72151
ctattgggtacgggccccccctcgagccctgcagtggtaaaggtgtagccgccactagtacgaagccctcagtcctccctcacacaccgaaccgagcgcaccatgtcgtcggcggctggaggagtggaggagacggtgcgggcgtcgcacatcctcatcaagcacgagggttcccgccgcaaggcctcctggaaggaccctgacggccgcatcatctccgccaccacgcgcggcgacgccgcagcgcgcctcctggacctccgcaaccagattctctccggccaggccaacttcgccgacctcgccgctcggcactccgactgctcgtccgcgcgacgcggtggggacttaggtacctttgggaggaggcagatgcagaaacccttcgaggacgccacatatgccctcaaggttggtgagctcagcgacatcgtggacactgacagtgggggttcacatcattcctgcggaactgccctgaggaggggatcacacctgtccctcctcagggctttcaagtttaagggccttatggggggttccttgtttaaaaacccggtttttttttttttcccccggcgggggagaaaccaaa

SEQ ID NO: 72151 - protein, 164 aa, Zea mays
  misc_feature: Ceres CLONE 1554835
  misc_feature (16)..(117): Pfam Name: Rotamase Pfam Description: PPIC-type PPIASE domain
  misc_feature: SWISSPROT Homolog: EC 5.2.1.8 Peptidylprolyl isomerase
MSSAAGGVEETVRASHILIKHEGSRRKASWKDPDGRIISATTRGDAAARLLDLRNQILSGQANFADLAARHSDCSSARRGGDLGTFGRRQMQKPFEDATYALKVGELSDIVDTDSGGSHHSCGTALRRGSHLSLLRAFKFKGLMGGSLFKNPVFFFFPRRGRNQ

SEQ ID NO: 72152 - DNA, 619 bp, Zea mays
  misc_feature: Ceres CLONE 1554841
  misc_feature: Encodes the peptide sequence at SEQ ID NO. 72153
  misc_feature (412)..(412): n is a, c, t, g, unknown, or other
  misc_feature (431)..(431): n is a, c, t, g, unknown, or other
  misc_feature (435)..(435): n is a, c, t, g, unknown, or other
  misc_feature (555)..(555): n is a, c, t, g, unknown, or other
  misc_feature (557)..(557): n is a, c, t, g, unknown, or other
  misc_feature (598)..(598): n is a, c, t, g, unknown, or other
cgattgggtacgggccccccctcgagccctgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtccccgcggcggcccnttgaaaagcgggggggggngggngggtttttaaggggggggggggggcccccctcagaaaaagaggggggggggggtttaatatgggggggggggggggggggggggccccccccccctttttttaatttttgagggggggangnattttttgtaatataaggggaacctttgggggggggggggngcggcccccccgggttttttt

SEQ ID NO: 72153 - protein, 134 aa, Zea mays
  misc_feature: Ceres CLONE 1554841
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (91)..(91): Xaa is any aa, unknown, or other
  misc_feature (97)..(97): Xaa is any aa, unknown, or other
MAASDVEYRCFVGGLAWATDDHSLHNAFSTYGEVLESKIILDRETQRSRGFGFVTFSTEEAMRNAIEGMNGKELDGRNITVNEAQSPRRPXEKRGGXGGFLRGGGGPPSEKEGGGGLIWGGGGGGGPPPPFFNF

SEQ ID NO: 72154 - DNA, 632 bp, Zea mays
  misc_feature: Ceres CLONE 1554850
  misc_feature: Encodes the peptide sequence at SEQ ID NO. 72155
cgattgggtaccgggccccccctcgagccactgcagtggtaaaggagatggtggtaaaggaccgcgctgacctccctccccgcgcgcctgcgcgcccctgcgccccccgcggcgacgggcggccggcgcctcctcagcgacgggaaggggcgcgtgctcagcgaggaggagcgcgccaaggagagcgtctacatccagaagatggagagggagcggcaggagaagctcaagaagaggctcgagcaggagaaggccgactccgacaaggccaagcccgccgacgccgacaagaaggccgagggatctacctagctaggaaggcgctgttggaaggcaatcacgtttcgcatgtatccgaatccgatggtcagctttgtgaatgaataaattctgtaaaacgtcaacagcactggatatgctgtggcttcggttgcttgcatgttgaagttgaagacgacattcatattttgatactgctgctctttgtggactcgcggtaaaaaaaaaaaaaaaaaaccagagctctgggaattcctgcagcccgggggatccactagttctagagcggccgccaccgcggtggagctccagcttttgttccctttagtgagggttaatttcgagcttggcgt

SEQ ID NO: 72155 - protein, 36 aa, Zea mays
  misc_feature: Ceres CLONE 1554850
MERERQEKLKKRLEQEKADSDKAKPADADKKAEGST

SEQ ID NO: 72156 - DNA, 565 bp, Zea mays
  misc_feature: Ceres CLONE 1554852
  misc_feature (305)..(305): n is a, c, t, g, unknown, or other
cgattgggtaccgggcccccctcgagccctgcagtggtaaaggttgcgcagcagggcagctgggcagggcagggcaggtcgccatttagtcctctgcgctttttggcgttggttcttcttgcacaactcttctgctggattccagctctgtttttctttctcctgtcctgctggtcagtcaaatatatcctcctggtcctgggtagcttttgggttccggcgccttgccgttcgcagtttgtgttcttggtcatctgatctgggtggtattaatctggagacccagtcactcggtcgggacgagnatcataaaaaggaagaaagaaacagcgcggcaaagccgcggcgtcccgaaacttaagatcagagacacacctttgtttgggcgttgccttccaaataatctacaaaaaccagctcaaaattccattaagtcgggaagtacctcggaaaaacccccctttccctccttttttggcgtttaaaacccggttgcttcctcccctaatggcaaaggaatttgaaaaaagaacaatcccccctgggggaaaaaaacccgcgaaac

SEQ ID NO: 72157 - DNA, 615 bp, Zea mays
  misc_feature: Ceres CLONE 1554857
  misc_feature: Encodes the peptide sequence at SEQ ID NO. 72158
  misc_feature (368)..(368): n is a, c, t, g, unknown, or other
  misc_feature (369)..(369): n is a, c, t, g, unknown, or other
tgggtaccgggccccccctcgagccactgcagtggtaaaggactcatcaccagctagctctagcaaagcacttgccatctaccgaccgccgcattccaaacagcccgacgagctagcagagcggcaggcacctccctcctcaaggaacatggcccgcatgcagaagttggcagtggcgacggcggccgtggtggccttggtgctgctggcggcggcggcgacctcggaggcggccatcagctgcgggcaggtggcgtcggccatcgcgccctgcatctcctacgcgcgcggccagggctcggggccctccgctggctgctgcagcggcgtcaagagcctcaacaacgccgcccgcaccaccgccgacnnccgcgccgcctgcaactgcctcaagaacgccgccgccggcgtcagcggcctcaacgccggcaacgccgccagcatcccctccaagtgcggcgtcagcatcccctacaccatcagcacctccaccgactgctccagggtgaactgaaccctaaacgacgacgacggcgccggcggccgcctgaagacgatccatatctatcccgccgtcgtcggcgcccgcggatcggaccgtcatgaccatatcta

SEQ ID NO: 72158 - protein, 121 aa, Zea mays
  misc_feature: Ceres CLONE 1554857
  misc_feature (32)..(117): Pfam Name: Tryp_alpha_amyl Pfam Description: Protease inhibitor/seed storage/LTP family
  misc_feature (74)..(74): Xaa is any aa, unknown, or other
MARMQKLAVATAAVVALVLLAAAATSEAAISCGQVASAIAPCISYARGQGSGPSAGCCSGVKSLNNAARTTADXRAACNCLKNAAAGVSGLNAGNAASIPSKCGVSIPYTISTSTDCSRVN

SEQ ID NO: 72159 - DNA, 648 bp, Zea mays
  misc_feature: Ceres CLONE 1554858
  misc_feature: Encodes the peptide sequence at SEQ ID NO. 72160
  misc_feature (620)..(620): n is a, c, t, g, unknown, or other
cgattgggtaccgggccccccctcgagccctgcagtggtaaagggcagtcgcggacaggaggaagaggaagaagaagcggccgcgagcgaggatgccgtgcctgaacgtgtcgaccaacgtgaacctggagggggtggacacctccggcatcctcgccgaatcctccaagtccgtcgccaacatcatcggcaagcccgacgcctacctgatggttgttctcaagggttcggagcctatggcatttggaggtacccaggagccagcagcttacggtgagctggtttccatcggaggcctgaaccctgatgtgaacaagaagcttagtgctggcatcgcttctatcctggagtcaaagctgtctgttcccaagtcacgcttctacctcaagttctatgactcgaagcgctcggacttcggttggaacggctccaccttctagacttgaggtctgcagctgacataaaagacattcgtggaatcatggtacctaatgcccatggctattgcctattaaggacaatgtcatacgatgtgtcttactccgtgctgaactgaaaaacagtaactgttgtcgtggaactggaagtgcggtgctggcatgtcaaagtgcttgcttccntactagcatagcatgcctgtgctatctt

SEQ ID NO: 72160 - protein, 115 aa, Zea mays
  misc_feature: Ceres CLONE 1554858
  misc_feature (2)..(116): Pfam Name: MIF Pfam Description: Macrophage migration inhibitory factor (MIF)
  misc_feature: SWISSPROT Homolog: EC 5.3.2.1 Phenylpyruvate tautomerase
MPCLNVSTNVNLEGVDTSGILAESSKSVANIIGKPDAYLMVVLKGSEPMAFGGTQEPAAYGELVSIGGLNPDVNKKLSAGIASILESKLSVPKSRFYLKFYDSKRSDFGWNGSTF

SEQ ID NO: 72161 - DNA, 626 bp, Zea mays
  misc_feature: Ceres CLONE 1554860
  misc_feature: Encodes the peptide sequence at SEQ ID NO. 72162
  misc_feature (1)..(1): n is a, c, t, g, unknown, or other
  misc_feature (477)..(477): n is a, c, t, g, unknown, or other
ncgattgggtaccgggccccccctcgagccctgcagtggtaaaggtttccgatcgccaattcgccttccaccgcctgcaaccctttcttcccttctcggtcatcgtgacggcatcacgcgcgcgctctcctcttccacgagtccgtcagcctgctaagtcttaagatggcgtcaagcaatggtcagacagaagctccagcaccatctgtccccaaaaatcctgctatggcatcatgccggaagaagaaaacagatgatgctaccttccttgaagatctgaaagaccacatggatgagttcattcacgcctccatggatgagcacaagagctgctttaagaagacaattcagaacatgtttgggatgtccaacgctgttgcagagagatccgcggcggaagcaaacaaagctgaagttgaaagtgctttgccacttcagaccagtgtctcgcagtagaatttcatgcagtagaattcnctgttggtagtttcttgctcgtgccaatagttttatataacggtttttgttgctgtgttttctgaaacgcataagcgtgtcactagcatgttatcataaccggattgtagtgcttcattatctatagttgtctgaacgtgtaagataga

SEQ ID NO: 72162 - protein, 96 aa, Zea mays
  misc_feature: Ceres CLONE 1554860
MASSNGQTEAPAPSVPKNPAMASCRKKKTDDATFLEDLKDHMDEFIHASMDEHKSCFKKTIQNMFGMSNAVAERSAAEANKAEVESALPLQTSVSQ

SEQ ID NO: 72163 - DNA, 573 bp, Zea mays
  misc_feature: Ceres CLONE 1554861
  misc_feature (281)..(281): n is a, c, t, g, unknown, or other
cgattgggtaccgggcccccctcgagcactgcagtggtaaggtgctctctcagaggtgggctggcttctcctcccctcttacaagtcctcctcgggttagggttccttagggttttgtggaggggcgatggcggcggctgatgtggagtacgttgcttcgtcggcgggcttgcctgggccacccagcacgagtcgctggagaatgccttccgcctcctacggcggagatcctcgactccaggtcatcaccgaccgggagacgggggagtcccgcggcttcngcttctttacttctcctccgagaaactcatgctcgacgctatcgagaacctgaacggccaagagttcaacggcccttaacttcccgtttaccaggccaattcccttggcctttgccctttggccccctgggctaccaggggcgttccccggggggggggggggtttttgtggggcgggccccccttaacggggtttttggggggggggggggggccttccgggggccgccccaaatgggggcccggggggtccaaagggggggggggggggtaaaaggggggggggccaaag

SEQ ID NO: 72164 - DNA, 653 bp, Zea mays
  misc_feature: Ceres CLONE 1554865
  misc_feature: Encodes the peptide sequence at SEQ ID NO. 72165
cgattgggtaccgggcccccctcgagccctgcagtggtaaagggggacagccaaagaagacggacggaagtgaggcgagcacgggcgctcaccggcgatggcgacgagggcatgggtggccgcggcggtggccttgaaccctcaactgctgcctctccgctcctgctcgcccacgaagtcggtttccccagcgcagcgctcggcgtcgatggggctccggctgcgcagcggccggccgtgcgtggggaagttcgtgtgccgccgcgccaagaacgcgggatacgaggactacaagttcccggaccccatcccggagttcgccgagcaggagacgagcaagttcagggagcacatggcgtggcggctggagcagaagaaagaggactacttcggggaccatgtcgaggagatcgttgacgtctgcaccgaggcacatcttggggacattcctggagaacgattaccgtggaccagggacgctcctggttcacccgttcctggacatgaagggcgagatcaaggagagggggctccccggcgcacctcaggcggcacgggcggcgatagcatgggccgaaaagaacgggataggacggaagctggatggactcctttgtgtactcacctcttgacaattgcctcatgtgctgcgc

SEQ ID NO: 72165 - protein, 185 aa, Zea mays
  misc_feature: Ceres CLONE 1554865
MATRAWVAAAVALNPQLLPLRSCSPTKSVSPAQRSASMGLRLRSGRPCVGKFVCRRAKNAGYEDYKFPDPIPEFAEQETSKFREHMAWRLEQKKEDYFGDHVEEIVDVCTEAHLGDIPGERLPWTRDAPGSPVPGHEGRDQGEGAPRRTSGGTGGDSMGRKERDRTEAGWTPLCTHLLTIASCAA

SEQ ID NO: 72166 - DNA, 556 bp, Zea mays
  misc_feature: Ceres CLONE 1554866
  misc_feature: Encodes the peptide sequence at SEQ ID NO. 72167
  misc_feature (250)..(250): n is a, c, t, g, unknown, or other
  misc_feature (251)..(251): n is a, c, t, g, unknown, or other
ccgattgggtaccgggccccccctcgagccactgcagtggtaaaggctcatcacactcgatcgcagttgatccagtacacaattgcagagagctagaagacacaagaacatggcgtccaagcgactcctcgtgctagtagctctcctgctcgccgccgttttccttgccgtctcaggagcagctaacgacgaccaagcccaaccgaggaaggacggcggcgagaacaaagccgacgtgcagggactaccnngtggcggcggccggcggcctggccccccgttgggggggtggcttaccccccgggggggggggggggtaaccccggccggtggggtcacccccggggggggggggttcaccttgggggggcccccgggtttaatcgaggggggggggctcaccccgggaaatagggggggtccgggggttttccccccccaaaaaaaggccgggaacactattttccccccgggggcccccccggggggtcccccatttggggggcgcgccacccccaccctctttttttaaaaaaaagagaaggggggggggaga

SEQ ID NO: 72167 - protein, 140 aa, Zea mays
  misc_feature: Ceres CLONE 1554866
  misc_feature (1)..(105): Pfam Name: GRP Pfam Description: Glycine rich protein family
  misc_feature (48)..(48): Xaa is any aa, unknown, or other
MASKRLLVLVALLLAAVFLAVSGAANDDQAQPRKDGGENKADVQGLPXGGGRRPGPPLGGWLTPRGGGGVTPAGGVTPGGGGFTLGGPPGLIEGGGLTPGNRGGPGVFPPQKKAGNTIFPPGAPPGGPPFGGRATPTLFF

SEQ ID NO: 72168 - DNA, 646 bp, Zea mays
  misc_feature: Ceres CLONE 1554867
  misc_feature: Encodes the peptide sequence at SEQ ID NO. 72169
  misc_feature (554)..(554): n is a, c, t, g, unknown, or other
tccgggcccccctcgagcactgcagtggtaaagggttttcccctaaccgacgttgcgactcactcacaagtacgactacggggcacacgagctcacgggtgatggctaacgagggcgtcgcggccgatcgggcggtcaaggcccctccaccggagacggagagcatcgtgtggagggaggacaaggggaggttccagactcccgacggcgaggccttccttcagtaccgcctcctcgacggccgcggggcccccgctgcggcagtgatggacctggtgcacacgtacgtgccgcggatcaagcgcgggcaggggctcgcggcgcggctctgcgacgctgccttcgcccacgctcaggcccgcggcatgcgcgtcctccccacctgctcctacatctccgacacgtacctgcctcggaatcctgcgttgaaggagctcgtggacaaggatcaagaaccccatcccaaacccaatagcatgtacatggttggttgttcaagagaccacctgccacttaaataatcagatatccagaaatacctgtcacttgatgantatttgcttcttcgcaagcgttgatgtcagatgttacacgttagatatctcgtgcagtgcgtcaggggcattttatttttgaccacataata

SEQ ID NO: 72169 - protein, 139 aa, Zea mays
  misc_feature: Ceres CLONE 1554867
MANEGVAADRAVKAPPPETESIVWREDKGRFQTPDGEAFLQYRLLDGRGAPAAAVMDLVHTYVPRIKRGQGLAARLCDAAFAHAQARGMRVLPTCSYISDTYLPRNPALKELVDKDQEPHPKPNSMYMVGCSRDHLPLK

SEQ ID NO: 72170 - DNA, 728 bp, Zea mays
  misc_feature: Ceres CLONE 1554869
  misc_feature: Encodes the peptide sequence at SEQ ID NO. 72171
  misc_feature (326)..(326): n is a, c, t, g, unknown, or other
  misc_feature (327)..(327): n is a, c, t, g, unknown, or other
  misc_feature (355)..(355): n is a, c, t, g, unknown, or other
  misc_feature (356)..(356): n is a, c, t, g, unknown, or other
  misc_feature (371)..(371): n is a, c, t, g, unknown, or other
  misc_feature (392)..(392): n is a, c, t, g, unknown, or other
  misc_feature (395)..(395): n is a, c, t, g, unknown, or other
cgattgggtaccgggccccccctcgagccactgcagtggtaaaggaggtcgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctcccagatggaaggagttgaaaccttcgacatagaccctcaggagcagaaagtgacagtcaaaggcaatgtcnnagcctgaggacgtcttccagacggtttnnccagtcgggaaggangacctcgttactggaagggcnaanccaccgccccgggaccttggggggggttccgaaaaccgaaagcagttccaaaacacccggggaaaaaacgccttcctggtggttgttccgggggggccccaaaatttccccccccaaaaagttgaccccttaattccccccttttttttcccccccctgggggaggggggggggggggcacccccaaaaccttaaaactcaaaaaaatcgggggggaataggtttttatttcccccggggtttttccggcggcccccccgggggtttttaaaaaaattgtggaaaaaaccccccccccccggtgtgtgtttttatttttccccctaaaaaacc

SEQ ID NO: 72171 - protein, 52 aa, Zea mays
  misc_feature: Ceres CLONE 1554869
  misc_feature (51)..(51): Xaa is any aa, unknown, or other
MAAVETVVLKVAMSCEGCAGAVRRVLSQMEGVETFDIDPQEQKVTVKGNVXA

SEQ ID NO: 72172 - DNA, 762 bp, Zea mays
  misc_feature: Ceres CLONE 1554870
  misc_feature: Encodes the peptide sequence at SEQ ID NO. 72173
  misc_feature (55)..(55): n is a, c, t, g, unknown, or other
  misc_feature (56)..(56): n is a, c, t, g, unknown, or other
  misc_feature (58)..(58): n is a, c, t, g, unknown, or other
  misc_feature (70)..(70): n is a, c, t, g, unknown, or other
  misc_feature (76)..(76): n is a, c, t, g, unknown, or other
  misc_feature (77)..(77): n is a, c, t, g, unknown, or other
  misc_feature (83)..(83): n is a, c, t, g, unknown, or other
  misc_feature (86)..(86): n is a, c, t, g, unknown, or other
cgccacactatcacaaggcaaccgacgaacgtttttgacactagctccttactannanaaatgattattntttttnntttttnttnttttccgattgggtaccgggcccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctgcttcatcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcccccgccatggaggcggcggcggcggctacggtggtggccgtggaggcggcggctacagcagtggcgggcgccgtgatggcggcggcggctacggcggtggcggcggcggctacagtggcggcggtggctacagtggtggtggtggccggctaccgcggtggcaaccgtggcggcgggctacggcaaactccgacgggaaactggaaggaaacttgaagcggtgggggcccccgcgccggcccaagtttattccctgtttccgcttac

SEQ ID NO: 72173 - protein, 176 aa, Zea mays
  misc_feature: Ceres CLONE 1554870
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
MAASDVEYRCFIGGLAWATDDHSLHNAFSTYGEVLESKIILDRETQRSRGFGFVTFSTEEAMRNAIEGMNGKELDGRNITVNEAQSRPRHGGGGGGYGGGRGGGGYSSGGRRDGGGGYGGGGGGYSGGGGYSGGGGRLPRWQPWRRATANSDGKLEGNLKRWGPPRRPKFIPCFRL

SEQ ID NO: 72174 - DNA, 550 bp, Zea mays
  misc_feature: Ceres CLONE 1554875
  misc_feature: Encodes the peptide sequence at SEQ ID NO. 72175
ccgattgggtaccgggccccccctcgagccctgcagtggtaaaggatcgatcctcactgcagtggtaaaggctattcgtgtcctggcatccgcagagagcttgttccgtccaggcaaccaaaaagcaagttgccccgccgcgcagaggaagaagagagcagaggaggatggctcgtacgaagcagaccgcccgcaagtccacgggaggcaaggccccccgcaagcagctcgccaccaaggcggcgaggaagtcggcgccgacgaccggcggcgtgaagaagccccacaggtacaggcccgggaaccgtaggcgtctgcgcgtagatccgcatagtaccagaaagagcacggatagctgcctgaatcccgcaaggctgcccctttcccaagcggccctggttggccgccgaagaacccccgccaaggaacctttcaaagaaacaaaaaccctccccggggtttcccccagaaagccccaccccccccctggggcctttggggcccccccccccccacaggggagaaggggccccccccccccccaaaaagg

SEQ ID NO: 72175 - protein, 127 aa, Zea mays
  misc_feature: Ceres CLONE 1554875
MARTKQTARKSTGGKAPRKQLATKAARKSAPTTGGVKKPHRYRPGNRRRLRVDPHSTRKSTDSCLNPARLPLSQAALVGRRRTPAKEPFKETKTLPGVSPRKPHPPPGAFGAPPPPQGRRGPPPPQK

SEQ ID NO: 72176 - DNA, 641 bp, Zea mays
  misc_feature: Ceres CLONE 1554881
  misc_feature: Encodes the peptide sequence at SEQ ID NO. 72177
taccgggccccccctcgagccactgcagtggtaaaggctgctcttaaggccgccgccgcctcggtgcctcctcgcttcgaagtgttcgtgcgaaggcgaccctccctccttcgctccttccgcgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtcgcgccactccaatgggcagggccgctggcccgttaaatcagccaggttcatcctggatttgctgaagaatgctgagagtaacgctgatgtgaaaggcttggatgtggacaacctctatgtttcacacatcagggtgaaatcagcccaaaaggcagaagcgccggcacctaccgggctcacgggcgcatcaatcccttaatggtcctcccctttgccacattggaacctgatccttggccaaaaaaagaaaaaccctgttgaaaaaaaaaag

SEQ ID NO: 72177 - protein, 140 aa, Zea mays
  misc_feature: Ceres CLONE 1554881
  misc_feature (17)..(127): Pfam Name: Ribosomal_L22 Pfam Description: Ribosomal protein L22p/L17e
MVKYSQEPGNPTKSAKAMGRDLRVHFKNTRETAFALRKLSLTKAKRYLEDVIAHKQAIPFRRYCGGVGRTAQAKSRHSNGQGRWPVKSARFILDLLKNAESNADVKGLDVDNLYVSHIRVKSAQKAEAPAPTGLTGASIP

SEQ ID NO: 72178 - DNA, 547 bp, Zea mays
  misc_feature: Ceres CLONE 1554886
cattggtcgggcccccctcgagccctgcgtggtaaaggagtttcgatctctcccatccgagtgtctcctcctcctccgccgccgccgccgccgcttccctcgtctccgcccgccgaagcctgccgtcgcacaagaccttcggatcagaagaagctggccagaagatgcgccagaacgcccctccctactggatccgctgcgcccgacacacatcagtacacgcaagcgcagcactggcgtcgcacaaactcggattctgagcggtggaagaatgctgctaaagacgcctaaggtataggctctgcagctaggaacccctgttaaatttttttgctgggggtatttggcattggaaaccccggttttggccgaagggaaaaaaccccctttttggcctggggaaatttttttttaccttgggccccccctaaaaacggggttttcccttgcccccaaaaaaaaaaaaaaaaaaaacccccggccccctttgggaaaatttcccccccccccccccggggggggggacccccccccccttttttttttt

SEQ ID NO: 72179 - DNA, 928 bp, Zea mays
  misc_feature: Ceres CLONE 1554888
  misc_feature: Encodes the peptide sequence at SEQ ID NO. 72180
  misc_feature (13)..(13): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (501)..(501): n is a, c, t, g, unknown, or other
  misc_feature (821)..(821): n is a, c, t, g, unknown, or other
tatttatttaaanataatggtggcgtggcgcggcgaaccacgagagtgcattgttttgtttaaannnnncannnnnnnnnccaattgggtactcgcacgccccctagccctgtcgtggtaaaggaggcccaaaccacgcttctttccccactgcaccaggcaacccaccagcaggccgcagttcacgcttggctgacgaccgacccccattcgttctagccctccctccgacactccgatccattactcgctatggacgcggcgggcggcgaccagctaagcctggccgcggtgcgcgacgcgctggtgcggctggaggactccgtggtgttcgcgctcatctagcgcgcccggcatccgcggaacgcgccagcctacgcgcccgccgccaccgctggagaacattcgctcgtggagttcttcgtccgggaagcataggcccctcaacccacaggctggacattatcaaaagccagaagatgtttaaccccccccgccaanatctaaccctcacctcctctttcccgaacaaagcccttcccgcaaaaagggtctttgcaaccccttttatgctttccattgggtcaccccgtcggaaatagatgccaaataatgggcaaaaaattggcaatttttggcaatggaaatttggcttccccccgtttaatttccaacctggttttgtattgcggcggcactgaaaggggacaagcctcattgccccccaaaaacaagtgttctgccaaccctgggaattttctaaccccgatgttcccttgcccaggggcctccctacatcaaccaaaaagaaaatctcccanttactcgggcttaaaacaaaatagtttctgcccatgaagagggtgaaaactctctccaaaaggaaaccgcttcccctttcaaagaaaagtaaattgccgctccgcag

SEQ ID NO: 72180 - protein, 30 aa, Zea mays
  misc_feature: Ceres CLONE 1554888
MDAAGGDQLSLAAVRDALVRLEDSVVFALI

SEQ ID NO: 72181 - DNA, 706 bp, Zea mays
  misc_feature: Ceres CLONE 1554889
  misc_feature: Encodes the peptide sequence at SEQ ID NO. 72182
cgtattgggtaccgggccccccctcgagcactgcagtggtaaaggcttcgaagtgttcgtgcgaaggcgaccctccctccttcgctccttccccgccgcctcccggccgtcgccgccatggtgaagtactcgcaggagccgggcaaccctaccaagtcggctaaggccatgggcagggatctgagggtccacttcaagaacacaagggagacagcctttgcgcttcgcaagttgtctttgaccaaggctaagcgataccttgaggatgttattgctcacaagcaggcaattcccttccggagatactgtgggggtgttggtcgcaccgcgcaagctaagtctcgccactccaatgggcagggccgcttggccggttaaatcagccggggttcatccctggaatttgctggaaaaatgcctgaaagtaaacccctgaatgtggaaaaggtttggaatggggaaaaacctccattttttcacactttccagggggaaccaaggcccaaaaaaccaaaaggcccccccacccttaccgggggttccaggagaaccaatttaaatcccccctacaatgtcccccccaccccttgggccccattttgagaggcttgtaactttgttcccccaaaaaaagggggaagaacaccccccctggtgtgaaaaaaaaaaagaaaaggggcggtgttataccaaaaaaatatttttt

SEQ ID NO: 72182 - protein, 86 aa, Zea mays
  misc_feature: Ceres CLONE 1554889
  misc_feature (17)..(86): Pfam Name: Ribosomal_L22 Pfam Description: Ribosomal protein L22p/L17e
MVKYSQEPGNPTKSAKAMGRDLRVHFKNTRETAFALRKLSLTKAKRYLEDVIAHKQAIPFRRYCGGVGRTAQAKSRHSNGQGRLAG

SEQ ID NO: 72183 - DNA, 676 bp, Zea mays
  misc_feature: Ceres CLONE 1554893
  misc_feature: Encodes the peptide sequence at SEQ ID NO. 72184
ccgattgggtaccgggccccccctcgagccctgcagtggtaaaggagcagcgacgaactcgaagcttgcgttcttgtagtagaggtcggcagcaagcggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggcgccaccaagtacagatgccgcgacttcctccccgaaaactgcggctgcaagatccactagactcatccacagcggcacagccgatggatccttccatgctcctccgtccgtccgccttgctacaagcaggcagccaccaataagctagctcttgttgttgttttgcatgtttgattgggtgtcccttcccagtcgagatggaataatgtcaggcgcacgtacagacgtgttattacgatatttctcccctacaaataaaaactcgatctgtggggttaacactgtcccctagtattacaattaaaaaaagatgttatcacgcatgttaagaaaacatctgaatccct

SEQ ID NO: 72184 - protein, 89 aa, Zea mays; identical to SEQ ID NO: 42097
  misc_feature: Ceres CLONE 1554893

SEQ ID NO: 72185 - DNA, 655 bp, Zea mays
  misc_feature: Ceres CLONE 1554899
  misc_feature: Encodes the peptide sequence at SEQ ID NO. 72186
  misc_feature (172)..(172): n is a, c, t, g, unknown, or other
  misc_feature (411)..(411): n is a, c, t, g, unknown, or other
cgattgggtaccgggccccccctcgagccctgcagtggtaaagggtgctttcttagaggtgggttggcttctcctccccctccggttcgggttcgggttcgtgaggttctccggggttcggtttcgtgggtgagcggatcgagatggcggcgtcggatgttgagtaccgctngcttcgtcggcggcctcgcctgggccacggacgaccactccctccacaacgccttcacacctacggcgaggtctcgagtcaagattatcctcgatcgggaacgcagaggtcccgcggcttcggcttcgtcaccttctccacggaggaggcgatgcggaacgccatcgagggcatgaacggccaggagcttgacggcccgcacatcaccgttcacgaaggcccgtccccgcggccggccnttgaaggccgccggcggccggcttccggtgggtggcccctggaagcgcggcggccttcccgcggggggggcgggggcccccctttatgggggggggggggggtttcccgggggggggggggggggggggttcagggggggggggggggggtccccggggggggggggggggggggccctccccgggtgggggcaccccctggggggggggggttttgggggaacttccctggggggaatggggg

SEQ ID NO: 72186 - protein, 170 aa, Zea mays
  misc_feature: Ceres CLONE 1554899
  misc_feature (10)..(10): Xaa is any aa, unknown, or other
  misc_feature (90)..(90): Xaa is any aa, unknown, or other
MAASDVEYRXLRRRPRLGHGRPLPPQRLHTYGEVSSQDYPRSGTQRSRGFGFVTFSTEEAMRNAIEGMNGQELDGPHITVHEGPSPRPAXEGRRRPASGGWPLEARRPSRGGGGGPPLWGGGGVSRGGGGGGVQGGGGGVPGGGGGGGPPRVGAPPGGGGFWGNFPGGNG

SEQ ID NO: 72187 - DNA, 676 bp, Zea mays
  misc_feature: Ceres CLONE 1554900
  misc_feature: Encodes the peptide sequence at SEQ ID NO. 72188
cgattgggtacgggccccccctcgagcactgcagtggtaaaggccccgccgcacagacagctcggccggaaaccctcgccgccgagtgggtttacgagaacagaagcaaatgaatatgtttctcggctcgctcacgcggagcccgagcaaggaggctgctatacagcatctgcggtcgcacatcatcatcatggcctcctgcgccgcagtaatccgcgccacccgcttacatcactcaatttcctcggccgcgacggagacatccaggaagtacaaggtagatctgtaggcccgtcctgttgcttccccacactgcagaggtgctgaaaaaggaaacacgtgatgtcgagcccactgtaaagcactatggatttagtggctatagcgactactataactgcttttgttgtcccaagtttagtgacaaactgacaatggtgtagcaactggcttgtgctgcaacaagtattccgtttctgcctatgtgtatggcctcatctttgtttgcactggtggattttcgcagatgttatcattcaagcaatgttcatgagacaaaagaaaaaaaaagacgcagatctctgggaattactagcaccgcggggatcaacaagattaacagcggccggcaccgatgtggatcatcagcttctgttccaatagtgcaggttaatct

SEQ ID NO: 72188 - protein, 59 aa, Zea mays
  misc_feature: Ceres CLONE 1554900
MNMFLGSLTRSPSKEAAIQHLRSHIIIMASCAAVIRATRLHHSISSAATETSRKYKVDL

SEQ ID NO: 72189 - DNA, 808 bp, Zea mays
  misc_feature: Ceres CLONE 1554901
  misc_feature: Encodes the peptide sequence at SEQ ID NO. 72190
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (157)..(157): n is a, c, t, g, unknown, or other
  misc_feature (159)..(159): n is a, c, t, g, unknown, or other
  misc_feature (426)..(426): n is a, c, t, g, unknown, or other
  misc_feature (442)..(442): n is a, c, t, g, unknown, or other
  misc_feature (452)..(452): n is a, c, t, g, unknown, or other
  misc_feature (458)..(458): n is a, c, t, g, unknown, or other
  misc_feature (505)..(505): n is a, c, t, g, unknown, or other
  misc_feature (511)..(511): n is a, c, t, g, unknown, or other
  misc_feature (689)..(689): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttntntttttgccgaattggggttaccgggtccccccctcgtaccactgcagtggtaaaggtgaagagatactgtatcacaggaacctcttcaggcttcaaggcaggtccgcagcagatggaggcgaagagcaggctgccggaggtgaccatcgtcccgacggcacggccgttggctggcgacggcacaggcgacgcggctgaatgcggcgtgctggcaagggagcccgtaagcccgggcactccgtcctcggtggccgccggccgcatcanctgtgaggagaagcgncgcgtggacngcgtcnccctgcctgggtgggagctcgacgcccctctgccagagtcctgcccngtcgcngccatgaagggcccgcttccccctactaacttctgaaaactttccggttgcaatccctgcctgaatttctttgaacggggaaacatcgggggaatggccctttaaaacactaaaagggggttccccctgggggggttttcccctggcccaggaaattttccccttttggggcccgggnccggggggggggggggaataaggggggggtttttttgggggtggggggggggataaaaaaaaaattttggaaaactttttttttttaaaaaaaaaaaaaaaaaaaaaaaaacccccgcc

SEQ ID NO: 72190 - protein, 91 aa, Zea mays
  misc_feature: Ceres CLONE 1554901
  misc_feature (52)..(52): Xaa is any aa, unknown, or other
  misc_feature (61)..(61): Xaa is any aa, unknown, or other
  misc_feature (63)..(63): Xaa is any aa, unknown, or other
MEAKSRLPEVTIVPTARPLAGDGTGDAAECGVLAREPVSPGTPSSVAAGRIXCEEKRRVDXVXLPGWELDAPLPESCPVAAMKGPLPPTNF

SEQ ID NO: 72191 - DNA, 706 bp, Zea mays
  misc_feature: Ceres CLONE 1554906
  misc_feature: Encodes the peptide sequence at SEQ ID NO. 72192
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (111)..(111): n is a, c, t, g, unknown, or other
  misc_feature (112)..(112): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (135)..(135): n is a, c, t, g, unknown, or other
  misc_feature (268)..(268): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagttttttnnttnnngcgaattggggtacgggnccccccctctagccacttcagtggtaaaggtgctttcttagaggtgggtttggcttctcctccccctccggtttcgggttcgggttcgtgaggttctccgggagttcggtttttcgtggggtgagcggatcgnagatggcggcgtcagatgttgagtaccgctgcttcgtcggcggcctcgcctgggccacggacgaccactccctccaaacgccttcagcacctacggagaggtcctcgagtccaagattatcctcgatcggggaggaacgcagaagggtcccgcgggctttcggcttttgttcacctttctccacggaaagaaggccaattccggaaaccccctttcgaaggggcttgaaaacgggaaaaagaaaatttggaaaggggccaaaaaattttaaccggtaaaaaaaaaaggcccaattttcccccgggggggcccttttaaaaaagggggcggcggggaacaaaaaggggggggggggcccctaaaaaaagggggggttttaaggggggggggggggggggcgccctttattttatgtggggggggttaaaaaaagggggg

SEQ ID NO: 72192 - protein, 91 aa, Zea mays
  misc_feature: Ceres CLONE 1554906
MAASDVEYRCFVGGLAWATDDHSLQTPSAPTERSSSPRLSSIGEERRRVPRAFGFCSPFSTERRPIPETPFRRGLKTGKRKFGKGPKNFNR

SEQ ID NO: 72193 - DNA, 654 bp, Zea mays
  misc_feature: Ceres CLONE 1554907
  misc_feature: SWISSPROT Homolog: EC 1.11.1.6 Catalase
cgattgggtaccgggccccccctcgagccactgcagtggtaaaggacttccttaccactgcagtggtaaggccgtcaggcatctgctgctgcaagatatatatgaatcatccatccattgataatgcggtgccatgcgatctgacattctttttggcggtgcagggaggagttggtgaggaggttcaaggctgcggtgctgggacgtgagtgaagtgaacctgctgaagctactctgctgtgaagctgggacaagggccagttgaaggctagaagctgtaaatacacccttcaacagtcttcagacattgatgtatccggggctttcttgaataaatcgattgaatggaataatgaggcttatcgagattaaaaaaaaaaaaaaaaaaccagagctctgggaattcctgcagcccgggggatccactagttctagagctaccgccaccgcggtggagctccagcttttgttccctttagtgagggttaatttcgagcttggcgtaatcatggccatagctgtttcctgtgtgaaattgttatcccctcacaattccccacaacatacgagcccggaagcctaaagtggaaagcctgggggggcctaatgagtggacctaacccccattaaattgcgttgcccccccacggcccc

SEQ ID NO: 72194 - DNA, 1130 bp, Zea mays
  misc_feature: Ceres CLONE 1554908
  misc_feature: Encodes the peptide sequence at SEQ ID NO. 72195
agaattccccaccaccaccagcagcgcaggcgacgcggcccgatcccatccaccgccccgctgaagaccccgcgccgatgcggccgccgtcgccgttgccgtcgtcgccgcgcccgcctgtcgcgttcccgacgctggactcgctggcggcgttcctccggccgcggctccctcccggggcgctctcctcctggggcgccgtgccggggaccaagaccctcgcgaacctgttcctggagctcgccgtgggcgactgcgcgctggacgccgcctcgccgcggctggtccgcgcggtgcacgtggccacggtccgcatccgcaaccggcgcggcgcgcggctcgtggaaacccggcagctgctctccgacggcacggtccggcggcgcggcccgcggccgctgtccgagaagatgcggcccggcgagtcccccgaggccgccgcggcgcgcgccgtccgggaggagctcggcgcccgcgcccgcgtccggatcctcggcggggccggcgcgcgcgtggaggagcgggagtccgcgtcctacccgggcctccccgcccgctacgtgctccacgcggtcgacgccgaggtggtggacggcgtgcccgaggacggcgagttcgagaccgaggaggccggcgaggacgacgccgccggtgccatcaccgtgaagcgccactactgggattggatcgaagacgatgacgacggtgacagtgagcgcaaggaagttgctgctgccggcgcgcgcgcgcactaggactaggggctgctccgtcagtggtgcatgccgagcaaatcgtctgtctcctcctgatgattctgttggcaacttccctgcctcagatgagctcagtaggtttgcagtatcagctcacattatcgtttcagtttcagagatgaaatcgggaactgctcgttcctcccaaaactgaaaacgcacccaatcaagaacaaaccgatcaccctgctcccaagtctgaacatatagggagtgctgtactgtaggctacttttgttgcttccagcttctgtgcgggatcataaggacgattatacatatgtaaaaggaaccgtggaatgtaaccgatcaaaatttgtctttttctgggtgatgaaaaaaaaaaaaaaaaaa

SEQ ID NO: 72195 - protein, 225 aa, Zea mays
  misc_feature: Ceres CLONE 1554908
MRPPSPLPSSPRPPVAFPTLDSLAAFLRPRLPPGALSSWGAVPGTKTLANLFLELAVGDCALDAASPRLVRAVHVATVRIRNRRGARLVETRQLLSDGTVRRRGPRPLSEKMRPGESPEAAAARAVREELGARARVRILGGAGARVEERESASYPGLPARYVLHAVDAEVVDGVPEDGEFETEEAGEDDAAGAITVKRHYWDWIEDDDDGDSERKEVAAAGARAH

SEQ ID NO: 72196 - DNA, 697 bp, Zea mays
  misc_feature: Ceres CLONE 1554914
  misc_feature: Encodes the peptide sequence at SEQ ID NO. 72197
  misc_feature (252)..(252): n is a, c, t, g, unknown, or other
  misc_feature (269)..(269): n is a, c, t, g, unknown, or other
  misc_feature (680)..(680): n is a, c, t, g, unknown, or other
acgattgggtaccgggccccccctcgagccctgcagtggtaaaggggtcacaagcctccacagaactctccccgactttgccgtccactcccccgccgcagccgcgccgttcgccgggacaggagggatagtagagcaccaggatgccggcgacgccgacgatcatcggcgccctcctggggctgggcacccagatgtactcaaacgctctccgcaagctcccctacatgcgccatccatgggagcatttgnttggggaatgggtctcnggtgcagtgtttgtgaaccagctggtaaagtttgatgagaagctcaaggaggacctcgacaagatgcttgagcgcgccaagctagcccacgagcagcgctcctttgacgatgatgaaatagatgcccccaattttttttgcccacccaccctgttttttttttttttggcaaaaattgtttgtccgggtcaccaattgggccaggaaatgataatccccccctcctttttaattttccctaagcttttccgcctttttcaactgggggatcttgggaaaaaaaaaggtccgattactccggggttttcccccaagggttaacccccccaattttggggggtcttgtgaaactagaaggggggggcgtttttcccccgcaaaaaaatattccccccctttttttaaaaaaanaaaaccccccccccccc

SEQ ID NO: 72197 - protein, 148 aa, Zea mays
  misc_feature: Ceres CLONE 1554914
  misc_feature (37)..(37): Xaa is any aa, unknown, or other
MPATPTIIGALLGLGTQMYSNALRKLPYMRHPWEHLXGEWVSGAVFVNQLVKFDEKLKEDLDKMLERAKLAHEQRSFDDDEIDAPNFFCPPTLFFFFLAKIVCPGHQLGQEMIIPPSFLIFPKLFRLFQLGDLGKKKGPITPGFSPKG

SEQ ID NO: 72198 - DNA, 673 bp, Zea mays
  misc_feature: Ceres CLONE 1554932
  misc_feature: Encodes the peptide sequence at SEQ ID NO. 72199
ccgattgggtaccgggccccccctcgagccctgcagtggtaaagggcagaagtttagaagaacggggagggaagcacgcccccaaacgttccgaggtttcgcctctcggagcgcaccaacgccacccggagcgactcgccaccggcgcggagaaggtacaaaaccagagctatactgccgatctgggcggtctaggggcgcgtctttcggagggcggaggctaggcgatggcggacgagaatgaggctgggaagaaagaggaagaggaatttagcacaggccctctgtcagtactaatgatgagtgttaagaacaacacccaggttctcatcaattgccgcaacaacaagaagctgcttggccgggttcgtgcttttgatcgccactgtaacatggtgctcgagaacgtgcgggagatgtggacagaggtccccaagactggcaagggcaaaaagaaggctctgcctgtgaacaaggatagattcatcagcaagatgttcctcaggggcgactcggtcatcatcgtgctgaggaaccccaagtgacagcccaaccggaagccaggtctctgttgaaaactgtagcttatgatgtatgttggggaatgattaaggccttgttcgtttacgtcggattgcaaccggaatcattccagctaatcaaagtttatata

SEQ ID NO: 72199 - protein, 105 aa, Zea mays
  misc_feature: Ceres CLONE 1554932
  misc_feature (23)..(102): Pfam Name: LSM Pfam Description: LSM domain
MADENEAGKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 72200 - DNA, 669 bp, Zea mays
  misc_feature: Ceres CLONE 1554937
  misc_feature: Encodes the peptide sequence at SEQ ID NO. 72201
  misc_feature (395)..(395): n is a, c, t, g, unknown, or other
  misc_feature (669)..(669): n is a, c, t, g, unknown, or other
cgcggtggcggccgctctagaactagtggatcccccgggctgcaggaattcgtctcacccctagaaaaagacgtgtattgttatttgctaaccacaggaccgaggttgactggatgtacttgtgggatcttgcactgaggaaaggccatttaggatatatcaagtacatacttaagagcagcttgatgaagttgcctatttttagctgggcatttcacatttttgagtttatcccggtagaacggaaatgggagattgatgaagcaattattcagaacaagctatcaaaatttaagaacccgagagatcctatctggttggcggtttttcctgaaggcacggattatactgacaacacatgcatcatgagtcgagagtatgcttcaaaaaatggnttgcctatgctaaaacatgtcctccttccaaagacaaaaggcttcatttgttgtttgcaaaacctgaggagttccttacaatgccgtttatgatgtcacaaaagcatacaagcatcgactccccagattttctgggacaatggggaatggggtttaataccttccggagacccccctcccaccttccaaaagggtttcagcttccttccccattccccccccacaaaaaaaaacaaaaacacacccaaatgggcagggtaaacaaaaggttttn

SEQ ID NO: 72201 - protein, 124 aa, Zea mays
  misc_feature: Ceres CLONE 1554937
  misc_feature: SWISSPROT Homolog: EC 2.3.1.51 1-acylglycerol-3-phosphate O-acyltransferase
MYLWDLALRKGHLGYIKYILKSSLMKLPIFSWAFHIFEFIPVERKWEIDEAIIQNKLSKFKNPRDPIWLAVFPEGTDYTDNTCIMSREYASKNGLPMLKHVLLPKTKGFICCLQNLRSSLQCRL

SEQ ID NO: 72202 - DNA, 631 bp, Zea mays
  misc_feature: Ceres CLONE 1554938
  misc_feature: Encodes the peptide sequence at SEQ ID NO. 72203
  misc_feature (562)..(562): n is a, c, t, g, unknown, or other
cgcggtggcggccgctctagaactagtggatcccccgggctgcaggaattcgtctcacccctagaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgaatatgtcgtggagtccaccggcgtcttcactgacaagggacaggctgctgcacatctcaagggtggtgccaagaaagtggttatctctgcccccagcaaagatgcacccatgtttggtgttggtgtcaatgangacaagtacacctccgatgtaaaatttgtttccaatgctagctgcaccaaaaacggccttggtcccctt

SEQ ID NO: 72203 - protein, 162 aa, Zea mays
  misc_feature: Ceres CLONE 1554938
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
  misc_feature (139)..(139): Xaa is any aa, unknown, or other
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKGQAAAHLKGGAKKVVISAPSKDAPMFGVGVNXDKYTSDVKFVSNASCTKNGLGPL

SEQ ID NO: 72204 - DNA, 701 bp, Zea mays
  misc_feature: Ceres CLONE 1554941
  misc_feature (221)..(221): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (382)..(382): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (387)..(387): n is a, c, t, g, unknown, or other
  misc_feature (397)..(397): n is a, c, t, g, unknown, or other
  misc_feature (398)..(398): n is a, c, t, g, unknown, or other
tggcggccgctctattactactggatcccccgggctgcaggaattcctctcacccctagaaaaaaaggaacaacgcagacaaaccgaactcgcacctcgcacctcgcatcgtcttgtcgacacacctccagctccgaaaccctactccgccggcgatgtcgtcatccggcgccccggccccggcggcggcaatggccgttgacaacgcggaggactaccanctcgcctccctgtccacggaggatatcatcccgggcctcccgccttctttgacaacgagagccgtggcctccaggacgatttgctttttacgaaccctggagttggagtcgttcctggtttttttttcctccccaccccggggaaaagaaaaaggggnnnnnnncncctccccctnnctccgttggggcctatctaaaaaaaaatttaacaaactggccccctgggggggggggggcttccattaaaccaccctttctcccccttcccagctttaagacccccccagggcaaaacggtaaatcgcggctggcacccagaaacacctccctccaacgttagccccttttttttcctcccgtcgctgtttgcacccgcctgccacctttgccacagccatgcccgcccggataccctttcgagttcccttctaccttacttcctgtgggctcgtccatcctgcctttctacgaggctgtctc

SEQ ID NO: 72205 - DNA, 644 bp, Zea mays
  misc_feature: Ceres CLONE 1554942
  misc_feature: Encodes the peptide sequence at SEQ ID NO. 72206
ggagctccccgcggtggcggccgctctagaactagtggatcccccgggctgcaggaattcgtctcacccctagaaaaaacaaccgaacgacgaagcgtccgatccaatagggccggctagcaagtgcatgcacacgcgtagcagctaataactgcccggtgcctgcctttgtgacatatagagaggcagctgctaccgtacggtcgacagagatatagatcgatggatgcgaggaggaggagcagcgcgccgctcgtatcggtggccgccgccgccgccgccgtcgcgctgctgctggtgctcgccgccgagccgtcccgcgcggagcggttcgtcgtctgcgactcggcgcggtggacgtgcggatactactacgcggactgggtcatcaggaatgggcccttcttccagaacgacactccttgtgttcatgtacgaacctcccaaacgcgactggtgcacgtcgcaacatcgtgtacctggatgcgcacccgccgtgaactacccagtccgtgcaacctcaatgcgcccaaagcttggtgggccagcgatcacccaagggcgccccaggctccaggctttcgaaatttccgtgcctcccggaaaagcagcaatacaggccatttaactttccgtggggcggg

SEQ ID NO: 72206 - protein, 140 aa, Zea mays
  misc_feature: Ceres CLONE 1554942
MDARRRSSAPLVSVAAAAAAVALLLVLAAEPSRAERFVVCDSARWTCGYYYADWVIRNGPFFQNDTPCVHVRTSQTRLVHVATSCTWMRTRRELPSPCNLNAPKAWWASDHPRAPQAPGFRNFRASRKSSNTGHLTFRGA

SEQ ID NO: 72207 - DNA, 645 bp, Zea mays
  misc_feature: Ceres CLONE 1554946
  misc_feature: Encodes the peptide sequence at SEQ ID NO. 72208
ggagctccccgcggtggcggccgctctagaactagtggatcccccgggctgcaggaattcgtctcacccctagaaaaaagcgaggtgattgcaatggtggcctccactgcttcccgcctctcgcccccgcgcttcagcaccccttccccgtctcttcatcctccaaaccgccgctcgcgcttctcccctgttcgcgcagccaagttggaagctgtgctgtctattggtgctcatctaatcccacacccaagaaaggctgcaagtggcggagaagatgctttctttgccaatagcgatgctggcggagtatttgccattgcagatggtgtctcgggatgggcagaaaagaatgtcaatccagctctattctctcgagagctcatgagaaacagctctaatttcctcaatgatgagggggtcagtcatgatcctcatattcttctcatgaaagctcatgctgcaactttcttctattggaatctgcaacagaaatcatcgccatggcttgaaaaagaccgggactctaaaaaattgcaagggggggaaaattggggggttgaaagtttattcgtaaagggcaaaggaaaggttccctaaaatccccctcaaaaaaatttttttttgaccggccccttaccaaaatac

SEQ ID NO: 72208 - protein, 167 aa, Zea mays
  misc_feature: Ceres CLONE 1554946
MVASTASRLSPPRFSTPSPSLHPPNRRSRFSPVRAAKLEAVLSIGAHLIPHPRKAASGGEDAFFANSDAGGVFAIADGVSGWAEKNVNPALFSRELMRNSSNFLNDEGVSHDPHILLMKAHAATFFYWNLQQKSSPWLEKDRDSKKLQGGENWGVESLFVKGKGKVP

SEQ ID NO: 72209 - DNA, 886 bp, Zea mays
  misc_feature: Ceres CLONE 1554947
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (38)..(38): n is a, c, t, g, unknown, or other
  misc_feature (39)..(39): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
tgtgcgttttgttctccatattttannntnnnannccnnccgactnnnntatttttatatttctccgctcggtggcggccgctctagaactagtggatcccccgggctgcaggaattcgtctcacccctagaaaaacaggatcttacattttaaaagtccctgagtgattgtttttaaaagttcctgagtgattgtttttccttgagccaatcaaaattgggtgcttcccacccatagaaaattttgtagtatggcctactctcgtaatcacccgatttacgtctaaatcccacgctcaacctacagatacaatcaacccgcacgctagctgtcagctgaaccttcattatgacctccttttccgccaccaccccccattcactatatctttcacttatcactcccctagacccgcgtccaccgcctggacatatacgtttaattattaccccctacgtcagggtggggggggggggtcatcctccgcacttaacccccctcccattgttgttgcctcccccccctgttcatcccccttaccctcaacaaccccatacgcccatccgcctccccccccgcctcgacccatctcttccccactctcccctttattatggtaggtgtcatgtaccaccaccaccaatacctccccactctttccctgacttaaattcccccccacacctaccactctataatatatcctccgcaccccctatcaccccgcacaccaccctcacaggaatcgaccattacgccacccattcccccgcttttgcccgctcatataccactgccccttattcttctctacccccgcccgccttatatccccgcattcgacacactgttcaccgcacgaaccactccctttcatctccatcg

SEQ ID NO: 72210 - DNA, 632 bp, Zea mays
  misc_feature: Ceres CLONE 1554949
  misc_feature: Encodes the peptide sequence at SEQ ID NO. 72211
  misc_feature (253)..(253): n is a, c, t, g, unknown, or other
cggtggcggccgctctagaactagtggatcccccgggctgcaggaattcgtctcacccctagaaaaagtgttttggtggaagcaacaagtggaaacacaggcattggtcttgccttcattgctgcttctaaaggatataagctgatactaacaatgccttcatcaatgagcatggagagaagagtcctcctcagagcttttggtgctgaacttgtccttactgatgctgcaaaagggatgaaaggggccttanataaggctacagagattttaaacaagacaccaaattcttacatgcttcaacagttcgataaccctgccaaccctaaggtacattatgagactactggtccccacatctgggaggagtcaaaggggaaggtggatatattcattggtggaattggaacaggggggacaatatctggtgccggccgttttctcaaggagaaaaatcctggaattaaagttattggtattgaaccttctgaaaaatacatactctccgggggaaaaactggtccccataaaatccagggaatccgcccaagatttgtttccaggaatttgggaaagcgatattcttgatgaaataatttgaaatatcacggggatgaagccttttgaaaaaa

SEQ ID NO: 72211 - protein, 140 aa, Zea mays
  misc_feature: Ceres CLONE 1554949
  misc_feature (1)..(141): Pfam Name: PALP Pfam Description: Pyridoxal-phosphate dependent enzyme
  misc_feature: SWISSPROT Homolog: EC 2.5.1.47 Cysteine synthase
  misc_feature (30)..(30): Xaa is any aa, unknown, or other
MSMERRVLLRAFGAELVLTDAAKGMKGALXKATEILNKTPNSYMLQQFDNPANPKVHYETTGPHIWEESKGKVDIFIGGIGTGGTISGAGRFLKEKNPGIKVIGIEPSEKYILSGGKTGPHKIQGIRPRFVSRNLGKRYS

SEQ ID NO: 72212 - DNA, 814 bp, Zea mays
  misc_feature: Ceres CLONE 1554950
  misc_feature (19)..(19): n is a, c, t, g, unknown, or other
  misc_feature (20)..(20): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (290)..(290): n is a, c, t, g, unknown, or other
  misc_feature (814)..(814): n is a, c, t, g, unknown, or other
gtcccctctttccccgctnntatccnnnnnnnnnnnngggcgcaannnntgcaaaaaacatttaaaaaatgttgacgctctaaaatagggatcccccgggctgcaggattcgtctcacccctagaaaaaaccaccagttccttgttcggtcggaacgcagcgcagcggcggcggcgatagggagagaggagagagtctgcatgatctagcaggccgagggaggagtccgcggcgggccggagaaaatgagcggcaacggcgcgaagaaagtggtccatgcccccgtgaangccggcaggacaatcatccactgggacggtttggccaattttttttcctcaccgggggaggggcgcaagggctccccccgctcttttttcggacttatcaagaagggaaaaccccgagattttttttttcccccccccccccgggggaaagaaaggggggagaatcccaacacctcccccaaaattttatttttaaccacaaaacaaaaaaaaaaaaaccaaaactaaggcatcggggcgccgcccccttcaattcgcggaaaacgtcccaccacatatatccaccgccacccctaccccaatcccccaccctattgtccccttcccccattgcttcttccgccgccggcgcgacattgctaattacaagtcgttttctggagtgcgcccaaagaagtgcaccacatacggaaggaccgcaccccgcgcgcccctgcagagcacaacgattaaccaccaacccgcagtccgcccagggtcctcgccggccacgagcccgttagtccgccgcaccccgaaccccn

SEQ ID NO: 72213 - DNA, 697 bp, Zea mays
  misc_feature: Ceres CLONE 1554952
  misc_feature: Encodes the peptide sequence at SEQ ID NO. 72214
  misc_feature (1)..(1): n is a, c, t, g, unknown, or other
  misc_feature (697)..(697): n is a, c, t, g, unknown, or other
natagctggagctccccgcggtggcggccgctctagaactagtggatcccccgggctgcaggaattcgtctcacccctagaaaaaccggcttcgtttcgtgctttcctcaacctcccctcttccgtgccgcacagtttatccgctgcttcacggaaatccttacggggctgcatatactatattccctgcgttccaggcggccccgcccccgccccccaccggctcttgctgtctcctctcgcacggtcgcaccccgctagcctcccggcgtcccaatcccaggaacttccgtcgcgtcaggtgatgctttcagcaactacaggtgtaggacaatgtcgatgaactatgatggggataggagtgaggaccgccaccgcgaggggggggggggggcatacaaaagggacagtgacgttggtgaggaaatgataataagtaccgaagagcaaaatggtgagaatgaatggatctggttgaaaccagatagaaaatgtggatccttttgcttaatcggttttcctcccttcctaacaacacagccaatccctccaaaatgaaaaaccaaaaaattatcccaacctgggcaaaaaaaattttgaggtcggagaaaatccccctttccggaaaacaagaaacaacaatgggggatcctcttttggccgaataaaaggagggcttgaatgctgttccgaaaan

SEQ ID NO: 72214 - protein, 74 aa, Zea mays
  misc_feature: Ceres CLONE 1554952
MSMNYDGDRSEDRHREGGGGAYKRDSDVGEEMIISTEEQNGENEWIWLKPDRKCGSFCLIGFPPFLTTQPIPPK

SEQ ID NO: 72215 - DNA, 766 bp, Zea mays
  misc_feature: Ceres CLONE 1554953
  misc_feature: Encodes the peptide sequence at SEQ ID NO. 72216
  misc_feature (46)..(46): n is a, c, t, g, unknown, or other
  misc_feature (47)..(47): n is a, c, t, g, unknown, or other
  misc_feature (54)..(54): n is a, c, t, g, unknown, or other
atattttttttttgtctgttgtggtggtgttatttttttttttaanngaaaggnaacaaactggaaatccccgcggtggcggccgctctttaactagtggatcccccgggctgcaggaattcgtctcacccctagaaaaaccggcttcgcttcgtgctttcctcaacctcccctcttccgtgccgcacagtttatccgctgcttcacggaaatccttacggggctgcatatactatattacctgcgttgcaggcggtcccgcccccgccccccaccggctcttgctgtctcctctcgcacggtcgcaccccgctagcctcccggcgtcccaatcccaggaacttccgtcgcgcccggtgatgctttcagcaactacaggtgtaggacaatgtccatgaactatgatggggataggagtgaggaacgacaaaacgaggaggtccagacaacatacaaaacggacattgactttggcgagggaaatgataattaggtaagtcgaacaccaaaatgatgataatgaatggaactagggtgaaacccagatacgaaatggtgatccttttctgctgaaatcggatttccctccacttcattacgaacactccccaaattccctcccaaaattggaaataccgacaaatttgtgcaataactcttgttcccagcctactttgcatggcttaaacgaaattccccccttttcccgggttacccatagggaacccatacaatgcgtagatccacctccttttgcccgcatatt

SEQ ID NO: 72216 - protein, 34 aa, Zea mays
  misc_feature: Ceres CLONE 1554953
MSMNYDGDRSEERQNEEVQTTYKTDIDFGEGNDN

SEQ ID NO: 72217 - DNA, 708 bp, Zea mays
  misc_feature: Ceres CLONE 1554959
  misc_feature: Encodes the peptide sequence at SEQ ID NO. 72218
tggcggccgctctagaactagtggatcccccgggctgcaggaattcgtctcacccctagaaaaagaagctctcctgagaagcatatagcaccagcggaacacgggaacggcggaagcaaacaactagaaattccccagcccggttctttgcgtgcggttgatctcgtcggaggcccggccgcggttccccaatccgccatcgaattcgatggcggccaacgccgggaataagatccgcaacgccaagctggttcttcttggaaatgtgggcgctggcaaatcaagcttggttcttcggtttgttaatggacattttgttgaattccaggaaacaccaattgtactgcccctcccccccccgggggggggggggcatatgatgaaaactgcaaaatattgaatatttgggaatactggccgggcaaagcagacgtctcccaaccctcgggcttcccctgccaactataagggagtgcacccccccagcccatttggtggtctccctgacccttaagtaacacctaggctcctcttttcccgccgtgtctatgtaaaagggcggtcctaaaaaacctaaaacgctctcttggaaactaagtaatcccctcccctgggtattctcttcactacatcccccgacataccacttgtacacgcgcgcgcgataggtgtgactaaaaaccgaccattaatgtgctaagtgtctta

SEQ ID NO: 72218 - protein, 63 aa, Zea mays
  misc_feature: Ceres CLONE 1554959
MAANAGNKIRNAKLVLLGNVGAGKSSLVLRFVNGHFVEFQETPIVLPLPPPGGGGHMMKTAKY

SEQ ID NO: 72219 - DNA, 678 bp, Zea mays
  misc_feature: Ceres CLONE 1554963
tggcggccgctctagaactagtggatcccccgggctgcaggaattcgtctcacccctagaaaaacgacacaggtgggtaggtagagaatacctaggggcgcgagacaactctctctaaggaactcggcaaaatagccccgtaacttcgggagaaggggtctatctcttcctagttcctacgccgcggcggcgcggcctctccattccggtgtgttctccgatttgggggacgtcccttgcccgctccggagtccggtccagcggagccagctacggcacagatcggcttccgtccgccccttcccatctcaccagactctgcaccgccgcggtgatcgtgcctcggctgcctccctaaattactgctgcgggccgtgctgatgcaaaatggttctattgtagggcgttcccggtgggaaagggtccgttgctagcttgttccgggggaatgagcaagtttttaggagccccccgggttcctggtgtaaggcggatctttttttcggcaagaaggccttccggggtggggcccggattcccttttctgcgcggggcgtggggcccgccgcgtgcccgcggggagggatttctgcggagaggggatgcccccgtccttttccgaggcggcgctataagtccgggagcccagggggcgcgttaagttgtgtgtgtggacag

SEQ ID NO: 72220 - DNA, 706 bp, Zea mays
  misc_feature: Ceres CLONE 1554966
  misc_feature: Encodes the peptide sequence at SEQ ID NO. 72221
  misc_feature (392)..(392): n is a, c, t, g, unknown, or other
tagctggagctccccgcggtggcggccgctctagaactagtggatcccccgggctgcaggaattcgtctcacccctagaaaaaattgttgaagcagccacttcaccttggggccatacagaaatggcggcttcttgcgcctccacactccctccactttccttcgtttcctcctccagttcaccccgccgattcaggcgctctggtgtggtggccatggccagcgttgggcagaaggtgtatgcgcccggtgtggcggtgtcggagggcaatggcgggctgcctaatatcgacctcaaatccccgcacgggagcgaggctgatatttatctgtttggagcgtgtgttacttctttcaaagttccccaccgcccggaagggggggggggttcnaccaaatgctgtgttttaatggacagaaaacccatcaacgggtggaaatccccctttggttccccccaggtttggcccaaatccccatggcagccaacaggggttttgcaccgaaaagggaaattgggccttatccccaaaattcaaaaagtcccagcaagggagttcccgctctgtaaatttttgaaacttaacaaaatagaaaccttattaagcccgtttcttaatggggggaaattttagcgtttccaatggcgccgggtacaaggggttttcccctgggacttctaaaaaaaatttgggccaccaaaccc

SEQ ID NO: 72221 - protein, 170 aa, Zea mays
  misc_feature: Ceres CLONE 1554966
MAASCASTLPPLSFVSSSSSPRRFRRSGVVAMASVGQKVYAPGVAVSEGNGGLPNIDLKSPHGSEADIYLFGACVTSFKVPHRPEGGGGSTKCCVLMDRKPINGWKSPFGSPQVWPKSPWQPTGVLHRKGKLGLIPKIQKVPAREFPLCKFLKLNKIETLLSPFLNGGKF

SEQ ID NO: 72222 - DNA, 685 bp, Zea mays
  misc_feature: Ceres CLONE 1554967
  misc_feature: Encodes the peptide sequence at SEQ ID NO. 72223
ccccgcggtggcggccgctctagaactagtggatcccccgggctgcaggaattcgtctcacccctagaaaaactcgccgcctcctccccactgcctcgtgtggccgtcgtctcccgttcggaacgccaagccccccttccggcgaaatggcccccaagcgaggtggcagggcgccggtgccggccaagaagaagacggataaagtgacgaaccctctgtttgagaagaggccgaagcagttcggcatcggcggcgcgttgccgcccaagaaggatctgcaccggttcgtcaagtggcccaaggtcgtgcgtatccagcgccagcgccgcatcctcaagcagcgcttttttgtcccccccccccctcgggaaagtcagggggacccctcaacaaaaacctctttactaatcttgttaaaaatgattcacaaaaaccggccctgaagacagggttgcccacaaagaaaaggctttctgaagaagggccaaagctgaaaaatgaatgaaaaacctgtttgactccaaaaaaactaattggtgtgggaagaaatgggcctttacaccgtggtgatttcacttcctttggcccaaaacaaagggccaaccttgggtggacgccgcccccagagagctggcatcccactggcacatagcctgttgagacttctcaatcccccgacatcata

SEQ ID NO: 72223 - protein, 98 aa, Zea mays
  misc_feature: Ceres CLONE 1554967
MAPKRGGRAPVPAKKKTDKVTNPLFEKRPKQFGIGGALPPKKDLHRFVKWPKVVRIQRQRRILKQRFFVPPPPRESQGDPSTKTSLLILLKMIHKNRP

SEQ ID NO: 72224 - DNA, 658 bp, Zea mays
  misc_feature: Ceres CLONE 1554976
  misc_feature: Encodes the peptide sequence at SEQ ID NO. 72225
tccccgcggtggcggccgctctagaactagtggatcccccgggctgcaggaattcgtctcacccctagaaaaaactccgctcggccaccagctttgaccgcctcccctcccctccgctcctgttcttccataccccactcccccgcaggagcggcgcggcggcggcaaaggcaaaggcaagatgttcgggcgcgcgccgaagaagagcgacaacaccaagtactacgagatcctcggggtgcccaagtcggcgtcccaggacgacctcaagaaggcctaccgcaaggccgctatcaagaaccaccccgacaagggcggtgaccccgagaagttcaaggagctcgcacaagcctatgacgccttgagtgagcgggagaaacgtgagatttatgatcagtatggtgaagatgcccttaaggaaggaatgggtggtggtggatcccatgctgatccatttgacattttctcatcattctttgggaccctcttttggaggagggggtggaaacaccagggggaaaaggcaaaggaaggggagaaaagtattccccctccctttaagttcctcttggaaaatctttaacaatggaaccccaaaaaacctctttcttttcgcgcaaggtcatccggctccaaggggaaggggcaaggggttcta

SEQ ID NO: 72225 - protein, 133 aa, Zea mays
  misc_feature: Ceres CLONE 1554976
  misc_feature (13)..(71): Pfam Name: DnaJ Pfam Description: DnaJ domain
MFGRAPKKSDNTKYYEILGVPKSASQDDLKKAYRKAAIKNHPDKGGDPEKFKELAQAYDALSEREKREIYDQYGEDALKEGMGGGGSHADPFDIFSSFFGTLFWRRGWKHQGEKAKEGEKSIPPPFKFLLENL

SEQ ID NO: 72226 - DNA, 639 bp, Zea mays
  misc_feature: Ceres CLONE 1554977
  misc_feature: Encodes the peptide sequence at SEQ ID NO. 72227
  misc_feature (486)..(486): n is a, c, t, g, unknown, or other
  misc_feature (639)..(639): n is a, c, t, g, unknown, or other
tggagctccccgcggtggcggccgctctagaactagtggatcccccgggctgcaggaattcgtctcacccctagaaaaactcaaacgccacttgttctccctccctctctgcctgaccagctaggatcagcggaagcagcaatggtgatggcgtcgtcgagcgggctgaggagctgcagcgccgtgggcgtgcccagcctgctggcgccgtcgtcccggtccggccgcctggcgccgttctgcgccaacgccaccacctctggccgcgtcaccatgtccgcggagtggatgcccggccagccacgccctgcccacctcgacggctcctctcccggggacttcggcttcgatccgctgggcctcgcgaccgtgccggagaacttcgagcggttcaaggagtcagaggtgtaccactgccgctggggcatgcttgccgtccccgggatcctggtgccggaagctctgggcctggggcactgggtgaanggcgcagagtgggcggccgtccccggcgggcaggccacgtacctgggcgccccggggccgtgggggacgctgcccaccattccgggggatccaagttctggccctcgccttccccaagcaccaggcaccttgggaaaggaccccgaaaaaaan

SEQ ID NO: 72227 - protein, 165 aa, Zea mays
  misc_feature: Ceres CLONE 1554977
  misc_feature (54)..(166): Pfam Name: Chloroa_b-bind Pfam Description: Chlorophyll A-B binding protein
  misc_feature (115)..(115): Xaa is any aa, unknown, or other
MVMASSSGLRSCSAVGVPSLLAPSSRSGRLAPFCANATTSGRVTMSAEWMPGQPRPAHLDGSSPGDFGFDPLGLATVPENFERFKESEVYHCRWGMLAVPGILVPEALGLGHWVXGAEWAAVPGGQATYLGAPGPWGTLPTIPGDPSSGPRLPQAPGTLGKDPEK

SEQ ID NO: 72228 - DNA, 698 bp, Zea mays
  misc_feature: Ceres CLONE 1554983
  misc_feature: Encodes the peptide sequence at SEQ ID NO. 72229
  misc_feature (170)..(170): n is a, c, t, g, unknown, or other
  misc_feature (182)..(182): n is a, c, t, g, unknown, or other
  misc_feature (346)..(346): n is a, c, t, g, unknown, or other
  misc_feature (375)..(375): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
  misc_feature (379)..(379): n is a, c, t, g, unknown, or other
  misc_feature (380)..(380): n is a, c, t, g, unknown, or other
  misc_feature (381)..(381): n is a, c, t, g, unknown, or other
  misc_feature (383)..(383): n is a, c, t, g, unknown, or other
  misc_feature (384)..(384): n is a, c, t, g, unknown, or other
  misc_feature (385)..(385): n is a, c, t, g, unknown, or other
  misc_feature (386)..(386): n is a, c, t, g, unknown, or other
  misc_feature (387)..(387): n is a, c, t, g, unknown, or other
  misc_feature (388)..(388): n is a, c, t, g, unknown, or other
  misc_feature (389)..(389): n is a, c, t, g, unknown, or other
  misc_feature (390)..(390): n is a, c, t, g, unknown, or other
  misc_feature (391)..(391): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (429)..(429): n is a, c, t, g, unknown, or other
  misc_feature (430)..(430): n is a, c, t, g, unknown, or other
  misc_feature (431)..(431): n is a, c, t, g, unknown, or other
  misc_feature (432)..(432): n is a, c, t, g, unknown, or other
  misc_feature (450)..(450): n is a, c, t, g, unknown, or other
  misc_feature (453)..(453): n is a, c, t, g, unknown, or other
  misc_feature (454)..(454): n is a, c, t, g, unknown, or other
ggcggccgctctaaactaatggatcccccgggctgcaggaattcctctcacccctagaaaaaaaaaaccaacgtgcttgatctccctccgccactccatccatctcctcgctcccagtccccgggaagcatggcgttcgtcaccgcccgcgccccggtagcggcccttcncccgtcgtcggnatcgctcaagtcgtcgtcggccttccttgggcactctagccgcctcggccgcaccgcgtctcccacgaggggcaacctcttttctcacgccaagggagagtggttccccggccttctttctttttctaaatagaaggaagcctggccggggtttttttgctctnttccaaaccgggggaaaagaaaagggggnnnnnnnannnnnnnnnnnnnttttttttttttaaaaaataaaaaaaaaaaaatnnnnttcttctgggggggggtnccnnaatcgtccttccccccaccttgatccacccccaaccccgcctttattctcaccccccctccttccactcacaaccccctccctattctaaaatacctttcccccctcttttctcccccccccttttttcgcctctccgatttccttctgctgcacctcccgcctctattatccctttcttgctgcccgcagactcttcccctcatctctcgcgcgctctattttctaatcactccctctttctg

SEQ ID NO: 72229 - protein, 61 aa, Zea mays
  misc_feature: Ceres CLONE 1554983
  misc_feature (14)..(14): Xaa is any aa, unknown, or other
  misc_feature (18)..(18): Xaa is any aa, unknown, or other
MAFVTARAPVAALXPSSXSLKSSSAFLGHSSRLGRTASPTRGNLFSHAKGEWFPGLLSFSK

SEQ ID NO: 72230 - DNA, 663 bp, Zea mays
  misc_feature: Ceres CLONE 1554987
  misc_feature: Encodes the peptide sequence at SEQ ID NO. 72231
  misc_feature (663)..(663): n is a, c, t, g, unknown, or other
cgattgggtaccgggccccccctcgagccactgcagtggtaaaggctggtcacaaggacgccctctacggtagccacaaggacgcccttgacgccaggcgcgacgatgccctcgaggctggccacaggcctcccttgacaccaacacagatatttgtgcacagagccacagactatagcgccctcgtctccggtcagaccagatcaactagctgttcagctttgaaacgaccaacacttgtgcgcagacttgagcgccatcgacgtcgcccacggctctggaatctgctccatttctgagatgacgcacccggttggaagtaatgctacctcaagctcagccatgagattggccaagttgatgtctacacagaagagcaccttctactcacaaaacaaattccatattctctgcatatgctcaagggttgaaaataaaagctgaagcctcttctaggcggattcggaatgtacgtgcacgcgcgcgcgggcatggatatggccgcacatcactatcatcctcaacagctgaggccgatagacattttattcagagtgtcaccagtagcaatgcaaatggtacaactacaaatcctactcaagatgttgttgctattgttgatgaaccacagatcggacacattatattgatagtattcagacn

SEQ ID NO: 72231 - protein, 47 aa, Zea mays
  misc_feature: Ceres CLONE 1554987
MTHPVGSNATSSSAMRLAKLMSTQKSTFYSQNKFHILCICSRVENKS

SEQ ID NO: 72232 - DNA, 817 bp, Zea mays
  misc_feature: Ceres CLONE 1554988
  misc_feature: Translation starting site: 200
  misc_feature (12)..(12): n is a, c, t, g, unknown, or other
  misc_feature (13)..(13): n is a, c, t, g, unknown, or other
  misc_feature (19)..(19): n is a, c, t, g, unknown, or other
  misc_feature (37)..(37): n is a, c, t, g, unknown, or other
  misc_feature (38)..(38): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (166)..(166): n is a, c, t, g, unknown, or other
  misc_feature (220)..(220): n is a, c, t, g, unknown, or other
  misc_feature (221)..(221): n is a, c, t, g, unknown, or other
  misc_feature (714)..(714): n is a, c, t, g, unknown, or other
cccttggttttnnttttanaacatgagaaagggtatnntttgtttnnnttttcgattgggtaccgggccccccctcgagccactgctttggtaaagggtgctttcttagaggtgggttggcttctcctccccctccggttcgggttcgggttcgtgaggttctccnggggttcgggcttcgtgggtgagcggcatcgagatggcggcggtcgtgatgttnngagtaccgctgcttcgtcggcggcctcgcctgggcacggacgacactccctccacaacgcttcagcactacggcgagtcctcgagtccagatcatcctcaatcgggagacgcaaaaggcccgcgggtttcggtttcgtcaccttttcccccggaggaaggggaatgccgaacgcccttcaagggcctttgaaccggccaaagaaacttggaacggccccccatcaattccccgtgttaaaaaagggccccatatttccggtggggggggcccccccccctactgccccgcgggggacgtggtggggtatacccgggggtggtggtgccccccttggaaaaggcggcggcgggcgcctatccccccccttgttggtgtctgcggcccccacctcttaatatggcgtgggggtcgggggggcttcaacgcggtgggggggggaggcgggggcgtttcgagggggtggcgcgggggggggcggggccattcaccgntggagtttggtggacggcccaccggccttcagacgccggggtgtgccaacccgagtggcggggcggggtgatcatcgggaaactatcccccgacggggggact

SEQ ID NO: 72233 - DNA, 696 bp, Zea mays
  misc_feature: Ceres CLONE 1554993
  misc_feature (64)..(64): n is a, c, t, g, unknown, or other
  misc_feature (65)..(65): n is a, c, t, g, unknown, or other
  misc_feature (219)..(219): n is a, c, t, g, unknown, or other
cgattgggtccgggcccccctcgagccctgcagtggtaaagggtgattgcggaatttgcttcanncccacaccttcatcagagagcgagacgacacgctcgggacccgcaagcaagaagaacacgagagagatagcaggcaccaggcagggatcaatcatccgtccatggagaaccctaaggagcggggcccacgacgcggcgggcgccaacgccctgnatgacggtgccccgcgtttccgggaacttgggacaccaaagaaaccgggggcccgcctttgccccggaaactacctccccttgggaccttttctcccccaaaaaaaaattttccccgcgaaaatttcccccaaacccaaaaaaaaaaaggggccctttttccccgggccaaaacccttggggggggaaaaaaaaaaaaatcttttttttccccaaagcccccagggccccaaggcccctttaaaaacccccgggggcctttaaacacccccccccccacaaaaatattttggggggcgccccccccccccccgcggggcccccccgaaaaaaaaaaaacccctcccccccccggggggggggggggaaaaaaaaaaaaaatttttcttaaaaaaaattttcttcgccggcggggggtgtttttttccccaccccccccccccacaaaaaaaaaggtgggttttctcccctctttttt

SEQ ID NO: 72234 - DNA, 605 bp, Zea mays
  misc_feature: Ceres CLONE 1554995
  misc_feature: Encodes the peptide sequence at SEQ ID NO. 72235
  misc_feature (23)..(23): n is a, c, t, g, unknown, or other
  misc_feature (24)..(24): n is a, c, t, g, unknown, or other
  misc_feature (265)..(265): n is a, c, t, g, unknown, or other
  misc_feature (279)..(279): n is a, c, t, g, unknown, or other
  misc_feature (297)..(297): n is a, c, t, g, unknown, or other
cgaattgggtaccgggccccccnnctcgagccactgcagtggtaaagggagcggcactcctctccctccctcgctcactcagccaaagctgacagcagcctacaagcaccagcagagctcttgccgatggcggtggccaagcccccgcttcagacggccgcggtcctcctcctcctcctcctggtcgtcgcggccgcgtcgtggctccagaccgtcgacgcagcttcagggttctgctcgggcaagtgcagcgtcccgtgcgggncggggcggcaagcnccccgggcgccgggcccntgcattaggtccctgcggctctgctgcgaggagtgcaactgcgttgccccacgcggggccccccgcccaacgttaaagaatggccctgtttaccggaaatggtcaccccccggccccgggaaaaggcccaagtggccccggaggccccaaaaacccggcccccttgggaattttgcccccccctttggcccccaaaattgcggccccccctcccccccttttgggaaaaaaagcaaccccgttttttttttttcccccccccccccccctaataaaaaatttttttgggtggccaccccccttttttt

SEQ ID NO: 72235 - protein, 159 aa, Zea mays
  misc_feature: Ceres CLONE 1554995
  misc_feature (8)..(103): Pfam Name: GASA Pfam Description: Gibberellin regulated protein
  misc_feature (47)..(47): Xaa is any aa, unknown, or other
MAVAKPPLQTAAVLLLLLLVVAAASWLQTVDAASGFCSGKCSVPCGXGRQAPRAPGPCIRSLRLCCEECNCVAPRGAPRPTLKNGPVYRKWSPPGPGKRPKWPRRPQKPGPLGNFAPPFGPQNCGPPSPPFGKKSNPVFFFSPPPPPNKKFFWVATPLF

SEQ ID NO: 72236 - DNA, 663 bp, Zea mays
  misc_feature: Ceres CLONE 1555001
  misc_feature (54)..(54): n is a, c, t, g, unknown, or other
  misc_feature (55)..(55): n is a, c, t, g, unknown, or other
  misc_feature (268)..(268): n is a, c, t, g, unknown, or other
  misc_feature (275)..(275): n is a, c, t, g, unknown, or other
  misc_feature (284)..(284): n is a, c, t, g, unknown, or other
  misc_feature (285)..(285): n is a, c, t, g, unknown, or other
  misc_feature (289)..(289): n is a, c, t, g, unknown, or other
  misc_feature (293)..(293): n is a, c, t, g, unknown, or other
  misc_feature (294)..(294): n is a, c, t, g, unknown, or other
cgattgggtccgggcccccctcgagccactgcagtggtaaaggtgcagggtccnngcggccggccggcgcgcgcgtccatggtccgggccggggccgtccccgcgctggcgctggccgtggcggccgcgcccacgggccgccgcggagtccgcgctgcggctgctggcggaggcggcgcgctgtggcgaccgcaaagcggccatcggcgccgacgccgcccgagtggcggccgccgtgatgggggcgatgatcccggtggggcccgcngggcggnaggctgccnntggntgcnnctgtggctgtgcctgctgcccccgggcggccggggaaccgggaaggattcccgggaaggcccctttggcctttccccgccccccgaagggcgggtggggggaaaacccttccttgggtggtggatttccaggggggaaattggcccccccaaacccccccctccccgaatgggccccgaaaaaacctcctcttccaaaccgggggcgggattggggccctttttaaaaaaaaagggggtttgggcccccccccctttaaaaaaagcccccaccccccccctttttttttccccccatttttttgtgggtccccgcggggaaaaaacattttcccccccggggaatttttcacaagtgggggggggggga

SEQ ID NO: 72237 - DNA, 658 bp, Zea mays
  misc_feature: Ceres CLONE 1555003
cgattgggtacgtgccccccctcgagccctgcagtggtaaaggagacgcaccagcgcctcgtcgttgtactctaatgccgccactgtccgactgcggatgcctgacgatcgggtcggaagttctgagtgaagatttttagaagacgatgacatggtgctgaatacggaactctgccgcttcagtggccaaaatatctgtcgtgggaaaggcatccggtttattcgtgctgattctcaggtattccttttgtcctactctgaacgtaatcgctgtttcgacaaacgactgatgcctgctcagcttacatggacacgctctgtcaacgaagtgcgcacaagaaagacatccttgctgaacctgtctagaagagacgccacgtcaccaataaaccatactcgaagcccatcgtgggagcttccttggaagtgatccagagcatgagagctgacaatcctgaagtccgagatgctgcatgatatgctgctctacgtgagatcaaggagcgcatcgctaacacgaaggatgacaagaacgcgaagaaggctgaggtgtccaattcccagaacgcgcagacaaagggtgctgttcagaacggttccaaaagccccaacgttgggtggcggcgtgggcaaacgctgataacgaactaagtgtctt

SEQ ID NO: 72238 - DNA, 644 bp, Zea mays
  misc_feature: Ceres CLONE 1555004
  misc_feature: Encodes the peptide sequence at SEQ ID NO. 72239
cgattgggtaccgggccccccctcgagccctgcagtggtaaaggtatatttcatcaaacacgttcctgttaaagacacgcttattaccattattactcactcgaccatggccccgaaatctgctggactctacttgtgaccgatggatgcgttcgttccccgacaggaggactacagagacaaggacgcgctgggaatactcaagtgcaggcacgacttccacgccggctgcatcaagaagtggctgcagacgaagaactcgtgcccagtgtgcaaagcggccgcggcctagtagggagggacacgccagaggaggaggagcaagcgactgttgcgctcgatccgattcatttttaggctcaggtcaagatgtgtatgccgtctattctttttttttttcccgtcctcctagccagggcagccgtgtaaatagatgttcttatgggattaactattatctcttgggttacattggcccagattcttttgttgtatttagcaataacaacccacttgtggaaggtactgatcgtcaagttgttatacattacagtctcatgtcggggttttcggatccgccgacactttgcgaggtatacctcttttggacggtgaagtttggtacacggaaaaaaaaaaaaaaa

SEQ ID NO: 72239 - protein, 49 aa, Zea mays; identical to SEQ ID NO: 71737
  misc_feature: Ceres CLONE 1555004
  misc_feature (12)..(44): Pfam Name: zf-C3HC4 Pfam Description: Zinc finger, C3HC4 type (RING finger)

SEQ ID NO: 72240 - DNA, 953 bp, Zea mays
  misc_feature: Ceres CLONE 1555005
  misc_feature: Encodes the peptide sequence at SEQ ID NO. 72241
gcggaggccgacgcgcacgcagagggagagggggggatccgcaaggaagcgaaacgaaacacaggcaaaagcgaccgagaagggatcgagcagtcagcagcgtttcctcttgcgttcgggcgggcgggcggctgctggtagcgagcgcgaggcttgccgagcgagcgagcgacatgagctactacaggcttggggaccgcgaggagggcgacgaggagctgttcgagacggcatcgtccgtctccagcgccgacgccgactccgactccgacgacgagggcgaccgcttccctagcgccggcgccggcgccgacgcggcgggggccgagggtccgtgcgaccagcaggaccgccgccgccccgtgccgcagccgctgcggaggatgaactcggacagcatctacgacatggcgtccatggtgtcgcagctcccagccaagaaagggctgtcgcggcactacgagggcaaggcccagtcgttcgcgtgcatgtcggaggtgcgctgcctggacgacctgcgcaagaaggacagcccctacaagcagaagaaggtcaagtcgtcgtgcaagggctacgtcgcgctgggagggatgatgatggccaacaagcccccctcctccggatcctgcgccggcctgggcctcgccgccgccaacgggttcaggacgtccccgattcagaacgggtaccagtaggcaggctggcggcttggccagagagcactgcaactgcaactggaggaaggcgtttttgttcctcccgagggtcactgaactgttttttttttctctttatttctttctttccttcttcccgttctagactgcttgttctgccgggatttatttccttcacggacgcattagtctgtgagaattttatgaggtggtgtgatttgttacttgttctgctagaggaacttaccgttcaccgttctgcaaaaaaaaaaaaaa

SEQ ID NO: 72241 - protein, 173 aa, Zea mays
  misc_feature: Ceres CLONE 1555005
MSYYRLGDREEGDEELFETASSVSSADADSDSDDEGDRFPSAGAGADAAGAEGPCDQQDRRRPVPQPLRRMNSDSIYDMASMVSQLPAKKGLSRHYEGKAQSFACMSEVRCLDDLRKKDSPYKQKKVKSSCKGYVALGGMMMANKPPSSGSCAGLGLAAANGFRTSPIQNGYQ

SEQ ID NO: 72242 - DNA, 672 bp, Zea mays
  misc_feature: Ceres CLONE 1555009
  misc_feature: Translation starting site: 80
  misc_feature: Pfam Name: DUF303 Pfam Description: Domain of unknown function (DUF303)
cgattgggtaccgggccccccctcgagcatggagtggtaaagggccagccgccccctcagtggcgtaccccgaccaggcatgcgcatcttcgtgctgtccgggaagagtaacatggccggccgcggcggcgtacaccacatgcaatgggacggcgtggtgcccccagaatgcgcgccggatccgtccatcctccgcctttcctcgtggcagcagtgggaggaagcccgcgagccgctccacgccgacatcgacacaaccatatacctgtggcatcgggcccgggatggcattctcccgcgctgtgctctcgcgcctgcatgaggacacccctggcgcggcgacccacatcgggatcgggctcgtgccgtgcgccgatggcgggacggccatccgggagtggtccctcgggaaacatctgtactatgcagatggtatcccgggcgcgcgtcgcgaccttgtacggcgagatcgaggccatcctatggtaccagggagagagcgacgcctaatccgatgccgacacgagtgcctacttggagaacgtcgagaggctcatctgtaatgtcagggcagatcttgcgatgccgcacttaccctttattctcgttgcacttgcatctgggaataaaaggaaccttgaaaaagtcagagatgctcaatttagtgttaac

SEQ ID NO: 72243 - DNA, 639 bp, Zea mays
  misc_feature: Ceres CLONE 1555015
  misc_feature: Encodes the peptide sequence at SEQ ID NO. 72244
cgattgggtaccgggccccccctcgagccctgcagtggtaaaggggagataccgcaaacggcgacgaatacaatcctctaccaagaagaggactgatcgattgagacagatggacggcggcaaggggagcgggattggtggcaatgatggcaagagcggcgatggcaagaccggcggcagcgctgtcaagggaggaggctcctactccgggggaggcgcgggctcgggcaactcaggtgtacggacttgcggggcatggtgatggtgctgagaagacgggctccggccgcgacggcatgatgaacgctcccggcggcggcggctacatcctccactccgacttcgaggccaacccgaaagagttcttccagggcctccaccagggaggaggcaaacagtagataaatcttgctagacatgttagcaagctagctgcttgttgcatgacaagctagcgtgcgatttgtgatcctgactgaatgtatgggccgtcatcagtctccgtagcctctaaataaaatgttaagctgcttgatcctttttggacatcaaacaaaaacaaaaaaagcaaagctctgggcaattcctgcaactccgggggatccactagattatagaagcggccgccactccggtcga

SEQ ID NO: 72244 - protein, 86 aa, Zea mays
  misc_feature: Ceres CLONE 1555015
DWVPGPPSSPAVVKGRYRKRRRIQSSTKKRTDRLRQMDGGKGSGIGGNDGKSGDGKTGGSAVKGGGSYSGGGAGSGNSGVRTCGAW

SEQ ID NO: 72245 - DNA, 672 bp, Zea mays
  misc_feature: Ceres CLONE 1555019
  misc_feature: Encodes the peptide sequence at SEQ ID NO. 72246
cgattgggtaccgggccccccctcgagccactgcagtggtaaagggagggggtaattcggagcagctagcacacagacagacgaaatggcttccgtcctccaccacctcttcccgctcgtcgtcgtcctcctcctcgcggccgctgccgacgcggccaccttcaccgtgaccaacaactgcccgtacaccgtgtgggcggccgccgtgccgggcggcgggcagcagctggacaacgggcagacgtggagcatcgacgtgccggcgggcacgacgggcgggcgcgtgtgggcgcgcacgggctgctccttcgacggcagcggcaacgggcagtgccagacgggcgactgcggcggcgtgctgcagtgcgcgcagtacaggcaggcgcccaacacgctggccgagttcgggctcaacaagttcgacggcctcgacttcttcgacatctccctggtggacggcttcaacgtgcccatggacttcctgcccgccggcgactgctccggctgcccccagggcgggccgcgctgcgacgccgacgtcacgtcgcagtgccccgccgcgctgcaagcccccggcggctgcgacaacccctgcaccgtgttcaagacggaccaatactgctgcaccggctcggcggcgaacaactgccgggctaccgactactccaagtg

SEQ ID NO: 72246 - protein, 195 aa, Zea mays
  misc_feature: Ceres CLONE 1555019
  misc_feature (30)..(195): Pfam Name: Thaumatin Pfam Description: Thaumatin family
MASVLHHLFPLVVVLLLAAAADAATFTVTNNCPYTVWAAAVPGGGQQLDNGQTWSIDVPAGTTGGRVWARTGCSFDGSGNGQCQTGDCGGVLQCAQYRQAPNTLAEFGLNKFDGLDFFDISLVDGFNVPMDFLPAGDCSGCPQGGPRCDADVTSQCPAALQAPGGCDNPCTVFKTDQYCCTGSAANNCRATDYSK

SEQ ID NO: 72247 - DNA, 656 bp, Zea mays
  misc_feature: Ceres CLONE 1555021
  misc_feature: Encodes the peptide sequence at SEQ ID NO. 72248
  misc_feature (388)..(388): n is a, c, t, g, unknown, or other
  misc_feature (389)..(389): n is a, c, t, g, unknown, or other
  misc_feature (396)..(396): n is a, c, t, g, unknown, or other
  misc_feature (401)..(401): n is a, c, t, g, unknown, or other
  misc_feature (415)..(415): n is a, c, t, g, unknown, or other
  misc_feature (488)..(488): n is a, c, t, g, unknown, or other
acgattgggtactgggccccccctcgagccctgcagtggtaaagggacgcccgaatccagaccctcgtctgttatggcggcggcggaggcggcgccaccgccgatactcgagctggacccgtcgcacgatcgagccgtcagcgttgtcgaggacatcgtgcgtctagagcggaggatctttccgaagcacgaatcgctggcgcggtccctgcacgacgagctaaagcggcggaactccgggctgatctacaagacgtccagcgccgacgagggggaggtcatcgggtatgccatgtacacctgcaacacatccctctgcgccaccatcaccaagctcgccgtgaaggagaactgcaggcggcagggccacggcgaggcgctgctggcnnggcgcantggancggtgccggccgcngaaggtccagccggctctccctccacggtcgacccccacaaaggaccggctgccctggggcgcttttaccccnaagggccggggttcccgggtcgaaacccccccgtgtgagggggtttttaccgccgccctccaaggggacccccctcccggggggttccctggggaactggaaaaaaaaaacccccccgggggaaggaaaaaaacccccccccctttgttttttccgggaaatttttta

SEQ ID NO: 72248 - protein, 150 aa, Zea mays
  misc_feature: Ceres CLONE 1555021
  misc_feature (106)..(106): Xaa is any aa, unknown, or other
  misc_feature (108)..(108): Xaa is any aa, unknown, or other
  misc_feature (110)..(110): Xaa is any aa, unknown, or other
  misc_feature (139)..(139): Xaa is any aa, unknown, or other
MAAAEAAPPPILELDPSHDRAVSVVEDIVRLERRIFPKHESLARSLHDELKRRNSGLIYKTSSADEGEVIGYAMYTCNTSLCATITKLAVKENCRRQGHGEALLAXRXGXVPAAEGPAGSPSTVDPHKGPAALGRFYPXGPGFPGRNPPV

SEQ ID NO: 72249 - DNA, 648 bp, Zea mays
  misc_feature: Ceres CLONE 1555029
cgattgggtaccgggccccccctcgagcactgcagtggtaaaggctgactctgccgcgccttagcttcgacaatctccttttgcttctgaattgtaacttggcatgttcttgtagtgtgacccttgccttcaccacagaataagcaatagagctttctgggctgatccccgcaccttcctccgaagcccctgccgcctctaccccttgggcctggtgtcctgaaagaactttgttgttgccctgaaaattgggagctgtgttgtggcctttaaggttggcttcctctgtcatcacttaagctggagttatggattgatctgacatgcctggggtggattcttcctctgaagcccctggtcatttcagaaaacctgtaggcttcttcccttctctggcggaaatcattatcagctcggatgtattcatccatcttctaaagaagcttctccagggtttgtgggggttttctggcaaaatactaagtcgtaggtcctggccaaagtcctttgatcatggcctcaatgacaatttcattgggcactgtgggcgcttgtgctctcagacacaagaaccttcagacatacccctgaaggcctgcagcccgggggatccactagttctagagcggccgccaccgcagtggagct

SEQ ID NO: 72250 - DNA, 654 bp, Zea mays
  misc_feature: Ceres CLONE 1555032
  misc_feature: Encodes the peptide sequence at SEQ ID NO. 72251
  misc_feature (603)..(603): n is a, c, t, g, unknown, or other
cgattgggtactcgagcgtctcggagccactgcagtggtaaaggtagagtgcatctccttcacgtcacttcctccccatcacgtttttcctctacccaggtcgagctcgccctactgtgcttgcctgtgctcgtcggccatatccctggtggccgacctcgcccctgccccagccacagcttccccttcggccctgctgctgcaagcactcagcctctcctatggcacacggtgctcgtccagcccctttctactggtgtttgcgtcatctccctggtgctcgacgaaatgaccatgaggagttttgtgttgtgtgcagccccacctgcgacaccgtcgacccccggtgaggttttgttctcgccctgtcgttttagcgctcgacgtcaattactattgtgtgtgttgatgagggagttaaccggtaaagaagcgaggtccgtgcgacgtttgccaagtgttcgatggaaggtccgaaccgggaacctcgcctttctcgcggatcttcgggtcggtttgtgaattggtatcttcggacttgaatcagaaagggagaagctcaaaagatacgaaggttgacacagtgccgaagctgtgaagcangaaagcttcggcatgttcgcagaaaggggaaccgacttaaagatgaaaaga

SEQ ID NO: 72251 - protein, 173 aa, Zea mays
  misc_feature: Ceres CLONE 1555032
RLGTRASRSHCSGKGRVHLLHVTSSPSRFSSTQVELALLCLPVLVGHIPGGRPRPCPSHSFPFGPAAASTQPLLWHTVLVQPLSTGVCVISLVLDEMTMRSFVLCAAPPATPSTPGEVLFSPCRFSARRQLLLCVLMRELTGKEARSVRRLPSVRWKVRTGNLAFLADLRVGL

SEQ ID NO: 72252 - DNA, 634 bp, Zea mays
  misc_feature: Ceres CLONE 1555033
  misc_feature: Encodes the peptide sequence at SEQ ID NO. 72253
acgattgggtaccgggccccccctcgagccactgcagtggtaaaggggtcgaacggaccaggccatcaggttatctagaaagctctcatgctcttccatttctaggctagcctaggtctggaccaagtatcaatcgattcataagaggaggaggccatcgaaacaagtagaaggcagtcacggcaatacaacgaaagctggtgaacaactttgtcaagcctcaagagctcatggaagatggcagtgctccaagacggtctactccacccacccgcagaagcagatctgctgagttccacaatttttcagaaaggaggagaagggataagatcaacgagaagctgaaagcattacaggagcttcttccaaactgcaacaagaccgacaaagtttcgatgctagacgaagcaatcgactacctaaaatcacttcagctacagcttcagatgctggtcatggggaaggggaatgtcaccaagtggtttcctcttgagctgcagcaatacatgcattacatcacgggctgaccctgcccagttgcctccgttggcgcccctccggccagcagccccgacaaatttccgaataacttcaaggcaaatcctcaggcgaacattttaaacgtcggagtcgg

SEQ ID NO: 72253 - protein, 98 aa, Zea mays
  misc_feature: Ceres CLONE 1555033
  misc_feature (19)..(68): Pfam Name: HLH Pfam Description: Helix-loop-helix DNA-binding domain
  misc_feature: The sequence is a functional homolog of SEQ ID NO 1139 in the 10/374,780 US patent application
  misc_feature: The sequence is a functional homolog of SEQ ID NO 1337 in the 10/412,699 US patent application
  misc_feature: The sequence is a functional homolog of SEQ ID NO 528 in the 10/666,642 US patent application
MEDGSAPRRSTPPTRRSRSAEFHNFSERRRRDKINEKLKALQELLPNCNKTDKVSMLDEAIDYLKSLQLQLQMLVMGKGNVTKWFPLELQQYMHYITG

SEQ ID NO: 72254 - DNA, 642 bp, Zea mays
  misc_feature: Ceres CLONE 1555036
  misc_feature: Encodes the peptide sequence at SEQ ID NO. 72255
  misc_feature (499)..(499): n is a, c, t, g, unknown, or other
cgattgggtaccgggccccccctcgagccactgcagtggtaaagggaggaaagcagaaggggaagagtcagcaatggaggcgagggttgcaggagtgcccgaagacgaagagtccggcctcctcccccgcccgtccgcagccggccgacggccgtcctctcgcggtgcccgcttcccgcctccaccggcagcctgggcgacggtggacggccccctcgggcttccgctggaggacgcggagggccacgcccgccgcttcttcatgtggggtttcgcgtgcctccccttcctctgggccatcaactgctgctacttctggcccgtcctccgctcgtcggtcgcctcctcgcccgccgccttcgcccccatccgcccctatgttgtgcggtcggcaattggcttcaccatcttctccgttgttctggtcacctgagccacgaccttcgtcgtcgagagcgagcggttatctgagtcagtgtggaatgatcttgtgatgtancatgtcgccgactagcttggcatctctggatgcatgggatgagcctgcgatgtctccctcgcttcagctgggctcgcttcacccaagcgtgaaacgatctattccatccatctccctagggataccactgtctcatgtactgg

SEQ ID NO: 72255 - protein, 119 aa, Zea mays
  misc_feature: Ceres CLONE 1555036
MEARVAGVPEDEESGLLPRPSAAGRRPSSRGARFPPPPAAWATVDGPLGLPLEDAEGHARRFFMWGFACLPFLWAINCCYFWPVLRSSVASSPAAFAPIRPYVVRSAIGFTIFSVVLVT

SEQ ID NO: 72256 - DNA, 628 bp, Zea mays
  misc_feature: Ceres CLONE 1555039
  misc_feature: Encodes the peptide sequence at SEQ ID NO. 72257
cgattgggtccgggccccccctcgagccctgcagtggtaaagggaggccccagaaagagtccgtaaacaactcccctcccgtccatggcgaccgcagaccgggtcgccgccaccttcctctcctctttcccccctcaccatcccggccccttttcctccgtttccctcgtgacaaaccctgtcctatccgtctcccttcgggccgctgttacaggtggcccacggctcgcctcccgtctccgggtccgccgcgtcggcgccgccgtcgcccagctccccaccacgaatccggaggtagcttctggggagaagaagatcagggctgtgcggtcttttgcgatggcagagctggaggcccggaagatgaggtaccctaccacaggcaccgaggggctcctcatgggcattcttgttgaaggaactagtggcgcagcaaaacttttgcgtgctaatggaaccacacttctcaaagtgcgtgaggaggcagcgaatgttcttgggaaatcagaaatgttttactttagtcccatgcatccaccattgacagaagctgcacaacgagcccttgattgggctgtcaatgaaaaattgaaatcaggtgagggatggagaagtaaccgccaatcat

SEQ ID NO: 72257 - protein, 181 aa, Zea mays
  misc_feature: Ceres CLONE 1555039
  misc_feature (87)..(139): Pfam Name: Clp_N Pfam Description: Clp amino terminal domain
MATADRVAATFLSSFPPHHPGPFSSVSLVTNPVLSVSLRAAVTGGPRLASRLRVRRVGAAVAQLPTTNPEVASGEKKIRAVRSFAMAELEARKMRYPTTGTEGLLMGILVEGTSGAAKLLRANGTTLLKVREEAANVLGKSEMFYFSPMHPPLTEAAQRALDWAVNEKLKSGEGWRSNRQS

SEQ ID NO: 72258 - DNA, 784 bp, Zea mays
  misc_feature: Ceres CLONE 1555041
  misc_feature: Encodes the peptide sequence at SEQ ID NO. 72259
acgattagttacgtcgacgccctcgagcactgcagtggtaaaggcgaggccacggcggtggcggcggcgccggggtcgccggcgccggaggcgagggtggtgctggcggacggcgcgctgcggcggttccctggcggcacgcgggcgtcgcaggccgtgaaggcggcgacgtcggcgtcgtccgcgtggttcctgtgcagcgcggacgggctggagctcggcggcgccgcggcggcggccgtggggcccgaggaggcgctgcagcccgggcagctgtacttcgtgctccccgcggcgatgcggcgccgcccgctgcgggcggaggagatggccgcgctcgccgtccgcgccagcgccgcgcctgggccggcgagctacccactcgtgttccccggaggaccaccgcacggcaaaggaggcgtagccgcaaggctcagagagggggacggcgcgccgggaactttcagtgccgcgaacctccgggcggccattggactgaaactaaccattagcatccgggtgctgggggacaaacttagcggcaagggcgataacgcacccgagaaaagccggggcgaggacagtacccagcgtccggacggcgtggggagaccgacgcgcagcttggaggaagcgaaaaccaagtaaagaaagcatgaaaggacacggcccacattcgtgattgggtcttacccacgggtcaaacagactggcagtgccataaccggagaagaaacaattggagaaggttgaatggtcacaataatacctctttatattattg

SEQ ID NO: 72259 - protein, 215 aa, Zea mays
  misc_feature: Ceres CLONE 1555041
TISYVDALEHCSGKGEATAVAAAPGSPAPEARVVLADGALRRFPGGTRASQAVKAATSASSAWFLCSADGLELGGAAAAAVGPEEALQPGQLYFVLPAAMRRRPLRAEEMAALAVRASAAPGPASYPLVFPGGPPHGKGGVAARLREGDGAPGTFSAANLRAAIGLKLTISIRVLGDKLSGKGDNAPEKSRGEDSTQRPDGVGRPTRSLEEAKTK

SEQ ID NO: 72260 - DNA, 664 bp, Zea mays
  misc_feature: Ceres CLONE 1555046
  misc_feature: Encodes the peptide sequence at SEQ ID NO. 72261
cgattgggtacgggccccccctcgagccactgcagtggtaaaggcgggccccgaccacagctcccaaggccgcgcccaggatggccccgctgccgcctccccctgcgcggtccccggccacagccccggcgccggccgccaagccgccggccgccaagccgccgaccgccgcggcgccgtcaccgctggcctctcctccggccccgcccaccgagggccccgccgcctctgcgccgtccgcgaaggctccgacctcgtccgtctccaccaccccggccggcgcccccaccgtcgcgccctccggcagcgccgccgcctcgcgcgcctccgccctcggcttcgtcgccgtcgccggcgcggtcgcagccgccgtcatgttctagacgcctccccggggcgtcgtggtgggcggtgctgtttatactatcgtgttttacttttgtgtgtgtgtgtgtgtgtgtgtgtgggtcgtgggtgattctttcttagatactgagagagcagaggttatgtgagagattctagtgggtgtagtagcgatgggctgttacatatgaatatcatgattcatgatccagatgattattaatggaattctttcatttgtttctagtaaaaaaaaaaaaaaaaaccagagctctgggaattcctgcagcccgggggg

SEQ ID NO: 72261 - protein, 100 aa, Zea mays
  misc_feature: Ceres CLONE 1555046
MAPLPPPPARSPATAPAPAAKPPAAKPPTAAAPSPLASPPAPPTEGPAASAPSAKAPTSSVSTTPAGAPTVAPSGSAAASRASALGFVAVAGAVAAAVMF

SEQ ID NO: 72262 - DNA, 674 bp, Zea mays
  misc_feature: Ceres CLONE 1555049
cgattgggtacgggcccccctcgagccctgcagtggttatggtaggacggtgaagccgatgatggcccaatgctgacgtccctggacttcgtacagtggaggatctgatccgaagcgagaggacttaattctgctctcgggactgacccaggaccacgacgagccgtctccgtcggtgcttgacaaccgtcgattctcctgtccaggagcgtcgttaacatcgtctacgacatcttcgggctgttgatcttctacgacctacctcttgtccacctcatcgtggaccacaacgcgtacatggtggactagcacatgttcgtcgcgctcataggtcgactctgcccatgtgctacgcgctggctcacgtgcgtgccataagtgggacgcaaattgggggagttaagcgcaccgatcagctacgagaagccccaccagtgcaggatttaccatgacctacactgctacctcggaactttcttgcctcgcctatattatttctgatgacatctcatgctgatcacatccgcggagaagaatctggcaatatatccctgctgctggcttaaaatcatgctgctgttccctataatcatgcagatcgtactgcctactgtgctcgcacttgtggctattcagacgattctgtttgtcacagtccttcaaatcagcttgaa

SEQ ID NO: 72263 - DNA, 646 bp, Zea mays
  misc_feature: Ceres CLONE 1555068
  misc_feature: Encodes the peptide sequence at SEQ ID NO. 72264
cgattgggtaccgggccccccctcgagccctgcagtggtaaaggtcttctctccgcctcgcgcacccggttccgcgtgcctttccccacctactctcgcggctctcgccagccagtctagggtttcggtcccggcgtgcttatccgcccccgccggccatgtcgaagcaaggagggaaggccaagccgctgaaggcgcccaaggccgacaagaaggagtacgacgagacggatcttgcatatctgcagaagaagaaagatgaggaaaaagcactgaaggagcttaaggccaaggcacagaagggcgcgattgggggctcgggtctgaagaaaagtggaaagaaatgagactggtcacccgtctccaatacctagaggatgataaggcagctgtctatctgtgttgcgcttcactaagtgtgattgtaacagtggtacctcttgtgttctgtgttccgcgatgttgcagttggttgcttgatcgaaagatgtttcaacctcccatctgctagctatgatacagatggtcccctgataataatgatgacatattctgtgatggaaaaaaaaaaaaaaaaaaccagagctctgggaattcctgcagcccgggggatccactagttctagagcggccgccaccgcggtgg

SEQ ID NO: 72264 - protein, 62 aa, Zea mays; identical to SEQ ID NO: 5990
  misc_feature: Ceres CLONE 1555068
  misc_feature (1)..(62): Pfam Name: TMA7 Pfam Description: Translation machinery associated TMA7

SEQ ID NO: 72265 - DNA, 634 bp, Zea mays
  misc_feature: Ceres CLONE 1555076
  misc_feature: Encodes the peptide sequence at SEQ ID NO. 72266
cgattgggtaccgggccccccctcgagccactgcagtggtaaagggtgttgttccagctgcaggatctggtggccttgatgccttgcgacagcttccacagtttcaagcactgcttcagttggtccaggctaatcctcaaatcttgcagccaatgcttcgagaactaggcaaacaaaacccagaaatcctgcgtttgattcaggaaaatcaagctgagtttgtccgcttggtgaacaaaactccggagggtggtcctggaggaaacatattaggacaactggcagctgctatgccgcaatcggtgacagttaccccagaggaacgagaggccatccagcggcttgagggaatgggcttcaaccatgagcttgtgctagaagttttctttgcatgcaacaaggacgaagagcttgcagccaactacctccttgatcatggccacgagtttgacgagcagcagcaatagtggggatatggtggtggatggaatgctatgaaacctacgcgctagccgaacaacatactgtcgatcggatgacctccgtctgatgagagatacttggctgtttatgctatgcagcggaccagcttatgcattcgtgtcgtacgagatgctcacacatgacagactaa

SEQ ID NO: 72266 - protein, 154 aa, Zea mays
  misc_feature: Ceres CLONE 1555076
  misc_feature (25)..(83): Pfam Name: XPC-binding Pfam Description: XPC-binding domain
  misc_feature (106)..(142): Pfam Name: UBA Pfam Description: UBA/TS-N domain
IGYRAPPRATAVVKGVVPAAGSGGLDALRQLPQFQALLQLVQANPQILQPMLRELGKQNPEILRLIQENQAEFVRLVNKTPEGGPGGNILGQLAAAMPQSVTVTPEEREAIQRLEGMGFNHELVLEVFFACNKDEELAANYLLDHGHEFDEQQQ

SEQ ID NO: 72267 - DNA, 593 bp, Zea mays
  misc_feature: Ceres CLONE 1555080
  misc_feature: Encodes the peptide sequence at SEQ ID NO. 72268
  misc_feature (270)..(270): n is a, c, t, g, unknown, or other
cgattgggtaccgggcccccctcgagccctgcagtggtaaaggagcctgtgtccgtggctctcgcctgccacagtgccacccaagcagccatggcggccgcgctgctccgccgtgcgctccacctccgccgcgtgctcccctcgcccctcgcctccgcacagcgcctctcccccgccttctcggccactccgaccccgaagacctcccagcagaacgccgccatcaccacgatcgacctctcctccgacgagagtcgccgccgcctcctncacaggttggtgtaccggagcaagcagcggggtttcctggagctcgacctggtgctgggcacctgggtcgaacatcacgtgcacgccatggacgagccccacatccgcgccctttctacagtgctcgacctcgaaaaccccagattgtgggaaatggttgactagtcaggagcaggccaccggaggatctgaattcctattccggggttttctggcttcaaaccaaagggcccggataaacctggataaaggtggtttttccccgaaacccgattaaacacctgggccaactttgggttaaaggagggggattaccttaaaga

SEQ ID NO: 72268 - protein, 114 aa, Zea mays
  misc_feature: Ceres CLONE 1555080
  misc_feature (55)..(115): Pfam Name: DUF339 Pfam Description: Protein of unknown function (DUF339)
MAAALLRRALHLRRVLPSPLASAQRLSPAFSATPTPKTSQQNAAITTIDLSSDESRRRLLHRLVYRSKQRGFLELDLVLGTWVEHHVHAMDEPHIRALSTVLDLENPRLWEMVD

SEQ ID NO: 72269 - DNA, 655 bp, Zea mays
  misc_feature: Ceres CLONE 1555083
  misc_feature: Encodes the peptide sequence at SEQ ID NO. 72270
cgattgggtacggggcccccctcgagccctgcagtggtaaaggaaggtaagatgttcctgcggaggatcctgaccggcgggggcggcctggcggccctgagggcggcgcgcgccgtgaaggagacgacggggatcgtgggccttgaggtggtgcctaacgcgcgagaggttctggtagggctctacgagcgcacgctcaaagagatcaaggccgtccccgaagacgagggttaccgcaaggccgttgaatccttcaccggtcaccgcctccagatctgccagaaggaggaggactggaagcgcatcgaggaccgatcggatgcgggcaggtcgaggagctcatcgagggagccgaagacgagctcaagctcatcgctaaaatgattgaatgggatccatggggtggtcccgatgactacgaatgttaggtgattggagacgaaccccccaatccctaacatgttcctcaccacccgcctgtgtgctcctcctgaagaattcctcaagggccttaaatgctgccaaaaccgggaccctggccctcaaggggaatgccccccccccaaagggaagggctaaaggaagggctttttcctggggaaacaccattttccaattttttccccgggggggtaagggaacgggtttccttggg

SEQ ID NO: 72270 - protein, 110 aa, Zea mays
  misc_feature: Ceres CLONE 1555083
  misc_feature (35)..(91): Pfam Name: ETC_C1_NDUFA5 Pfam Description: ETC complex I subunit conserved region
MFLRRILTGGGGLAALRAARAVKETTGIVGLEVVPNAREVLVGLYERTLKEIKAVPEDEGYRKAVESFTGHRLQICQKEEDWKRIEDRSDAGRSRSSSREPKTSSSSSLK

SEQ ID NO: 72271 - DNA, 626 bp, Zea mays
  misc_feature: Ceres CLONE 1555093
  misc_feature: Encodes the peptide sequence at SEQ ID NO. 72272
  misc_feature (354)..(354): n is a, c, t, g, unknown, or other
cgattgggtccgggcccccctcgagccctgcagtagtaaagggtggatcgggtggtgggagcggtgggggtgggagtggaggcggaggatctggtggaggcggcagcagcggtggaggcggcggatctggtggtggtggaagcggtggcggcggcggatctggcggcgggccgacgagcggtcgttgccccgtggacgcgctgaagctgggcgtgtgcgccaacttgctggacgggctgatcaacgcgaccctggggacgccgcccaggacgccgtgctgcacgctgatccaggggctggcggacctggaggcggcggtgtgcctctgcaccgtcctcagggccaacgtcctgngcatcaacctcaacctgcccatcaacctcagcctcctcgtcaactactgcggcaggcgcgtcccctcgggcttccagtgcttctgatcacgcccatcgatccatctgcaggctaaataattttgtccagctagtatatatacgtacgtacgttgatatatatgatgtagtattatatatatgtccatgcatgcaatgcatctcgtcgtccatcgcatgttgttgcccgtggtggggggggttttccaagatcccgcctccgttataaatatc

SEQ ID NO: 72272 - protein, 145 aa, Zea mays
  misc_feature: Ceres CLONE 1555093
  misc_feature (62)..(144): Pfam Name: Tryp_alpha_amyl Pfam Description: Protease inhibitor/seed storage/LTP family
  misc_feature (118)..(118): Xaa is any aa, unknown, or other
IGSGPPSSPAVVKGGSGGGSGGGGSGGGGSGGGGSSGGGGGSGGGGSGGGGGSGGGPTSGRCPVDALKLGVCANLLDGLINATLGTPPRTPCCTLIQGLADLEAAVCLCTVLRANVLXINLNLPINLSLLVNYCGRRVPSGFQCF

SEQ ID NO: 72273 - DNA, 676 bp, Zea mays
  misc_feature: Ceres CLONE 1555110
  misc_feature: Encodes the peptide sequence at SEQ ID NO. 72274
cgattgggtaccgggccccccctcgagccctgcagtggtaaaggtcggtagccgtcggttcacttctccaggaaagggttcgtactcatggcgccgccgcagccaaagtcgggccttttcgttggcatcaacaagggtcatgtcgtcaccaagcgcgagctgcctccccgcccgtgccaccgcaaggggaaatcaacgaagagggtgtctatggtcaggggcctgatcagagaggttgctgggtttgctccttatgagaagcgtatcactgagcttctgaaggttggcaaggacaagcgtgccctgaagcttgctaagagaaagcttggaactcacaagagggcaaagaagaacagagaggagatggcgggcgtcctcaggaagatgaggtcggctggtacgcacactgaccaatagaaatagagagcatttcaagttcatggagctgggctggccacagatttatggtgccagggggcctgaatttttcccatacttgtaaaaaccctaatagaaccttgtcaaaagtttttttgggatgggaaccccaccctcatgggggaattttggcctccctttcccaaatgcatttccaggggggttttattggttttccccaaaaccaaaatttttttggggggaaatccttggcccccccttatttttcttaaaaaaa

SEQ ID NO: 72274 - protein, 109 aa, Zea mays
  misc_feature: Ceres CLONE 1555110
  misc_feature (5)..(103): Pfam Name: Ribosomal_L36e Pfam Description: Ribosomal protein L36e
MAPPQPKSGLFVGINKGHVVTKRELPPRPCHRKGKSTKRVSMVRGLIREVAGFAPYEKRITELLKVGKDKRALKLAKRKLGTHKRAKKNREEMAGVLRKMRSAGTHTDQ

SEQ ID NO: 72275 - DNA, 654 bp, Zea mays
  misc_feature: Ceres CLONE 1555112
  misc_feature: Encodes the peptide sequence at SEQ ID NO. 72276
caattgggtacgggccccctcgagcactgcagtggtaaaagaccgctacttgtgctcccccacgctactaccgccgctagctggttcaagtgcggcgagcggagccggagaccggtagaggaaattaagaggcgtcgatcgggcatggggtgcgacgacaagtgcgggtgcgccgtgccgtgccccggcggcaaagactgcaggtgcacgtcggggagcggcgggcagcgggagcacacgacttgcggctgcggggagcactgcgagtgcagcccgtgcacgtgtggccgggccacgatgccgtccggccgcgagaacaggagggctaactgctcctgcggggcgtcctgcaactgcgcatcctgcgcctcggcctgatccatgcgcctcgccctcgtgctaccgcgctgcctagtggagggagttgtctagtgaggctctggagacgaagcaactagcactacttctaataaaggggcttgtgtcatgctcgccagaggcatcacgcgctgcatctgcatcgtgggtatccgcgtcattaagttttggtgtattgaaataaaacacctcccacttttatggtcttaaaaaaaaaaaaaaaaaaccctgaacctcttgggaaattccctgccacccccggggggaatcccccct

SEQ ID NO: 72276 - protein, 77 aa, Zea mays
  misc_feature: Ceres CLONE 1555112
  misc_feature (2)..(76): Pfam Name: Metallothio_PEC Pfam Description: Plant PEC family metallothionein
MGCDDKCGCAVPCPGGKDCRCTSGSGGQREHTTCGCGEHCECSPCTCGRATMPSGRENRRANCSCGASCNCASCASA

SEQ ID NO: 72277 - DNA, 654 bp, Zea mays
  misc_feature: Ceres CLONE 1555117
cgattgggtccgggcccccctcgagccactgcagtgagtgaggagtgggcctcagctcggttcagcaggcggctcgctctaaccagatgagctgagcagaggaatccatgctggcgaagcggaaatatacgctggactggtgaccgacgagggctccgtggggcggctgtgcccgattcggcgaccggcgatgcacattctgcctgaccgtggctacctgcgtggtggaccacgaggtcgccaccggccgccgttgacttcctccagccagggcggtgagtgcttccaccgcgaggacctcctcctcagcacgtcccctaagagcagacccatccgacacagatctcttgtgcttcttccccacacgcatgacaaggtcaggatgaagctcatgcaagcatagaacactcgaatatcgatgacacctgaataacgtctcctgaactgtgctgggtctgcatgagaacataactccgcttgtagcgaatcctttctgttagagctggagcccacgatccttttggagatttgcacagaggccgacatgcttattaacctccagggacctgatcttgttcctgatcatccggtgctcgctgaccatgataacaagacttctctggagccgtgcaccttggaggatacgtcggtact

SEQ ID NO: 72278 - DNA, 740 bp, Zea mays
  misc_feature: Ceres CLONE 1555127
  misc_feature: Encodes the peptide sequence at SEQ ID NO. 72279
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (26)..(26): n is a, c, t, g, unknown, or other
  misc_feature (27)..(27): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (515)..(515): n is a, c, t, g, unknown, or other
  misc_feature (516)..(516): n is a, c, t, g, unknown, or other
nnnnnnnnnnnnnnnnnngggggggnngnnnngnnnnnnnggnnngnnnnnnnnnnnnnnnnnnnnnnnnnnnnnnnnnnnnnntttttgcgattgggtacgggccccccctcgagccctgcagtggtaaaagcggcaggccgagagttgtcaaggacgacgtctgccggcagtgctcctgctcctcctcctccttcctggccgccgcgcgagcttgggttagttagtgtctcttcttcgcggagacctgtgagaggagccatcatcatggccgctgttgagactgttgtcctcaaggttgctatgtcatgcgagggctgcgccggggcggtcagaagagtgctctccaagatggaaggagttgaaaccttcgacatagacctcaaggagcagaaggtgacagtcaaaggcaatgtcaagcctagaggacgtcttccagacgagtttccaatgtcggaggaagaaggaacctcgtactgggaaagggcgatagcctacggccccgagatcgctgnncggcggcttcctagatagccgtaaagcagcttcccatgcacccgcgtgcagaaagcgccctccctggcctgcctgctcccgggcggccgcccaggtaaattcaccccccagccccaataagctggaacgcccctggattccgtccaccgcctaatttaatttccaacctccaacaatggttggatggccttgccggggcccttgcccaaaccttcccctaaaaa

SEQ ID NO: 72279 - protein, 88 aa, Zea mays
  misc_feature: Ceres CLONE 1555127
  misc_feature (7)..(81): Pfam Name: HMA Pfam Description: Heavy-metal-associated domain
  misc_feature (83)..(83): Xaa is any aa, unknown, or other
MAAVETVVLKVAMSCEGCAGAVRRVLSKMEGVETFDIDLKEQKVTVKGNVKPRGRLPDEFPMSEEEGTSYWERAIAYGPEIAXRRLPR

SEQ ID NO: 72280 - DNA, 639 bp, Zea mays
  misc_feature: Ceres CLONE 1555128
  misc_feature: Encodes the peptide sequence at SEQ ID NO. 72281
ccaattgggtccgggccccccctcgagccctgcagtggtaaaggagcctccgcccatacacacactgccccatcccgccgccgcaggcgagaaccagcgccaccttaggttagggcggccgccgccggagaagtgcgcggttgccaagatgcagatcttcgtgaagaccctgacggggaagaccatcacgctggaggtggactcctcggacaccatccacaacgtgaaggccaagatccaggacaaggagggcatcccgccggaccagcagcgcctcatcttcgccggcaagcagctcgaggatggccgcaccctcgccgactacaacatccagaaggagtcgacgctgcacctggtgctccgcctcaggggaggcgccaagaagcgcaagaagaacacgtacaccaagcccaagaagatcaagcacaagcacaagaaggtgaagctcgccgtgctccagttctacaaggttgacgacgccaccggcaaggtcacccgcctccgcaaggagtgccccaactccgagtgcggcgcgggggtcttcatggccaaccacttcgaccgccactacgtgcggtaagtgtggcctcacctacgttcaccacagctagagccttctctcgagatgagtgaggactt

SEQ ID NO: 72281 - protein, 143 aa, Zea mays
  misc_feature: Ceres CLONE 1555128
  misc_feature (6)..(74): Pfam Name: ubiquitin Pfam Description: Ubiquitin family
  misc_feature (101)..(142): Pfam Name: Ribosomal_S27 Pfam Description: Ribosomal protein S27a
MQIFVKTLTGKTITLEVDSSDTIHNVKAKIQDKEGIPPDQQRLIFAGKQLEDGRTLADYNIQKESTLHLVLRLRGGAKKRKKNTYTKPKKIKHKHKKVKLAVLQFYKVDDATGKVTRLRKECPNSECGAGVFMANHFDRHYVR

SEQ ID NO: 72282 - DNA, 631 bp, Zea mays
  misc_feature: Ceres CLONE 1555135
  misc_feature: Translation starting site: 115
  misc_feature: SWISSPROT Homolog: EC 4.4.1.5 Lactoylglutathione lyase
  misc_feature (22)..(22): n is a, c, t, g, unknown, or other
  misc_feature (477)..(477): n is a, c, t, g, unknown, or other
cgattgggtaccgggccccccnctcgagccactgcagtggtaaaggattgtcacgactcacgacgacggaaacagtagtgctgccagtagagctctcagaactcgggaaaaaaaatgtcagaggccgccgtgcgtgtgatcggcctatggccgagcccgttcgtgatccgcgtcctgatcgccctgaagctgaagggcgtcgagttcgagttcgtggaggaggtggtgggcaggaagagcgagctgctgctgaggtcgaacccggtgcacaagaagatccccgtcctgctcccacacggcaagcccatctccgagtctctgatcatcgtccagtacatcgacgaagtctgggtcctccagcgcgcggcctttcctctccgccgacgctcaacgcccgcgccgtccagcgggtctgggcgcagtacgtcgacgacaagctgcctggggcaatccgcttcctgaagggaaccgaccacnacgggggccaagaaccaggcggcggggcaaatttttccccgggcccttgaaatttcctgaggaagggttttccccccacctacccccgggggaaagccttcctttggcgggggaaaacccccggggaccctgaaaaacccccttggggtgcccc

SEQ ID NO: 72283 - DNA, 607 bp, Zea mays
  misc_feature: Ceres CLONE 1555145
  misc_feature: Encodes the peptide sequence at SEQ ID NO. 72284
  misc_feature (24)..(24): n is a, c, t, g, unknown, or other
  misc_feature (607)..(607): n is a, c, t, g, unknown, or other
cgattgggtaccgggccccccctncgagccactgcagtgggtaaaggagcgcagcgcgctcctcgatccccaacaggcaacagcccagccgctgtcgccctcgttccgtagtacggcgccgccagatcgtcagtcaccatgatcatctccaagaagaaccgccgcgagatctgcaaatacctcttccatgagggggtcttgtacgccaagaaggactacaacctggccaagcaccccaagcttgatgtgcccaacttggaggtgattaagctcatgcagagcttcaagtcgaaggagtatgtgagggaaaccttctcatggcagtactactactggtacctcaccaacgatggcattgagcacctccgcagcttcctcaacctgccatcagaggttgtgcctaatacccttcaaaaagtttcccagcccccgtctcgccccctcgggtctggcccaacctggggaccgcccagggggccctctccgttataaagggaacaggccctagttttggggaatagggatggttacaaaggaaggtcccccgtgggcccccccgggggactttggggggggaaaaggggggggggcccctccgaaatttccn

SEQ ID NO: 72284 - protein, 117 aa, Zea mays
  misc_feature: Ceres CLONE 1555145
  misc_feature (3)..(98): Pfam Name: S10_plectin Pfam Description: Plectin/S10 domain
MIISKKNRREICKYLFHEGVLYAKKDYNLAKHPKLDVPNLEVIKLMQSFKSKEYVRETFSWQYYYWYLTNDGIEHLRSFLNLPSEVVPNTLQKVSQPPSRPLGSGPTWGPPRGPSPL

SEQ ID NO: 72285 - DNA, 665 bp, Zea mays
  misc_feature: Ceres CLONE 1555146
  misc_feature: Translation starting site: 465
  misc_feature: SWISSPROT Homolog: EC 5.3.1.1 Triose-phosphate isomerase
ccgattgggtacgtggccccccctcgagcactgcagtggtaaaggaatcatcgaactggttctagaatcgcccctctccctctctctctctctcttcgacgatcggaaattgcggaccccaatctaatcgacaccttgccgatatgggccgcaagttcttcctccgtgacgactggaaatgcgttgcaaccaattatcacgtcgagaacattgtcaaaaccctgaatgaaagacaggttcccccttcatatgttgtcggaggacgttgtcagccctccttatgtcttccttcctgtggtcaacagccagctgcgccatagagttccatgttgctgctcacaactgctgggtcaagaagggaggtgctttcaccagtgaagtctgcgctgacatgatcgacaaccttggtgttccctgagtcattcttggacactctgaaaggagatctctgctgggagaatcaaatgaatttgttggacacaaggatgcctatgcccctgtctcatggactaaacgtcattgcatgtgttggtgagacacttgagcatacggaggctgggtctaccatggaggttgttgctgcactaacaaaatctattgctgacaagataacagactggagcgacctagttgttgcctatgaaccagtttgggctattgagaac

SEQ ID NO: 72286 - DNA, 615 bp, Zea mays
  misc_feature: Ceres CLONE 1555156
  misc_feature: Encodes the peptide sequence at SEQ ID NO. 72287
  misc_feature (492)..(492): n is a, c, t, g, unknown, or other
acgattgggtacgtggccccccctcgagccctgcagtggtaaagggagcgtcaagcaaacatccgtcgaccccaattccgaccactgctctcgcgccgtcgcgcgacagcattgtgcgcccgagccgggcttgtctgatggcgtctggaggcgccgcccgcggtcgccttgctgaggagcgcaaggcgtggcgcaagagccatcccctcgtgggcgccgtcatcctctccgcgtcttctttacttctaggctttgtggccaagccggcgatgctgccggatggttctgtcaacctcatgctctggaactgcgtcgtccccggcaaggaaggcactgattgggaaggtggatatttcccagtcactcttcatttcactgaaaattacccaagtatcccaccaacctgcaagttcccacgaaggtttttccatgtcaacgtctatgattctggggatgtatgcctgtcaatacttggtgatgcatgggcgcccntctatcacagtggcggcaaatttcttatagggcatcccaggaagctgcctgggagaaccccaaaatccagccctctccccgcaaaagggatttttggcttttacgatggtttttttgccagag

SEQ ID NO: 72287 - protein, 159 aa, Zea mays
  misc_feature: Ceres CLONE 1555156
  misc_feature (10)..(154): Pfam Name: UQ_con Pfam Description: Ubiquitin-conjugating enzyme
  misc_feature: SWISSPROT Homolog: EC 6.3.2.19 Ubiquitin--protein ligase
  misc_feature (119)..(119): Xaa is any aa, unknown, or other
MASGGAARGRLAEERKAWRKSHPLVGAVILSASSLLLGFVAKPAMLPDGSVNLMLWNCVVPGKEGTDWEGGYFPVTLHFTENYPSIPPTCKFPRRFFHVNVYDSGDVCLSILGDAWAPXYHSGGKFLIGHPRKLPGRTPKSSPLPAKGIFGFYDGFFAR

SEQ ID NO: 72288 - DNA, 646 bp, Zea mays
  misc_feature: Ceres CLONE 1555157
  misc_feature: Encodes the peptide sequence at SEQ ID NO. 72289
ccgattgggtacggggccccccctcgagcactgcagtggtaaagggacgtggcccgtttcgtaaagccaaggactcaaatctcttcaaccagaaccagcgaagcgtgcgtggacgcgtcctattcttcttccctccccgacctttccccaacttctcctccctccttcaaatccgatctccccgcaaggccgcaatcatgcgcaactccaccgccgcccagccctctactccctcctccgcccccgccatgtccggctcaggccccgcttacgtggcgcccgcctcttccacccccgtcggcggcggatacacctacccggcgccggcctcctccgggggcagcgccggctacgccaggatcccgacctaccccgcgcccccgtcggcgtaccccgccaccacccctcccacgccgcaggtctccaccaacgccccggtccaggaccccacggcgccgccgtccccgctggccaaggcgggcgagctcgtcgcgcggctccgcgagcagggccaggcgctgatggcggcgcgccggccctgggccgaggtcttccgcgcggcggccttctccaggccaccgtcgctcgggggaggcgctcgcccggacgcgccgcaacgccggctactttcgcgccaactacgcgc

SEQ ID NO: 72289 - protein, 149 aa, Zea mays
  misc_feature: Ceres CLONE 1555157
MRNSTAAQPSTPSSAPAMSGSGPAYVAPASSTPVGGGYTYPAPASSGGSAGYARIPTYPAPPSAYPATTPPTPQVSTNAPVQDPTAPPSPLAKAGELVARLREQGQALMAARRPWAEVFRAAAFSRPPSLGGGARPDAPQRRLLSRQLR

SEQ ID NO: 72290 - DNA, 653 bp, Zea mays
  misc_feature: Ceres CLONE 1555164
  misc_feature: Encodes the peptide sequence at SEQ ID NO. 72291
cgattgggtaccgggccccccctcgagccctgcagtggtaaaggtgtctctctcacacacacagctcaccgcagctcaaaagccagcacaggcaaacccccgtcatggcctcctccaagatgctgcgcgccgccgtcgtcgtcgcggccgtcgccgtgtcctccttcgccggcgccgccctcgccgccgaggcccccgcgccgagcccggcctccggcgccgcggccctcccctcgtcgctcttggccgccgccctctgcccggccgtcgcgctcctcctcggcaacctgcgccactgatgacgcctgcctgtctcctagaccgacgagagccgccgtgtgctgtcgcgtgatgttattgtcctctgtatgtgtgtgtgtgtgttcctgacctgtgcgtgccttgtaccgccaccccgcgcgtggattggaactctatcgatcgttcggagattcagtgcgtttgtttctgtagcagcattggttcagacttcagagtgaacgtcgcccagattttctgaaaaaaaaaaaaaaaaaaccagagctctgggaattcctgcagcccgggggatccactagttctagagcggccgccaccgcggtggagctccagcttttgttccctttagtgagggttaatttcgagcttggcgt

SEQ ID NO: 72291 - protein, 64 aa, Zea mays
  misc_feature: Ceres CLONE 1555164
MASSKMLRAAVVVAAVAVSSFAGAALAAEAPAPSPASGAAALPSSLLAAALCPAVALLLGNLRH

SEQ ID NO: 72292 - DNA, 585 bp, Zea mays
  misc_feature: Ceres CLONE 1555167
  misc_feature: Encodes the peptide sequence at SEQ ID NO. 72293
ccgattgggtacgggccccccctcgagcactgcagtggtaaaggaggggccatcagatccaagaagagggaagagcaccaaggaccttcggcgcccgttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcagcagcagggtcaaaggactacgttcacgtgcgcatccagcagcgtaatggtcgcaagagcctgaccaccgtccagggattgaagaaggagttcagctacagcaagatcctcaaagatctcaagaaagagttctgctgcaattggtacagtgggtcaggaacccaaaactggaaaagtcattcagctccccgggtaaccaaaagaaaaaaccgccccaaaattcccccccgccccgggccgggattttgtgaaaaaaaaggaccccccccccgaaattttcccggggggttttctaaaaaaaaaacccc

SEQ ID NO: 72293 - protein, 127 aa, Zea mays
  misc_feature: Ceres CLONE 1555167
  misc_feature (27)..(98): Pfam Name: SUI1 Pfam Description: Translation initiation factor SUI1
MSDLDIQIPTAFDPFAEANAGDSGAAAGSKDYVHVRIQQRNGRKSLTTVQGLKKEFSYSKILKDLKKEFCCNWYSGSGTQNWKSHSAPRVTKRKNRPKIPPRPGPGFCEKKGPPPRNFPGGFSKKKT

SEQ ID NO: 72294 - DNA, 818 bp, Zea mays
  misc_feature: Ceres CLONE 1555171
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (661)..(661): n is a, c, t, g, unknown, or other
  misc_feature (695)..(695): n is a, c, t, g, unknown, or other
  misc_feature (697)..(697): n is a, c, t, g, unknown, or other
  misc_feature (703)..(703): n is a, c, t, g, unknown, or other
  misc_feature (710)..(710): n is a, c, t, g, unknown, or other
  misc_feature (771)..(771): n is a, c, t, g, unknown, or other
  misc_feature (791)..(791): n is a, c, t, g, unknown, or other
  misc_feature (792)..(792): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttnnnttgcggatgggtaccgggccccccctcgagccactgcagtggtaaaggtgctttcttagagtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacagaacgaacactccccttcacaacgcccttcagcacctacgggggaaggtccttcaaattccaagaattatcccctccaaccgggaaaaaacccaaaaggttccccccggggttttggggtttttttttaaccctttttccccccgagaaggaaagggcaatttccggaaaaaccccccctctaagggggcttttaaaaaacggcaaaaaaaaaaactttgggaaaaaggccccccaaaaaatttttcccccccttttaaaaaaaagagggggcccccattttttccccccccnggggggggcccccttttgaaaaaaaaaaagcggngngggggnggcgggngggggataaaaaaggcggggggtgggggccccccccccttaaaaaaaaaaaaaaggcgcgnttttgtttttttataaaaanntttttttttttcggggggggggcccc

SEQ ID NO: 72295 - DNA, 880 bp, Zea mays
  misc_feature: Ceres CLONE 1555176
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (203)..(203): n is a, c, t, g, unknown, or other
  misc_feature (248)..(248): n is a, c, t, g, unknown, or other
  misc_feature (249)..(249): n is a, c, t, g, unknown, or other
  misc_feature (251)..(251): n is a, c, t, g, unknown, or other
  misc_feature (258)..(258): n is a, c, t, g, unknown, or other
  misc_feature (337)..(337): n is a, c, t, g, unknown, or other
  misc_feature (458)..(458): n is a, c, t, g, unknown, or other
aaaatttatttccctggganggtttgagtaggccaccttnnnggaannnnnnaaaagctggagctccccgcggtggcggccgctctagaactagtggatcccccgggctgcaggaattcgtctcacccctagaaaaaacacaccacaccacaccgggccggctcacacgcgccgcaaagcatagcacggggggctgagaccanagcagagcggagcgccaccagacaatcctttgcctgctcaagcannancaacaantggcccgatggatctgtctctctccagtacctccgcccgcttcgccctcgcggcgctggtcccccgggcctggatctangttggtggaggcggattacggaaccatgaaacaccacatcccatgtctctttccttcttctaatccccccgccccccgggagccccccccccccgggggcaggggggagggggggggtgtnattccccatacccccatcactggggttcacctaccccccccccaccccaacatggggcccacacctctcccttccaaccccaagaatgaaccccccgcccttcccctcttcaaacgcatcatcccctggcaaacctataggcgcccggggggcgctgggaggggggggccccgcggcccttctccacggtaaattaaggatactccctcaccctatgatgcatcataacacccaaccaaacgtctggttattcgccgcgtactccctgatacgcaatcccacagacttttcccgtcctcttttacacgggtgttccaccctcaattatcgcgcgcgcggtttcgtctgtgttcacgcccgcccccattatcgactattcccctccaatttccacatccatacatcccgcctttacaccaatt

SEQ ID NO: 72296 - DNA, 633 bp, Zea mays
  misc_feature: Ceres CLONE 1555177
  misc_feature: Encodes the peptide sequence at SEQ ID NO. 72297
  misc_feature (413)..(413): n is a, c, t, g, unknown, or other
  misc_feature (575)..(575): n is a, c, t, g, unknown, or other
tggagctccccgcggtggcggccgctctagaactagtggatcccccgggctgcaggaattcgtctcaccccctagaaaaaacaggctcatctcgctttggatcgattggtttcgtaactggtgagggactgagggtctcggagtggattgatttgggattctgttcgaagatttgcggaggggggcaatggcgaccgcggggaaggtgatcaagtgcaaagctgcggtggcatgggaggccggcaagccactgtcgatcgaggaggtggaggtagcgcctccgcaggccatggaggtgcgcgtcaagatcctcttcacctcgctctgccacaccgacgtctacttctgggaggccaaggggcagactcccgtgttccctcggatctttggccacgaggctggaggtatcatanagagtgttggagagggtgtgactgacgtagctccgggcgaccatgtccttccctgtgtcactggggagtgcaaggagtgtgcccactgcaagtcggcagagagcaacatgtgtgatctgctcaggatccacaccgaccgcggtgtgatgattgccgatggcnagtcccggtttttcatcatgggaaagctatcttcactttggtgggactccaccttcac

SEQ ID NO: 72297 - protein, 148 aa, Zea mays
  misc_feature: Ceres CLONE 1555177
  misc_feature (34)..(142): Pfam Name: ADH_N Pfam Description: Alcohol dehydrogenase GroES-like domain
  misc_feature: SWISSPROT Homolog: EC 1.1.1.1 Alcohol dehydrogenase
  misc_feature (76)..(76): Xaa is any aa, unknown, or other
  misc_feature (130)..(130): Xaa is any aa, unknown, or other
MATAGKVIKCKAAVAWEAGKPLSIEEVEVAPPQAMEVRVKILFTSLCHTDVYFWEAKGQTPVFPRIFGHEAGGIIXSVGEGVTDVAPGDHVLPCVTGECKECAHCKSAESNMCDLLRIHTDRGVMIADGXSRFFIMGKLSSLWWDSTF

SEQ ID NO: 72298 - DNA, 740 bp, Zea mays
  misc_feature: Ceres CLONE 1555178
  misc_feature: Encodes the peptide sequence at SEQ ID NO. 72299
  misc_feature (21)..(21): n is a, c, t, g, unknown, or other
  misc_feature (703)..(703): n is a, c, t, g, unknown, or other
cgggcgaagccgggaatgggntatcacccacctatgaaggaaaaattcatcttttaaattggaactccccgcggtggcggccgctctaaactagtggatcccccgggctgcaggaattcgtctcacccctagaaaaaatcgcacgcactcctcatcttatcccccgcctcctccggtcctcccgccgctgttgctcacttctgagtcccgacgcacgagctcccaagagctagccatggcgtccaccaccctctcctccgccttcaccctcctctcccgcccctccacctccccgtgccccgccgcctcgctcccgaggtcctcccacgccgcgccccacatccgccggggccgccgcgccgtcgccgtcgcgtgcaccgccaccgagtcccccaagatcctggagctcggggacgccatcgccgggctcaccctcgaggaggcccgcagcctcgtcgaaccactccaagaacggttcggggtaaaggccgcggccttcgctgccggccagcgacgtcgcggccccccggggcggggggttggggccgccggccaaagaaggaaggcccccgtcgaaaaaaacagaagttcgaacctaaagaatccaaaaaagattgcccaaaaagcgcggcggatcccgcacttatcaaaagatggaggcggtgacctttaacaaacccttccccgctcatagggaagggcncaagggaaccttagatcgcaggggacctctcctcaag

SEQ ID NO: 72299 - protein, 145 aa, Zea mays
  misc_feature: Ceres CLONE 1555178
MASTTLSSAFTLLSRPSTSPCPAASLPRSSHAAPHIRRGRRAVAVACTATESPKILELGDAIAGLTLEEARSLVEPLQERFGVKAAAFAAGQRRRGPPGRGVGAAGQRRKAPVEKNRSSNLKNPKKIAQKARRIPHLSKDGGGDL

SEQ ID NO: 72300 - DNA, 657 bp, Zea mays
  misc_feature: Ceres CLONE 1555179
  misc_feature: Translation starting site: 193
  misc_feature: SWISSPROT Homolog: EC 4.1.1.35 UDP-glucuronate decarboxylase
  misc_feature (494)..(494): n is a, c, t, g, unknown, or other
tggagctccccgcggtggcggccgctctagaactagtggatcccccgggctgcaggaattcgtctcacccctagaaaaaacctcgtccgccccagtctagtccgattcaaacccgcccgttccccgtgtccgagccacgcaagccgagctcaatccccagaggccagagccagctgctcggcgctccacgcgatggcgcagaaggagaccaatggcagcaacggcgagcacatctccacccgcccgccgccgaccccgtcgcccctccgcttctccaagttcttccaggctaacctgcggatcctggtcactggtggggcgggcttcatcggctcgcacctcgtggacaggctcatggagaacgagaagcacgaggtcattgttgctgataactttttcaccggttcaaaagataacctgaagaagtggatcggacacccaagatttgagctcatccgccatgatgtcactgagccactttcttgtggaggttngacagatctatcaccttgcttgcccctgcttcacaatcttctacaagcacaatcctggtaaagacatcaagaacaatggtatgggtaccctgaacatgctgggacttgcaaagagagtgggagctaggattttgttgacatcacatctgaagtttatggtgac

SEQ ID NO: 72301 - DNA, 669 bp, Zea mays
  misc_feature: Ceres CLONE 1555186
  misc_feature: Encodes the peptide sequence at SEQ ID NO. 72302
ggcggccgctctataactactggatcccccgggctgcaggaattcctctcacccctagaaaagaaaggatactgtcatccatgtccaggaggtctgttgctgcacacccttggcatgatctggagataggtcctggtgctcccaccatattcaactgcgtcattgagatacccaggggcagcaaggttaaatatgaacttgacaagaaaactggactgatcaaggtggaccgtgtgctgtattcatcacttgtttaccctcaccactatcgattcattcctcgcacgctttgagaaaacagtgatcctttggatggacggagtaaaatgcaagaattttttatcccccccccaggaggggaagaagggggggcttccccccttaccacaactaattgttatggggagaaagaaaaacgacccacatcttttccttctcgccctccaaagaaaactccaattcacagccactccctcaggctattttatagtaggttcccccccctcacccagctagggttagtaaaatcaagaaatccctaatttctaaaaaaatctaacttcaaaatatataagaaatacacccccttagtgggacgaacgtcaatatcacccccaccataattcccatgcgccctccttccctcccaaacacccatattcctcgttg

SEQ ID NO: 72302 - protein, 96 aa, Zea mays
  misc_feature: Ceres CLONE 1555186
  misc_feature: SWISSPROT Homolog: EC 3.6.1.1 Inorganic diphosphatase
RPLYNYWIPRAAGIPLTPRKERILSSMSRRSVAAHPWHDLEIGPGAPTIFNCVIEIPRGSKVKYELDKKTGLIKVDRVLYSSLVYPHHYRFIPRTL

SEQ ID NO: 72303 - DNA, 550 bp, Zea mays
  misc_feature: Ceres CLONE 1555192
  misc_feature: Encodes the peptide sequence at SEQ ID NO. 72304
  misc_feature (377)..(377): n is a, c, t, g, unknown, or other
tccccgcggtggcggccgctctagaactagtggatcccccgggctgcaggaattcgtctcacccctagaaaaaaccgagcaaaccccagcctccgttactctccttcctcttggctcgcctcggctcccgtcgtccccttccttgagatctctaggatacgagcgcattcgcatcgcttcgcctccgccgcggcctggggagatggcgggtttgggaaaggcgatgtacgcggtgggattctggatccgggagaccggtcaggccctcgatcgcctcggctgccgcctgcagggcaagtacttcttccacgagcagatttcaaggcatcgcaccatcatggacatcttgacaaacccacatgtcataggatgcattngtgctcaagtgcatccctattggtgatgtcagtcggccaagagcttcatttgtatgggtgcgtctagaggggaccaaaaacctacaattggatctggaaccatattcaaaacattcccttgggcatggggctaaatccaatcctagtggggaaagcctttcccaacatccttg

SEQ ID NO: 72304 - protein, 66 aa, Zea mays
  misc_feature: Ceres CLONE 1555192
  misc_feature (59)..(59): Xaa is any aa, unknown, or other
MAGLGKAMYAVGFWIRETGQALDRLGCRLQGKYFFHEQISRHRTIMDILTNPHVIGCIXAQVHPYW

SEQ ID NO: 72305 - DNA, 808 bp, Zea mays
  misc_feature: Ceres CLONE 1555199
  misc_feature: Encodes the peptide sequence at SEQ ID NO. 72306
  misc_feature (37)..(37): n is a, c, t, g, unknown, or other
  misc_feature (38)..(38): n is a, c, t, g, unknown, or other
ggccccccatatccacccgtcgttggtataatttaannttcccttttttctccaattgcgactccccgcggtggcggccgctctatactagtggatcccccgggctgcaggaattcgtctcacccctagaaaaaatcctccagactgcgatcagagcagcgagagagagagagagagagagagcaactgagcaagcaagcaaggaagcaagcaagcaatcggagcgatggagcacgggtacccctgcaacggctgcggcaaggagaagcggccgtcgctcaagaggggccagctcaagctgcagatcgccaggaccctgctcgggagcctcgcggtgccggtcgccaagaaccgggaccgtgccttcgggagataggccgcccgtgccgtggtatcaggagtagagtagtagctaggtgaggacatgcggtcggccaagtgggcggcggactgtggccgtctgttccccccccccacgagccttcggataccccccccctctttccttcttccttttaacacaaaagagccgtgttgggccgtccgccccgcacgcacgcccactctctccaaaactccatccatccctacacctgacccagagtccgccgccaccaaccaccagcaaccaaacccatcacaaccctcccgccctaaaaccctgcacccaccccgacgcgctctccgggggaccacacatccgccgcccttaaaacgagacgttactaatttaaccttaacaccccctagcgcatccgccgctttactaatccgcgcggccggctactcgggcgcaacaacccactag

SEQ ID NO: 72306 - protein, 49 aa, Zea mays
  misc_feature: Ceres CLONE 1555199
MEHGYPCNGCGKEKRPSLKRGQLKLQIARTLLGSLAVPVAKNRDRAFGR

SEQ ID NO: 72307 - DNA, 644 bp, Zea mays
  misc_feature: Ceres CLONE 1555203
  misc_feature: Encodes the peptide sequence at SEQ ID NO. 72308
cgcggtggcggccgctctataactagtggatcccccgggctgcaggaattcgtctcacccctagaaaaaaccagcaagaccaacaaacccacttctgactgaccactgtgccgcgccgtggtcaccggacggacacacagaacgacgatggccgcgtcggcgctgcaccagaccaccagcttcctcgggcaggccctggtctcccgcgccgccggcgtcgatgccggcggccgcatcaccatgcgccgcaccgtcaagagcgttccccagagcatatggtacggccctgatcgccccaagtatcttggcccgttctccgagcagacgccgtcgtacctgaccggcgagttccccggcgactacgggtgggacaccgcgggcctctcggccgacccggagacattcgcgcgcaaccgggagctggaggtgatccactcccggtgggcgatgctgggcgcgctgggctgcgtgttccccgagatcctggccaagaacggcgtcaagttcggcgaggcggtgtggttcaaggccggcgcgcaaatcttcctcggaggggggggtggactacctggggaacccccaacctggtgcaacccacaaagcatcctggccatttggggcgtgccaaggggggggttaatggg

SEQ ID NO: 72308 - protein, 165 aa, Zea mays
  misc_feature: Ceres CLONE 1555203
  misc_feature (59)..(153): Pfam Name: Chloroa_b-bind Pfam Description: Chlorophyll A-B binding protein
MAASALHQTTSFLGQALVSRAAGVDAGGRITMRRTVKSVPQSIWYGPDRPKYLGPFSEQTPSYLTGEFPGDYGWDTAGLSADPETFARNRELEVIHSRWAMLGALGCVFPEILAKNGVKFGEAVWFKAGAQIFLGGGGGLPGEPPTWCNPQSILAIWGVPRGGLM

SEQ ID NO: 72309 - DNA, 653 bp, Zea mays
  misc_feature: Ceres CLONE 1555205
  misc_feature: Encodes the peptide sequence at SEQ ID NO. 72310
agtggatcccccgggctgcaggaattcgtctcacccctagaaaaacttcccctcgctcgactcgatccgcagcaagctaagcgcaaccgaccagctacgcaaccatggctttcgcttcctcgaatgccaagcagagcctctacccggatgtggaccagtcccaccctgatctcaatacccctttcttctccgcacccaccacctccacctgcgccggcgccggcgccgccacgggcaactccctctaccccaccgtcgaccccaacgagctcgcacagaacctcttccccgagacggtcgaagaggacgcggcaccgccaccgcccaccccccaggagaccgtcgtcgctgtccctggggcgcagctccaccttcatcgaccccgaaccgcagcgtcgatctcggcgctggcacgctctccatcgtgcgcctccgccagggggaccactccgtcgccgtcctcgcgcgcctgaatcccgaaaaaccccaccaccggccgcggcttctttccgcttgttcaacaacggggcggtcctgacacctggcacccgaaaaaaggaacccccttccagttggcccactggggcccgcccaaggtcccggccggttcaaatttccaaaccccctggccacataattttttttctccggtg

SEQ ID NO: 72310 - protein, 122 aa, Zea mays
  misc_feature: Ceres CLONE 1555205
MAFASSNAKQSLYPDVDQSHPDLNTPFFSAPTTSTCAGAGAATGNSLYPTVDPNELAQNLFPETVEEDAAPPPPTPQETVVAVPGAQLHLHRPRTAASISALARSPSCASARGTTPSPSSRA

SEQ ID NO: 72311 - DNA, 662 bp, Zea mays
  misc_feature: Ceres CLONE 1555206
  misc_feature: Encodes the peptide sequence at SEQ ID NO. 72312
ctctagaactagtggatcccccgggctgcaggaattcgtctcacccctagaaaaagtgccacggcctcgccccttcgtaccgcacccataagctaggttttagccgcagctttctcctttttcgccgcggcggccgcaagctccaaccttctccccgaagaagccccaagcaagcgacactcttgtcctctccgcgccagatcgttgtttatgagctcgaaggagaagcccactcttggaggcacgcggattaagacccgcaagcggaacattgcagctcctttggaccctgcatcattctctgatgcaattgtccagatttatctggataatggtggacatccccaactcgggggggggaggattgagtcttccgacctcaatttctcacggttacggggacaccttttttggagggggtttttgttggaggacgccctcatcctggcactggaaaaccctgaagaaagaaaccccccccctttattcaatgtaaaatagggggggacccccctggaaacatttttggccctttcgaaactcccatatcaaaaaaaacatttgtgcaaggaggcccttttcttaaaaaaagaaaccttgtaaaagtggttcaggggccaaaattcccccacaaacccctggggaatttccctatgaaggaa

SEQ ID NO: 72312 - protein, 96 aa, Zea mays
  misc_feature: Ceres CLONE 1555206
MSSKEKPTLGGTRIKTRKRNIAAPLDPASFSDAIVQIYLDNGGHPQLGGGRIESSDLNFSRLRGHLFWRGFLLEDALILALENPEERNPPPLFNVK

SEQ ID NO: 72313 - DNA, 649 bp, Zea mays
  misc_feature: Ceres CLONE 1555211
  misc_feature: Encodes the peptide sequence at SEQ ID NO. 72314
agtggatcccccgggctgcaggaattcgtctcacccctagaaaaagcgcaagcggggctgaccatcgaaccctagtccccggccgagccgccctccgccgagccttgcggccgctctgcgtcatccctcttagtctccctccgttcgacacggcttggatccgagatggaatcaccgcccctcacagctgaagcaattgcttatacagagaaaaagatggacatggctttggaggatataattaaaatgtcaaagaaaaagaatcctggaggcaagaaacccccgaggcagccgataaaaaagcatccattccagaatggtttttctccccacacccaatggggggggggggggagttttatggagtctacatcaaccattaaaaaaggggtttcttgcacagacaagggcaaatcttgggggaaaacaattccctggttacaaagaaggcttcgaaaaaaggttgctgttatgccactggccaaagggggtatattttttggagctaagcctaggcaaccaaagtatggtctttttaattggctcatcaacaacattttcctggcctatcacggggattctatctaattttattgggcaattagtctctttgcgaaaagacataggtctagatcaaacgctatttttt

SEQ ID NO: 72314 - protein, 140 aa, Zea mays
  misc_feature: Ceres CLONE 1555211
MESPPLTAEAIAYTEKKMDMALEDIIKMSKKKNPGGKKPPRQPIKKHPFQNGFSPHTQWGGGGSFMESTSTIKKGVSCTDKGKSWGKTIPWLQRRLRKKVAVMPLAKGGIFFGAKPRQPKYGLFNWLINNIFLAYHGDSI

SEQ ID NO: 72315 - DNA, 680 bp, Zea mays
  misc_feature: Ceres CLONE 1555218
  misc_feature: Encodes the peptide sequence at SEQ ID NO. 72316
  misc_feature (185)..(185): n is a, c, t, g, unknown, or other
  misc_feature (392)..(392): n is a, c, t, g, unknown, or other
  misc_feature (394)..(394): n is a, c, t, g, unknown, or other
  misc_feature (398)..(398): n is a, c, t, g, unknown, or other
  misc_feature (400)..(400): n is a, c, t, g, unknown, or other
  misc_feature (413)..(413): n is a, c, t, g, unknown, or other
acgctggagctccccgcggtggcggccgctctatactagtggatcccccgggctgcaggaattcgtctcacccctagaaaaaaccaggcaaacggttcacacgttcgaaccccatatggctgaacccaagtcaaataatggcggggcggacgcgacggcatcgatgatgctccacggccgcgtanccattgtcaccggtggtgccggcggcatcggctcggccgtgtcgaagcacctgtcgtcgctcggcgcgcgcgtcgtggtggggtacatcggcgacccggcacctgctctgacgctggtagccgccatcaactcctccgagcaccccggggagagccagcagccgcgagtcatttcccccccccccgaggtggggggggggggaaccntnaaancncttttctaatctnccccctcaaccttctgagggggagtcccccttcctgggaagggttgccggccgtgccttaactactcccaccccccccctgggggaaaccccccaaggcgattttctacgcccccttttatcgttaaaaaacggggggccctttcttgtgtgttccccaagggggcccagtcgggttggtgctttaaatccccccctgcaaaaatcttaattttttcttttctcgggaagggggttctctccgcccccggatatctccgtataatac

SEQ ID NO: 72316 - protein, 97 aa, Zea mays
  misc_feature: Ceres CLONE 1555218
  misc_feature (24)..(24): Xaa is any aa, unknown, or other
  misc_feature (93)..(93): Xaa is any aa, unknown, or other
  misc_feature (95)..(95): Xaa is any aa, unknown, or other
MAEPKSNNGGADATASMMLHGRVXIVTGGAGGIGSAVSKHLSSLGARVVVGYIGDPAPALTLVAAINSSEHPGESQQPRVISPPPEVGGGGTXKXLF

SEQ ID NO: 72317 - DNA, 646 bp, Zea mays
  misc_feature: Ceres CLONE 1555221
  misc_feature: Encodes the peptide sequence at SEQ ID NO. 72318
tggagctccccgcggtggcggccgctctagaactagtggatcccccgggctgcaggaattcgtctcacccctagaaaaatttttcctctcgcttctgctcagctgcaacccagcgcgtagatcttattcttggacgagaactctcctcaagctctccgatttctgttctcgcgccgcttagcaattcaaccccgaaattcttttgcggcgcaatcttcacctgaatcttgggtcgtagccaagaagatgaacaaagacaaagctccgatgccgggagacggcggccccagcgacggcttgccgccgcagtccacgcgccgtgtcggggcgccgccctcgtcgtctaccccgccgctggagtgcgacatcagccgcatgccggacttccctacccggagcaccggccaccggcgtgcgcactccgagatcctgggcctacccgacgacctcgacctcagtgctccccgaggcggcgaaggaccgtcgctgtcggacgaaaacgatgaggagctcttctccatgttcctggacgtccacaaactgaactcatcgtggcggggcgccctccggaggccgaggctgattcctcctcggcccccggttgcccccgttaaggggccttatcttgcccaacccccccaggcca

SEQ ID NO: 72318 - protein, 133 aa, Zea mays
  misc_feature: Ceres CLONE 1555221
MNKDKAPMPGDGGPSDGLPPQSTRRVGAPPSSSTPPLECDISRMPDFPTRSTGHRRAHSEILGLPDDLDLSAPRGGEGPSLSDENDEELFSMFLDVHKLNSSWRGALRRPRLIPPRPPVAPVKGPYLAQPPQA

SEQ ID NO: 72319 - DNA, 1012 bp, Zea mays
  misc_feature: Ceres CLONE 1555228
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
aacaactaaatatatactatcacgcgcatctatgatggaattggagatgaagtttcgcgggaggcnnnnnnnnnnnntttnnnnnttttcgattgggtacgggccccccctcaagccactgcagtggtaaaggaagcacactacagcaccgggcgaggcggctaggccccctcaccgtccaccggcgactgggccggccgtcgctgccgccctgcctctccaccgtcgccggcgacgagcaccaccaggtgtttttgagtctgttgcgagtgttgtggccatgtccatgttcaaaaggatctccgggaagcccaagggagcagcccactcccatgctttggcccccctggacaagtttaatgaagacactttatccgcccggaaaaaaaaaaaaacgggctgtgaaaaaaaagcaaactaccaacttttcgaaaacacccaggaattttttccccccccccccaaaaaaagaagggggggggggtggctttcccttctcaaaaccaataaaaactctcctcggtgcttcatatattcttcacccctctccctgccccagacttcttcctccttcacacagacccaccccccccgagcaccagaaggacgacactacctttgtattattaagtataccacctcataccaccctcttttgagttggatgggcaagctctcaccggatgccttctgacaagcactctctaactcacagaaacacacaccgcaaatgcgtgctccgtctacttctcgagccgcggaccagagcagtgcacggccgccacagtacactcattcgccgcccactcgcacatcctcgactaataaacttcaaactaaggagtaccaattcgaccataaatcagcactcaccaaaatatcctgacagctataaaaacacgacagtaaataatacaacccacctcactctctcactatccatccccgcattatcatcaacaacactacctctacctctctctatcccccatatcttgtccctactacacaa

SEQ ID NO: 72320 - DNA, 675 bp, Zea mays
  misc_feature: Ceres CLONE 1555229
caattgggtacgcggccccccctcgagccctgcagtggtaaagggctggggctgagagtagtcctggaccacctacgtctctactgattatgtgcctcctgataattctagagcgctcgaccatgttatggctcatcagccgtgaccctcgtcgttacatctgcgaaaatagccgacctcataacaccctgtaaccctgatatgccctccgttgccatgtatgtggctgcctgctcctctacagtaagaggacccccctgattgaccgatagaattcacgctttcgactgaaactcgggaaaacactggtgacggttgatctattgctccacccttatgctatcgttccacaccttctcgggggaaatgaaaatgtacctacttactcggttatgtgctgatcgcgcgcctccttacacctctgacctgtctcaaattgcaacagcttctcccggcgcactgatttgagacctctcctgctgctgctccaggtggatcggacactacctcggcgaatctctgactcctgatcttcgccctattattcactcacatgcgatgctccggcataccctcctccccctggatcctctaaatctctggcgatcgcctctgcattgcatctccgtcttgcgtgcctttctagtgactattattatgagctagtcacgatga

SEQ ID NO: 72321 - DNA, 702 bp, Zea mays
  misc_feature: Ceres CLONE 1555232
  misc_feature: Translation starting site: 82
  misc_feature (420)..(420): n is a, c, t, g, unknown, or other
  misc_feature (507)..(507): n is a, c, t, g, unknown, or other
  misc_feature (520)..(520): n is a, c, t, g, unknown, or other
ccgattgggtacgtggaccgccctcgagcactgcagtggtaaaggcaattcccgactcgcccaccaaccttcccgtccccgatggcgatcatggcggccaccgccactgccgtggcttccccctccagctccacctcgccaggtcccctccaccccagcccccgcttcctctctcccgtctcctcgcccgctcgctgccgtctcctccccaagccgcggcggtggtgcgcgcgcctccacatcgagcgtcgggtggccgtcggcagcgacgtgtcctcgtcccatgacgtggctgccgaggaggccgctgctgtgcccaacgtcgggaagcgcgtgcgcgtcacggtgcccgtccgcgtccaccacgttgccaaggcgcccggactggacctgcgcggcatgtatgccgtcgtcaagcantacatcgggcgtttggaaggggatgcgcatcacggccaatctccccatcaaagtagagttcgagctcaagctggacagccaagaacnagccgggtccggnttcatcaccccacctccgaagagaaaggagtccgaagatccccgggggaaaggaaaaagaacctcctggaactagaagaattaaccgcggcctcctcttccgggggggctgggggccttcccgggatacccctattgggggggccggcccccaaaagaaaaaaaccgggggggcccgaagag

SEQ ID NO: 72322 - DNA, 586 bp, Zea mays
  misc_feature: Ceres CLONE 1555237
  misc_feature: Encodes the peptide sequence at SEQ ID NO. 72323
  misc_feature (49)..(49): n is a, c, t, g, unknown, or other
  misc_feature (50)..(50): n is a, c, t, g, unknown, or other
  misc_feature (341)..(341): n is a, c, t, g, unknown, or other
  misc_feature (384)..(384): n is a, c, t, g, unknown, or other
cgattgggtccgggcccccctcgagccctgcagtggtaaagggatcatnnctgcttcgagaccctgaacccgccgtgcccgccgcagggagaccaggagcccgagatcttcgacatcgccggccacttcgcccgctccggcaccgccgacgagctgcccaagacccccgtcctgtgcaagcccaacgtggacgccatggaggaggcgctcaggatcgccaacgtcaacccgcacaaggcgatcttcttcgacgacagcgtacgcaacatccaggccgggaagcagattggcctccacacggtgctgggtgggcaaatcgcagcggggtgaaaggcgccggnaccacgcgctcgagagcatccacacatcagggaagcgctgccngagctgtgggaggaggccgagaaggcggaagacgtgctctaccccgacggcgttcgatggaagactcgggtcacgcgtaaaaccccgaatgcctcgggggcaccgtcggccaaactttttgaaattttccgggacgctttaagaatccaatgtccctcctcccccaaccagggggcggggataaatcccccctgggaacgat

SEQ ID NO: 72323 - protein, 44 aa, Zea mays
  misc_feature: Ceres CLONE 1555237
MEEALRIANVNPHKAIFFDDSVRNIQAGKQIGLHTVLGGQIAAG

SEQ ID NO: 72324 - DNA, 737 bp, Zea mays
  misc_feature: Ceres CLONE 1555240
  misc_feature: Encodes the peptide sequence at SEQ ID NO. 72325
caattgggtaccgggccccccctcgagccctgcagtggtaaaggggacgccagggccgattctctgcgtgacttggggcgtcgtcgccgagttttctccggccgagggcggcgcgaccggacaaccagcgtgagcgcgaccggcgacatgactcgcggcaaccagcgtgaccgcgaccgtgagcgcgcggcggcgcggaagcccaacgccaagaactcccaggacgggctcaccccggagcagcgccgcgagagggacaagatagctctgggaggagatggccgccaagaatgcgcagcatgcagcgggcggcggcacccggtacctccacgggacaacaaccagaaccaaggcaggtggcacagaagtaaggaagcagtggccgcgcccgccacctcctggaccatttaatcgatgcccttgagcttggtgacttgttccccatcccttgtaggtgccatgccttgttggggccataaaactccgaatgatatccgagattttgggggatgagaaataatgggcggggttttccggggtttttcaacaaaaaaaaaaaaaaaaaccccgaagctctgggggaatttcccgcgccccccggggggaatccccctaatttttttaaaggcggccccccccccccggggggaaagcccccccccttttttgttcccccttttaagggggggggtttaattttttgaggagctgtggggaaaaacctgggggccaaggcg

SEQ ID NO: 72325 - protein, 87 aa, Zea mays
  misc_feature: Ceres CLONE 1555240
  misc_feature (1)..(51): Pfam Name: 4F5 Pfam Description: 4F5 protein family
MTRGNQRDRDRERAAARKPNAKNSQDGLTPEQRRERDKIALGGDGRQECAACSGRRHPVPPRDNNQNQGRWHRSKEAVAAPATSWTI

SEQ ID NO: 72326 - DNA, 631 bp, Zea mays
  misc_feature: Ceres CLONE 1555242
  misc_feature: Translation starting site: 149
  misc_feature (77)..(77): n is a, c, t, g, unknown, or other
  misc_feature (78)..(78): n is a, c, t, g, unknown, or other
  misc_feature (353)..(353): n is a, c, t, g, unknown, or other
  misc_feature (379)..(379): n is a, c, t, g, unknown, or other
  misc_feature (383)..(383): n is a, c, t, g, unknown, or other
  misc_feature (384)..(384): n is a, c, t, g, unknown, or other
  misc_feature (388)..(388): n is a, c, t, g, unknown, or other
  misc_feature (422)..(422): n is a, c, t, g, unknown, or other
  misc_feature (437)..(437): n is a, c, t, g, unknown, or other
  misc_feature (438)..(438): n is a, c, t, g, unknown, or other
cgattgggtacgggccccccctcgagccctgcagtgtcctcgccgacagggaaagccgtgttgcaagaaggggaatnntccgctgcgagatccgtgaacgggttcagaagatggcacagacggtgggttcaccccctctttggaagcgatgaagcatgtcaaggcagagaacggagtcattctcaccaagcccttccttgatgtctgcaagcaaatattgcctgtcctcgataaatttggagctgctatggcaattgtaaagagtgatatcggcggcaatatcacaagactggaaaacaagtatacttcagaaccatcaaagtatgaacacttgtacagcatgattcaggaangaagtcaaaaacagaccgcaaaaggntccnntcangctgcacaaatgggcttctgtggctgacgagggncatggacttccctgnntgagtgtttcgtaacctgcttgagcatccagactgggccatgagtcaatcttgcactgattcatacacccagaactttgaagaaatttcaatggctggcttgccagttccagtttttacgggggccatgaaaccttgcccccttattaaaagaaaatttttgggagggcctttagtgggaacccgggggaaac

SEQ ID NO: 72327 - DNA, 647 bp, Zea mays
  misc_feature: Ceres CLONE 1555245
  misc_feature: Encodes the peptide sequence at SEQ ID NO. 72328
acgattgggtaccgggccccccctcgagccctgcagtggtaaaggatgatgttcgtcgccgtcgccggcgtggccgccgcgctcgtggcgtccgccgcaggcgccgaggcccccggcccggcccccgcctccgacggcgcggcctgcgtgcccctcgccgcggcctccctcgccgccgccgccttcggctacctcttctgctagatccgcgctggacgcgtggtttgtgcttgactcgtgattcgtctggcgctcgtggagtccttgtcgtgcgcgtgtctgtgcgagttgtttccgttggcgtgtgtctgtacgtatggagtcagccgcggaggatgaggtgtgctcgttgctggtacgtcgcttcctcactccattgcttgtggcggcgatcatgtgcctgccccgttcttctggttctaatgaggtgatttcgttgtctccagaatacaggggataaccccagctctggctattcctgcagcgcgggggatccgctagttctcgagcagccgccacctcgctggagctcctgctttggctccctcccccgagggtgcatttcgagctgggcgctctcatgggaggaggcgtttcctgtgaggactgttatccgctcacattttcgctctggtagctcctcgtac

SEQ ID NO: 72328 - protein, 52 aa, Zea mays
  misc_feature: Ceres CLONE 1555245
MMFVAVAGVAAALVASAAGAEAPGPAPASDGAACVPLAAASLAAAAFGYLFC

SEQ ID NO: 72329 - DNA, 683 bp, Zea mays
  misc_feature: Ceres CLONE 1555249
  misc_feature: Encodes the peptide sequence at SEQ ID NO. 72330
ccaattgggtaccgggccccccctcgagcactgcagtggtaaaggccggtttcgttctcatctccgtttctctggattgtcccccgctccccgctcccctctccggtcttccccatgtcggacgcgtataggaaagccaagcccggccgcctcgtcttcaagggcggcgaagccgcctccatccacaagccaaagaagcacaagaagaataagaagcccgcgtcggacgccctcgccgacggcgacatcgaggccgcggccgcgaccgcggagggtgctgaaggcggcggaggtgccggcagcggcactggcgacgactacaccatcgacgcggcgaagaagatgaagtacgaggaactcttccctgtggagtcgaagaagttcgggtatgaccccgacaacgccgcccgcgctgccgcccggaaccgcaccgtcgaggaagccctcgacgaccgcgtccgcaagaaggccgaccgctactgcaaatgaggttcactcattggtcattgctgttgtttgcagctgtattgctcagtgtattgaagatggcctctttggagaattatgatcctttcccgcatggttgtttagtaatcaaagtgctagtcaagcatttttccttaggccatatttgtactagtaaataagcaaacataaaggattccttgccacatgtttattcc

SEQ ID NO: 72330 - protein, 124 aa, Zea mays; identical to SEQ ID NO: 7032
  misc_feature: Ceres CLONE 1555249

SEQ ID NO: 72331 - DNA, 762 bp, Zea mays
  misc_feature: Ceres CLONE 1555255
  misc_feature: Translation starting site: 133
  misc_feature (144)..(144): n is a, c, t, g, unknown, or other
  misc_feature (383)..(383): n is a, c, t, g, unknown, or other
  misc_feature (384)..(384): n is a, c, t, g, unknown, or other
  misc_feature (389)..(389): n is a, c, t, g, unknown, or other
acgtggcccccctcgagccctgcagtggtaaaggtgctttcttagaggtgggttggcttctcctccccctccggttcgggttcgggttcgtgaggttctccggggttcggtttcgtgggtgagcggatcgagatggcggcgtcngatgttgagtaccgctgcttcgtcggcggcctcgcctgggccacggacgaccactccctccacaacgccttcagcacctacggcgaggtcctcgagtccagattatcctcgatcgggagacgcagaggtcccgcggctgcggcttcgtcaccttcttcacggaggagggcgatgcggaacgccctccgaggcatgatttttcccccccccagacgggggggggggggggcggccaacannccccnttcccccccccccccctaaaaggcggcggcggtcgggcttacgggggggggcccttggaaacccgccgccttaccggcggtggccgggcccccctgaaagggccggccgccgggcttaccggagctaggcccaccggtccccatactgggtggcccggcgttggtcctaacgtggtgttgctcggtgggccccctatacggcggggtgtgccaccccgtggccggggcggcctaccgcgaaatctccgggacggggaaagcggggggggaaacctcgtccccgggggggggcccccccgccccgggacaaagaggattgccatgtgtcccccctcccctgtatctgccgtcccccgctgctttcccctcagcg

SEQ ID NO: 72332 - DNA, 696 bp, Zea mays
  misc_feature: Ceres CLONE 1555257
  misc_feature (223)..(223): n is a, c, t, g, unknown, or other
  misc_feature (224)..(224): n is a, c, t, g, unknown, or other
  misc_feature (230)..(230): n is a, c, t, g, unknown, or other
  misc_feature (231)..(231): n is a, c, t, g, unknown, or other
  misc_feature (254)..(254): n is a, c, t, g, unknown, or other
  misc_feature (255)..(255): n is a, c, t, g, unknown, or other
  misc_feature (259)..(259): n is a, c, t, g, unknown, or other
  misc_feature (274)..(274): n is a, c, t, g, unknown, or other
  misc_feature (277)..(277): n is a, c, t, g, unknown, or other
  misc_feature (278)..(278): n is a, c, t, g, unknown, or other
  misc_feature (279)..(279): n is a, c, t, g, unknown, or other
  misc_feature (280)..(280): n is a, c, t, g, unknown, or other
  misc_feature (281)..(281): n is a, c, t, g, unknown, or other
  misc_feature (282)..(282): n is a, c, t, g, unknown, or other
  misc_feature (283)..(283): n is a, c, t, g, unknown, or other
  misc_feature (284)..(284): n is a, c, t, g, unknown, or other
  misc_feature (285)..(285): n is a, c, t, g, unknown, or other
  misc_feature (286)..(286): n is a, c, t, g, unknown, or other
  misc_feature (287)..(287): n is a, c, t, g, unknown, or other
  misc_feature (288)..(288): n is a, c, t, g, unknown, or other
  misc_feature (289)..(289): n is a, c, t, g, unknown, or other
  misc_feature (290)..(290): n is a, c, t, g, unknown, or other
  misc_feature (394)..(394): n is a, c, t, g, unknown, or other
  misc_feature (565)..(565): n is a, c, t, g, unknown, or other
  misc_feature (568)..(568): n is a, c, t, g, unknown, or other
  misc_feature (570)..(570): n is a, c, t, g, unknown, or other
  misc_feature (597)..(597): n is a, c, t, g, unknown, or other
  misc_feature (670)..(670): n is a, c, t, g, unknown, or other
  misc_feature (674)..(674): n is a, c, t, g, unknown, or other
  misc_feature (675)..(675): n is a, c, t, g, unknown, or other
cgattgggtaccgggccccccctcgagccctgcagtggtaaaggccagttcatgcacatccacacttacagagttacagttacagccaaccaaccacatcgcatatcaaagaccagaaagctcaaaccaagaccggcgtgcgcggacgaagcacagatccatcggagtgacagcgagcgagagcgagagagacagagagattgtccgcgcgtcagcgactccnncggcgnnaagacggatgggggggaaggggnngttnggccaaattcccccnttnnnnnnnnnnnnnncccccccccccccccccctttgtgtggggggggggggccccctttaatataaaaaaaaaaacacgcggggggggcccccccgcgagaggagggggggtgtgggnaaaaaaaaaaccccctcggggggggggggggggggggggccacccccaaaaaggggggggtttttttttttttttattattaaaaaaaacggcgggggggaaaaacatcctcctttctttgtggggggggaaaaaaaaagaaatccttctcgtcgggcggggttgcttttnttncncccccccccccccccggcggcgggcgnggggaaaaaaaaaaaaatactctctttttccccccaaaaaaaaaaaaaaaaaccgggccgcgggcgggggcgntgtnntttttcagtgggcgcgccgcc

SEQ ID NO: 72333 - DNA, 657 bp, Zea mays
  misc_feature: Ceres CLONE 1555258
  misc_feature: Encodes the peptide sequence at SEQ ID NO. 72334
cgattgggtaccgggccccccctcgagccctgcagtggtaaaggggacagaggagagtctagtagggcctcggccgtttcttcgtctccacagctcccgcagccgcggaccagcgcgtcactctaccgggttccggcgtctccccttagcgcggcatccatggcggagcagacggaaagggctttcttgaagcagcccaaggtgtttctctgttccaagaaggccaccaaggtaaacaaacctggcaagggagggaacagattctggaagaacattggccttggtttcaagacacccagggaagccattgaaggaacctacattgataagaagtgtccattcaccggcactgtgtctatcaggggtcgcatcatcgccggaacatgccacagtgctaagatgaataggaccatcattgttcgtaggaattatcttcacttcgtcaagaagtaccagaggtatgagaagagacactccaacatccctgcgcacatttcaccatgcttccgtgtcaaggaaggagatcatgtgatcattggccagtgcaggccagtgtcgaagactgtaaggttcaatgtggtcaaagttattcctgcaggttcgaagagtggagcagtgaagaaagctttcactgccgcttaagatcatgacgagttc

SEQ ID NO: 72334 - protein, 160 aa, Zea mays
  misc_feature: Ceres CLONE 1555258
  misc_feature (74)..(143): Pfam Name: Ribosomal_S17 Pfam Description: Ribosomal protein S17
MAEQTERAFLKQPKVFLCSKKATKVNKPGKGGNRFWKNIGLGFKTPREAIEGTYIDKKCPFTGTVSIRGRIIAGTCHSAKMNRTIIVRRNYLHFVKKYQRYEKRHSNIPAHISPCFRVKEGDHVIIGQCRPVSKTVRFNVVKVIPAGSKSGAVKKAFTAA

SEQ ID NO: 72335 - DNA, 620 bp, Zea mays
  misc_feature: Ceres CLONE 1555260
  misc_feature: Encodes the peptide sequence at SEQ ID NO. 72336
  misc_feature (558)..(558): n is a, c, t, g, unknown, or other
  misc_feature (620)..(620): n is a, c, t, g, unknown, or other
cgattgggtaccgggccccccctcgagccactgcagtggtaaagggaaaccttgcccctgctcttcacggcgccgccgccgccgccgccgccgcgcaccaccactactctagcgcccagccgccggagaagaggagggagccagcaccagccaccgtgggttgcgtccgcaccgagaccgtgaagaagacctccaggcaggtgatcgagaagtactactcccgcatgaccctcgacttccacaccaacaagaaggtgctggaagaggtctcgatcctcccctcgaagcgcctccgcaacaaggttgccggcttcaccacccacctgatgcgccgcatccagcggggccccgtccgtggcatctcgctcaagctgcacgaggaggagcgtgagcgccgcatggacttcgtcacggagaagtcagctctcgaggtcgcagagatccgcgtcgacgaggagactatggagatgctggcggctcttggcatggccgatctcccgggcgtggagcgcccagctgacgtctaccgcgtccccgcctacggttgcctccattacngaggtccacgccgtgaccgcgtctaggtataccgcccatcccagtggttgcgacgtgaacan

SEQ ID NO: 72336 - protein, 193 aa, Zea mays
  misc_feature: Ceres CLONE 1555260
  misc_feature (52)..(173): Pfam Name: Ribosomal_S17e Pfam Description: Ribosomal S17
  misc_feature (186)..(186): Xaa is any aa, unknown, or other
IGYRAPPRATAVVKGNLAPALHGAAAAAAAAHHHYSSAQPPEKRREPAPATVGCVRTETVKKTSRQVIEKYYSRMTLDFHTNKKVLEEVSILPSKRLRNKVAGFTTHLMRRIQRGPVRGISLKLHEEERERRMDFVTEKSALEVAEIRVDEETMEMLAALGMADLPGVERPADVYRVPAYGCLHYXGPRRDRV

SEQ ID NO: 72337 - DNA, 845 bp, Zea mays
  misc_feature: Ceres CLONE 1555263
  misc_feature: Encodes the peptide sequence at SEQ ID NO. 72338
  misc_feature (76)..(76): n is a, c, t, g, unknown, or other
  misc_feature (118)..(118): n is a, c, t, g, unknown, or other
cgcagaaataatatagaaaagtaaatagtaaagactttatatacctatcttacaaatcaatttttgtgtattattntttcttttttttttttcgaattgggtacgggtccccccctcnagccctgcagtggtaaaggtacaggcgacgacggaaagaggatgatgcggggagtcggaggtccgctgctcaccatcggggatctactcagcgacctcgctgtcgacgacccactcgtcggcgtcggagatgcgtctgtcccatcatctccatcggcggcgcagcaagcggggaaggccaatccgtccgatctcagccggctctttgaggaacactatgacgatttgatgaaggctctacaagagaaggatccttcatggccctcactgatgctgaagctgtgcgcggcgctgaagactgcggataggctgatgagttgcgcggacacgaacgcggaacagctgctggagaaggtgaaggcactggagggcgtcctcgacaggagcggtcatgcggtggcagagattgtagaagctctccagaggtcaggcctagccaatgatggtcacgggttcccccgtcaaaattcggctagcaaagtaagacgtttctggtcctgctttttttggttcgtccttctatccccatgcaaaatcctcttggggtaattgtggaagatgagttttgttttgttcctaaccctgggtgcccttcccaccggacttttttgcgggcccctggccccttggattttttttttttttttttaaaccccctttaacccgggaattcttgtgggaaaaatgtgccgaccgcttttaagagatatttttttatcccccctggg

SEQ ID NO: 72338 - protein, 168 aa, Zea mays
  misc_feature: Ceres CLONE 1555263
MMRGVGGPLLTIGDLLSDLAVDDPLVGVGDASVPSSPSAAQQAGKANPSDLSRLFEEHYDDLMKALQEKDPSWPSLMLKLCAALKTADRLMSCADTNAEQLLEKVKALEGVLDRSGHAVAEIVEALQRSGLANDGHGFPRQNSASKVRRFWSCFFWFVLLSPCKILLG

SEQ ID NO: 72339 - DNA, 622 bp, Zea mays
  misc_feature: Ceres CLONE 1555267
  misc_feature: Encodes the peptide sequence at SEQ ID NO. 72340
  misc_feature (575)..(575): n is a, c, t, g, unknown, or other
cgattgggtaccgggcccccctcgagccctgcagtggtaaagggtgctttcttagaggtgggttggcttctcctccccctccggttcgggtgcgggttcgtgaggttctccggggttcgggttcgtgggtgagcggatccagatggcggcgtcggatgttgagtaccgctgcttcgtcggcggcctcgcctgggccacggacgaccactccctccacaacgccttcagcacctacggcgaggtcctcgagtcccagatcgtcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggctgtgggtacggtggtggccgtggaggcggcggctacggcaatggcgggcgccgtgatggccgtggcggctacggcggtggcggcggctactgtagctgcagctgctactgtggtggtggcggctgctacggcagtggcaaccgtggctgcngctactgctactccgacgggaactggatgaactgaccggtggggccc

SEQ ID NO: 72340 - protein, 155 aa, Zea mays
  misc_feature: Ceres CLONE 1555267
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (145)..(145): Xaa is any aa, unknown, or other
MAASDVEYRCFVGGLAWATDDHSLHNAFSTYGEVLESQIVLDRETQRSRGFGFVTFSTEEAMRNAIEGMNGKELDGRNITVNEAQSRGGRGGGGCGYGGGRGGGGYGNGGRRDGRGGYGGGGGYCSCSCYCGGGGCYGSGNRGCXYCYSDGNWMN

SEQ ID NO: 72341 - DNA, 663 bp, Zea mays
  misc_feature: Ceres CLONE 1555270
  misc_feature: Encodes the peptide sequence at SEQ ID NO. 72342
ccgggccccccctcgagccactgcagtggtaaaggcacgaacgcgtcgcatccgctccacaggatcctctgcgccaccgcaaccgtgtgaccgcccgtgccgccggcgatcccgatccgccgacccgtcccagccccgctcgcagccatgtcgccgtcggagccgacgcgggaggagagcgtgtacatggccaagcttgcggagcaggcggagcggtacgaggagatggtcgagttcatggagcgcgtcgcgcgctacgccgggggcgcccggcggcggaggactactctctgtggaggagcgcaaccttgctgtcgcctccctactagaatttcttcccctcccccgcggcctcgcggccgacctcatgttctatacacctcaccgaggaaggcctggtgaacgacgctgattctactaccgtgctttacttctgctcgtgtatgtatgtctatctgggcctcatgtgcgattgcatcttcgagctcgtcagatcccacgtcatgtcatacatccgagtgggcgtagtaacggtgggctgccacataagaatagcatgattcatgatgcacatgattattaatggaattctttcatttggttctggatgcagaagaaacaacatgcaagctctggggattcttggaccctgcggtatcccat

SEQ ID NO: 72342 - protein, 84 aa, Zea mays
  misc_feature: Ceres CLONE 1555270
MSPSEPTREESVYMAKLAEQAERYEEMVEFMERVARYAGGARRRRTTLCGGAQPCCRLPTRISSPPPRPRGRPHVLYTSPRKAW

SEQ ID NO: 72343 - DNA, 954 bp, Zea mays
  misc_feature: Ceres CLONE 1555273
  misc_feature (71)..(71): n is a, c, t, g, unknown, or other
  misc_feature (98)..(98): n is a, c, t, g, unknown, or other
  misc_feature (255)..(255): n is a, c, t, g, unknown, or other
  misc_feature (278)..(278): n is a, c, t, g, unknown, or other
  misc_feature (682)..(682): n is a, c, t, g, unknown, or other
  misc_feature (683)..(683): n is a, c, t, g, unknown, or other
  misc_feature (684)..(684): n is a, c, t, g, unknown, or other
  misc_feature (689)..(689): n is a, c, t, g, unknown, or other
  misc_feature (714)..(714): n is a, c, t, g, unknown, or other
  misc_feature (716)..(716): n is a, c, t, g, unknown, or other
  misc_feature (791)..(791): n is a, c, t, g, unknown, or other
gaaataaacaagggtgtcgattgcgttgagcggaaaaaagaaggaaaaagagtttggtgtttatgaaagtnaatggaaaaaagaggtggggccccccnggtcccgattgggtacgtggccccccctcgagccactgcagtggttaaaggtctctgctataagtagctgcactctctctcctccaagcctaccccagccagccgccgccagccaccgccacctgccccagcgcgccgccgccgcagccaccatggngtcgcgtccgcaccaagaccgtngaagaagacctccaggcaggtgatcgaagaagtagctactcccgcatgaaccctcgaacttccacaccaacaaagaaggtgctcgaaggagggtctcgatcctgcccctcgaagcgcctcccgcaacaagggtgggctgggcttcagttacccaaccttgatgccgccgcattccaagcgccggccccaagtcccgcggcaatcctcgccttcaaacctttcaccgaaggaaagaaaaccccctaagcccccccccaatgggaacttttcggtgtggcccggagaaaaaaaaacccccccgccgccctctctaaaaggcgtcccgaaaaaaaaaaagaactcaccgcgggtgtcggtcaacccagagggagaagaaaacaccaatgtgggtataaataaattannntttanaaacccatgaccccccccctcgcgnanaaaatatgggccccaaggaaaacatgttgcgcccccacgggggctttttttaagaagaaggccccccgggggcgntgtgaagaggggctctcttccaaaaaaggaccccccccccgcgcccctttaagaggggcgccccgcacccgcgaaaagtacccggggggggggccgcccccccccgccccggggtgaacccgccccgcctttcataagaaactcctccgcgcggggtgggggg

SEQ ID NO: 72344 - DNA, 619 bp, Zea mays
  misc_feature: Ceres CLONE 1555284
  misc_feature: Encodes the peptide sequence at SEQ ID NO. 72345
  misc_feature (437)..(437): n is a, c, t, g, unknown, or other
  misc_feature (446)..(446): n is a, c, t, g, unknown, or other
  misc_feature (455)..(455): n is a, c, t, g, unknown, or other
  misc_feature (467)..(467): n is a, c, t, g, unknown, or other
  misc_feature (477)..(477): n is a, c, t, g, unknown, or other
  misc_feature (478)..(478): n is a, c, t, g, unknown, or other
  misc_feature (481)..(481): n is a, c, t, g, unknown, or other
  misc_feature (488)..(488): n is a, c, t, g, unknown, or other
  misc_feature (497)..(497): n is a, c, t, g, unknown, or other
cgattgggtacgggcccccctcgagccactgcagtggtaaaggtgctttctcagaggcgggttggcttctcctcccccaccaggttcgtgattcaggttctggttcgtgggcgagagggaagagatggcggcgtcggacgttgagtaccgttgcttcgttggcggcctcgcctgggccaccgacgaccactccctcaacaacgccttcagcacctacggcgaggtcctcgagtcgaagatcatcctggatcgggagacgcagaggtcccgcggcttcggcttcgtcaccttctccacggaggacgcgatgcgcagcgccatcgagggcatgaacggcaaggagctcgacggccgcaacatcaccgttaacgaggcccagtcctgacgcggccctcgaggcggcggtggcggatactgtggcgggcgccgtgatggangcagctacngcagtggcngtggcggctacngaagtggtcnntgnagctacngccgcggcngtgggggataccgtggtgaaaaccgcggcgggcggctacggcaacaacgacgttaactggaggaactgaacgggtgggggtcccctgaaggctagttaacctggttccccttccggctcccg

SEQ ID NO: 72345 - protein, 86 aa, Zea mays
  misc_feature: Ceres CLONE 1555284
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLNNAFSTYGEVLESKIILDRETQRSRGFGFVTFSTEDAMRSAIEGMNGKELDGRNITVNEAQS

SEQ ID NO: 72346 - DNA, 663 bp, Zea mays
  misc_feature: Ceres CLONE 1555286
  misc_feature: Encodes the peptide sequence at SEQ ID NO. 72347
cgattgggtaccgggccccccctcgagcactgcagtggtaaaggcagccggccggcgggcgggcgggcgggcggctcacgagtgaaggtgacttctcctcctccctccctccgcggcacacatcgcagggccacccttactattttaattttagggtagggaaacccttgattcacccccaaaccctcgctccttaacaaatccatccgccaccgtcggccaggtaaccatgtcgatgtcctcgcccacggtccaggtttcgtcttcatcgtcctccatcatcgccaccaccgctgtcggctcgcacgtgctcaagatcgacggctactcgcgcaccaagggcctcgccaccggcatccacctcaagtcctgctcgttccgcgtcggcggccactcctggcacctcgcttacctccccaacggcgactgcgcgcagacggccgactacatctcgctctacctcgttctcgaggacgcacccgccaaccgcacccccgcgctcgcgcagctcagcgtcggccttctcgaccgtgccggcaagccggtgccgtccccctgcagcccggggggatcactagttctagagcggccgccaccgcggtggagctccagcttttgttccctttagtgagggttaatttcgagccttggcgtaatcatggc

SEQ ID NO: 72347 - protein, 132 aa, Zea mays
  misc_feature: Ceres CLONE 1555286
MSMSSPTVQVSSSSSSIIATTAVGSHVLKIDGYSRTKGLATGIHLKSCSFRVGGHSWHLAYLPNGDCAQTADYISLYLVLEDAPANRTPALAQLSVGLLDRAGKPVPSPCSPGGSLVLERPPPRWSSSFCSL

SEQ ID NO: 72348 - DNA, 676 bp, Zea mays
  misc_feature: Ceres CLONE 1555288
  misc_feature: Encodes the peptide sequence at SEQ ID NO. 72349
  misc_feature (613)..(613): n is a, c, t, g, unknown, or other
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (623)..(623): n is a, c, t, g, unknown, or other
  misc_feature (624)..(624): n is a, c, t, g, unknown, or other
  misc_feature (625)..(625): n is a, c, t, g, unknown, or other
  misc_feature (626)..(626): n is a, c, t, g, unknown, or other
  misc_feature (627)..(627): n is a, c, t, g, unknown, or other
  misc_feature (628)..(628): n is a, c, t, g, unknown, or other
  misc_feature (629)..(629): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
  misc_feature (633)..(633): n is a, c, t, g, unknown, or other
  misc_feature (634)..(634): n is a, c, t, g, unknown, or other
  misc_feature (635)..(635): n is a, c, t, g, unknown, or other
  misc_feature (636)..(636): n is a, c, t, g, unknown, or other
  misc_feature (637)..(637): n is a, c, t, g, unknown, or other
  misc_feature (638)..(638): n is a, c, t, g, unknown, or other
  misc_feature (639)..(639): n is a, c, t, g, unknown, or other
  misc_feature (640)..(640): n is a, c, t, g, unknown, or other
  misc_feature (641)..(641): n is a, c, t, g, unknown, or other
  misc_feature (642)..(642): n is a, c, t, g, unknown, or other
  misc_feature (643)..(643): n is a, c, t, g, unknown, or other
  misc_feature (644)..(644): n is a, c, t, g, unknown, or other
  misc_feature (645)..(645): n is a, c, t, g, unknown, or other
  misc_feature (646)..(646): n is a, c, t, g, unknown, or other
  misc_feature (647)..(647): n is a, c, t, g, unknown, or other
  misc_feature (648)..(648): n is a, c, t, g, unknown, or other
  misc_feature (649)..(649): n is a, c, t, g, unknown, or other
  misc_feature (650)..(650): n is a, c, t, g, unknown, or other
  misc_feature (651)..(651): n is a, c, t, g, unknown, or other
  misc_feature (652)..(652): n is a, c, t, g, unknown, or other
  misc_feature (653)..(653): n is a, c, t, g, unknown, or other
  misc_feature (654)..(654): n is a, c, t, g, unknown, or other
  misc_feature (655)..(655): n is a, c, t, g, unknown, or other
  misc_feature (656)..(656): n is a, c, t, g, unknown, or other
  misc_feature (657)..(657): n is a, c, t, g, unknown, or other
  misc_feature (658)..(658): n is a, c, t, g, unknown, or other
  misc_feature (659)..(659): n is a, c, t, g, unknown, or other
  misc_feature (660)..(660): n is a, c, t, g, unknown, or other
  misc_feature (661)..(661): n is a, c, t, g, unknown, or other
  misc_feature (662)..(662): n is a, c, t, g, unknown, or other
  misc_feature (663)..(663): n is a, c, t, g, unknown, or other
  misc_feature (664)..(664): n is a, c, t, g, unknown, or other
  misc_feature (665)..(665): n is a, c, t, g, unknown, or other
  misc_feature (666)..(666): n is a, c, t, g, unknown, or other
  misc_feature (667)..(667): n is a, c, t, g, unknown, or other
  misc_feature (668)..(668): n is a, c, t, g, unknown, or other
  misc_feature (669)..(669): n is a, c, t, g, unknown, or other
  misc_feature (670)..(670): n is a, c, t, g, unknown, or other
  misc_feature (671)..(671): n is a, c, t, g, unknown, or other
  misc_feature (672)..(672): n is a, c, t, g, unknown, or other
  misc_feature (673)..(673): n is a, c, t, g, unknown, or other
  misc_feature (674)..(674): n is a, c, t, g, unknown, or other
  misc_feature (675)..(675): n is a, c, t, g, unknown, or other
cgattgggtacgtggcccccctcgagccctgcagtggtaaagggtgctctctcagaggtgggctggcttctcctccccctcttacaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctactgcggcggtcgcggcggcggcggctatggtggcgggcgccgtgacggcggttatggcggcggtggcggctactgcggtcggcgcgagggtggtggcggcggctactgaggcggtggcggctacggcggtcggcgcgagggtggtggtggcgtcggggggggagtggccgcctttttctcctcgtccttggtcggnnnnnnnnnnnnnnnnnnnnnnnnnnnnnnnnnnnnnnnnnnnnnnnnnnnnnnnnnnnnnnnt

SEQ ID NO: 72349 - protein, 131 aa, Zea mays
  misc_feature: Ceres CLONE 1555288
  misc_feature (10)..(81): Pfam Name: RRM_1 Pfam Description: RNA recognition motif. (a.k.a. RRM, RBD, or RNP domain)
  misc_feature (48)..(128): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYCGGRGGGGYGGGRRDGGYGGGGGYCGRREGGGGGY

SEQ ID NO: 72350 - DNA, 666 bp, Zea mays
  misc_feature: Ceres CLONE 1555294
cgattgggtaccgggccccccctcgagccactgcagtggtaaagggcgcggggtgtcgggcaaggtgcccccacgcgcggcggttggcgccgccgccgtccaccgccgcccgcgtgcgcccaccgccacctgttaccgcctaaggggaacgcctccgttataacccacggcaccatccatgccgtcctccaccaccgcttcaccatccccgccaggcccaccaccaccatggcctctccttcccccgcccgcgcctccggccggcgcgtgccgcccccgtgctggacgaccgacgagaccctcgcgctcgcgcgggcctacaccgcgcgccgcctcgccgtcggccgggagcacctgacctccgctgactgggccgccgtcgccgcggccgccccgtccaagacggccagccagtgccgccacaaggtcgagaagctccgccgacgcctccggtccaaccgccgccgcccgtgcccgctcctcgacgccatcgacctcctcgacgtcccttccccgcccttcttctccaagtcccaatcacgatccacgtcgcggtcctcgtcgacgccgccgctgccggcagcggtctcttcgccgtctcacccttcacctcccgcatccccgcccagaaagaggcggctggacgatgccggggacgaggacggt

SEQ ID NO: 72351 - DNA, 589 bp, Zea mays
  misc_feature: Ceres CLONE 1555306
  misc_feature: Encodes the peptide sequence at SEQ ID NO. 72352
cgattgggtaccgggcccccctcgagccactgcagtggtaaaggcgttagttactccagtccaggcttaaggttaagcacctcccaaacacgcctatgagggccctcgtccggatccacctgcccacggccatctccaccggatccttcctccacacctcctcaaccgccgcctccaagaccctagtaccgaaccccaacctcgtcccgctccggctcgtccgccacttcccggccatggccgaccacgtcgcagactagttcgtgaatggccgcgtcgtccccaacggcgtcggcgtcatcacgctcgaccgacccaggccctccacgccctggacctcgaaatggatgtagaaacaaggcacctccttgatgaaagggaaaacaaacccagggtccagggaattcttggggaaaagaaacccttcccgggccttcttcaaaaaggcttggccccctcccccctttttcccagaggaaaccccccggcccccccccaaaaaagggtttgggccccttcccccaaaggggggcttttgcccaaaatggggggaaaaaaaccccaaaaaggggggggcactttttggttt

SEQ ID NO: 72352 - protein, 54 aa, Zea mays
  misc_feature: Ceres CLONE 1555306
MRALVRIHLPTAISTGSFLHTSSTAASKTLVPNPNLVPLRLVRHFPAMADHVAD

SEQ ID NO: 72353 - DNA, 634 bp, Zea mays
  misc_feature: Ceres CLONE 1555319
cgattgggtacgtggccccccctcgagccctgcagtggtaaagggcggaggaggtggacgaggtgctcggctcgcggcgcgagaaggggttccttcctggccccgaggagagcggcgaccacgaggagcgggagcaggaggaggaggaacgcgaagaacgccacggcgggcgtggggagagggaacgccacggacgtgaggagcgggagaaagaggaggaacgcgaaggacgccacggcggccgtgaggagcgggaggaggaggaacgccacggccgcgggcgccgcgaggaggtggcggagacgctcatgaggatggtgaccgccaggatgtgaggccgccgcgctcgccaaaacgagcaagcaggaagcaacgagaggatggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataaaaaaaaaaaaaaaaaaccagagctctgggaattcctgcagcccgggggg

SEQ ID NO: 72354 - DNA, 875 bp, Zea mays
  misc_feature: Ceres CLONE 1555322
  misc_feature (1)..(1): n is a, c, t, g, unknown, or other
  misc_feature (15)..(15): n is a, c, t, g, unknown, or other
  misc_feature (35)..(35): n is a, c, t, g, unknown, or other
  misc_feature (38)..(38): n is a, c, t, g, unknown, or other
  misc_feature (52)..(52): n is a, c, t, g, unknown, or other
  misc_feature (53)..(53): n is a, c, t, g, unknown, or other
nttcgttttgttttnctgtttttgtttagggtttnttnttattttatatttnnttttacgattgggtaccgggccccccctcgagccactgcagtggtaaaggcggccccagatcactgggagtcgcaagtagcaacccgcatcacgagttctcccacgctccccgcacagggacagatcactagcgaccagggagttcaaacaagaggcaacgagaacgaacgccaccaccgcgctccggtcgctttgcttggttcggagccactgcaccgccattgttgatctgttctccttctccttggaggacaaagaagaggggagaggaatgatggggtggacgagcgtgtggggcgacatccgtggtgtgaatttaaatggggttaaagtgcgaagagacacagctcccgcggacagacctcacaccccctccccccccccaccttcagctcgccgcgggcttggggcgtatgggaatccgaggagaccgcccccccccccccccagagcccaaccctgccgaattctttcctgttgcaatgcccagcaaacacccgaacggagacattgtccgacacctgaacaaaggtagtaggccaccccccgaaaaaaggtagccctctagagggggaaactagtaaaatacctactctcgccaagaaaggggaccttcctgtcgggcacgaaaaacagcaaacaggaacaggtccgtaccagtctataacttgtccccgtcttattaagagccaagacctttaacgaaaatgcgcaccaataccttctggagcctacaaatcaaatttacagaaggccaattacgggtggatacaactttaaagccttttgagtactagacaacgtacctcaactcatacttg

SEQ ID NO: 72355 - DNA, 651 bp, Zea mays
  misc_feature: Ceres CLONE 1555329
cgattgggtacgggccccccctcgagccctgcagtggtaaagggcacgacggctgattcctttccgggtcgaaccgctgttgaccaacgttgtcgttgtttcctccccaacttccaacatggcctctatcttcatccactcttcccccttctccttccggtcctccccccgacactattaatatacgcgggtatgcgtccgaggcctcccttgttctatgcttatcacctccaagggcgctactccgtccgcgcatgatctgctctcctgcttccggcagaggtcgctgtgcaacatgaccaacatcaatcccaaggtcttgctcggacataatcaaggtgaagaacgtccccggacaactcagagtggccacgatcgttacctacatgatcctcggcgtcctgctattgtcctatgtttacgctgcctataagtactgctagggctgcacacgaccaccagatgcagtaaccaccgcatgaaactgatccgcctcctactgcgtggactgatctccaatgttgtgtgtatcatcacggttgactgcaaacatctgttggtttcgttgcatgtcgtaccaaaatggggcgtccctttgggaacttttgcattacgccttggaattggtcggaacccaaggtttccggaacg

SEQ ID NO: 72356 - DNA, 636 bp, Zea mays
  misc_feature: Ceres CLONE 1555331
  misc_feature: Encodes the peptide sequence at SEQ ID NO. 72357
cgattgggtacgggcccccctcgagccctgcagtggtaaagggaaagcctccgctactcccacgtctcccatggccgtcgacagattagccgcagcgccgctccgccggctgctcctccgcctccgtgacccgccgccgatgccctttaacacacacctatcccggctcgcgccacatctgcagcaaggccacacactagacccagcgacagcccatgctcttgcactcccgacctcgacgacacggccaaacgccatccgggattctgcgcgacgcgctcttctcctttcacccgggcctccacgcacacccggacctagatcagattgggggtgcccccgcaaaggactatgacggcgcaggagctgctgatgtgtgggctcgacagcgtgaagaagagcgcaagcctaagatgaacaagcacaatctccgcaagctccagaagcgacttcaccgacagacatgagggctctctcctctccggctacaacgttgttggaattgaaacctcggtctccgacgctgttacacactggctaactgtgtatacctgctgcaagtttttgttaggccaaagagcaatatgatcgattgcagccgacaattgttgtgaccaacagcttagaaaggcttgc

SEQ ID NO: 72357 - protein, 83 aa, Zea mays
  misc_feature: Ceres CLONE 1555331
MLLHSRPRRHGQTPSGILRDALFSFHPGLHAHPDLDQIGGAPAKDYDGAGAADVWARQREEERKPKMNKHNLRKLQKRLHRQT

SEQ ID NO: 72358 - DNA, 691 bp, Zea mays
  misc_feature: Ceres CLONE 1555332
  misc_feature: Encodes the peptide sequence at SEQ ID NO. 72359
cgattgggtaccgggccccccctcgagccctgcagtggtaaagggcggacccatcgtgcgccttcgcttcagccgtgagcccgcaaccgacccgccgcaaaagaccaaaaccctagccgtcacagcgccgcccccgaaccataaacctccacctcgccggcggccatggcgttctccggcaggatccaggagctcgtgaggaagtatggcaaggtggccatttgcgtccacctatccgtctcctgcgcctccatcgccggcctttacgtcgccatcaacaacaacgtcgacgtcgaagccgttttccggaggttcggtatctcccccggcgttaccgtaggcggcgaggcctcacccgcccccgtttcccgcgatgaacacctgcgcgacgtccccctgccgcccatggccaacgaggtactgcaagaagagacggagcgagagcggcagccccgcaacaggacgatggagctcgtggcgtcaagtggcggcgcgttcgcgctcgctgtcgtctgcaacaaggcactattccccgtgagggtccccatcaccatcgcgctcacgccgcccgtcgccagggccctaagccgctggaggctcgtcaagagctgatctgtgtttttttcgtcacaactgctctgggatatagggtgcatccacatccaggaaatccagagagaaaatcgccgct

SEQ ID NO: 72359 - protein, 148 aa, Zea mays; identical to SEQ ID NO: 11115
  misc_feature: Ceres CLONE 1555332
  misc_feature (1)..(147): Pfam Name: DUF1279 Pfam Description: Protein of unknown function (DUF1279)

SEQ ID NO: 72360 - DNA, 668 bp, Zea mays
  misc_feature: Ceres CLONE 1555334
  misc_feature: Encodes the peptide sequence at SEQ ID NO. 72361
cgattgggtaccgggccccccctcgagccactgcagtggtaaaggggagtggcgcagctccgcctccggcaagtccgtcgccatcgtcaaccccaccacccgcaagacgcagtacagggtgcaagataccccttggagtagttttggcaatcccgccgttcaactatcctgtcaacttagcagtttctaagattggcccagcactaattgcaggcaatgctcttgtgctaaagcctccaactcagggcgctgtggctgcacttcatatggtacactgcttccacctggctggtttcccgaaaggtttgatcagttgtgtgactgggaagggttctgaaataggagattttcttacaatgcatcctggagtcaactgcataagttttactggtggcgatactggtatagccatttcaaagaaggctggaatggtccctcttcagatggagcttgggggaaaagatgcttgcattgtgctagaggatgcagatctggatttggtttccgcaaatatagtaaagggtggcttctcatacagtggccagaggtgcactgctgtcaaagtagtgctgatcatggaatcgattgctgatgctgtggtacagaaggttaatgccaagttggcgaaactgaaagttggcccacctgaggacgactctgatatcacc

SEQ ID NO: 72361 - protein, 222 aa, Zea mays
  misc_feature: Ceres CLONE 1555334
  misc_feature (3)..(222): Pfam Name: Aldedh Pfam Description: Aldehyde dehydrogenase family
  misc_feature: SWISSPROT Homolog: EC 1.2.1.9 Glyceraldehyde-3-phosphate dehydrogenase (NADP(+))
IGYRAPPRATAVVKGSGAAPPPASPSPSSTPPPARRSTGCKIPLGVVLAIPPFNYPVNLAVSKIGPALIAGNALVLKPPTQGAVAALHMVHCFHLAGFPKGLISCVTGKGSEIGDFLTMHPGVNCISFTGGDTGIAISKKAGMVPLQMELGGKDACIVLEDADLDLVSANIVKGGFSYSGQRCTAVKVVLIMESIADAVVQKVNAKLAKLKVGPPEDDSDIT

SEQ ID NO: 72362 - DNA, 649 bp, Zea mays
  misc_feature: Ceres CLONE 1555338
  misc_feature: Encodes the peptide sequence at SEQ ID NO. 72363
cgattgggtacgggcccccctcgagccactgcagtggtaaagggagacctatccttttcccactcccgggtctccagcattcctatcctctccccgcccgcccgtgccgccgccaccgacgccgccgcggcttcccttcctctcccgagccaagatgaatgttgaaaagctcaagaagatggcaggtgctgtgcgcaccggggggaagggtagcgtgcgcatgaagaagaaggcagtccacaagactacaaccacagatgacaaacggcttcaaagcaccttgaaaagaataagagtgaacagcattcctggtattgaagaggtcaacatctttaacgatgatgttgttattccgtgtgtaaatcctaaagtgcaagcgtcaattggtgctaatacatgggtggtcagtggaactccacagactagagaagctcgcaagatctgcttccatcgattatcaaccagcttggtcctgacaacctggacaatctgcggaggctcgcagagcaattccagaagcaagcctctggcgcttctggtgcacaggctggtgccagcgctagggctgttcaggacgatgatgatgacgttcctgagcttgtcactggagagacatttgacgaggccgcggaagagaaaaacgagtcct

SEQ ID NO: 72363 - protein, 165 aa, Zea mays
  misc_feature: Ceres CLONE 1555338
  misc_feature (34)..(92): Pfam Name: NAC Pfam Description: NAC domain
MNVEKLKKMAGAVRTGGKGSVRMKKKAVHKTTTTDDKRLQSTLKRIRVNSIPGIEEVNIFNDDVVIPCVNPKVQASIGANTWVVSGTPQTREARKICFHRLSTSLVLTTWTICGGSQSNSRSKPLALLVHRLVPALGLFRTMMMTFLSLSLERHLTRPRKRKTSP

SEQ ID NO: 72364 - DNA, 559 bp, Zea mays
  misc_feature: Ceres CLONE 1555342
  misc_feature: Encodes the peptide sequence at SEQ ID NO. 72365
  misc_feature (246)..(246): n is a, c, t, g, unknown, or other
cgattgggtaccgggccccccctcgagccctgcagtggtaaaggcgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtccntcgagtccaagaattatccctcgatcggggagaccgcagagggtcccccgggctttcgggttttcttcacccttttccccacgggggggaaggccaattcccgaaaaccccccctttcaagggggcttataaaccggcaaaggaaacttttggaagggggccccaaaaaattttcccctttttaaaaaagagaggccccctttccccccccccggggggcccccttaataaaaaagagggggctgctcgcggggtttttacactgggtggggggcccccccagagagagggggggcggcctcccccggggggg

SEQ ID NO: 72365 - protein, 139 aa, Zea mays
  misc_feature: Ceres CLONE 1555342
  misc_feature (35)..(35): Xaa is any aa, unknown, or other
MAASDVEYRCFVGGLAWATDDHSLHNAFSTYGEVXRVQELSLDRGDRRGSPGLSGFLHPFPHGGEGQFPKTPPFKGAYKPAKETFGRGPQKIFPFLKKRGPLSPPPGGPLNKKEGAARGVFTLGGGPPQREGGRPPPGG

SEQ ID NO: 72366 - DNA, 597 bp, Zea mays
  misc_feature: Ceres CLONE 1555343
  misc_feature: Encodes the peptide sequence at SEQ ID NO. 72367
  misc_feature (245)..(245): n is a, c, t, g, unknown, or other
  misc_feature (246)..(246): n is a, c, t, g, unknown, or other
  misc_feature (348)..(348): n is a, c, t, g, unknown, or other
  misc_feature (351)..(351): n is a, c, t, g, unknown, or other
  misc_feature (353)..(353): n is a, c, t, g, unknown, or other
cgattgggtaccgggccccccctcgagccctgcagtggtaaaggggtccctgtccatccgtagcgttccattccattccatcccatccccggaaagtgcaaggacgggagggagagcggccggcgcgtcacaaataccaccagcccaggggccatggccgccgcgatgaccagcttcgtcgccaagaacccgctgctcgcggccgcggcgcggcgcagggcgcctcccctcgcggggcgcgcccnntgcgtctctccgctcaggctgaggaccgtcacgtgcttcgtgccgcaggacacggcggccccggccgctccgttgccgcgctggacaaagaggcaggggcgncgncngcgcgggccttttcggaaaagggaggcccggaaacgggtccaaacgggcgaacattcctgggggccccccccggaatctaagccctcggaataccctcccatgggcgttcccccccccgggaactatccctttcacctgggaaaaaggaaagggcccaaaagtcccccgaaaataaaaaactgggggaattttcccctcttctctttggggggggggggcggaaaaagaattttttggggccgc

SEQ ID NO: 72367 - protein, 148 aa, Zea mays
  misc_feature: Ceres CLONE 1555343
  misc_feature (31)..(31): Xaa is any aa, unknown, or other
  misc_feature (67)..(67): Xaa is any aa, unknown, or other
MAAAMTSFVAKNPLLAAAARRRAPPLAGRAXCVSPLRLRTVTCFVPQDTAAPAAPLPRWTKRQGRRXRGPFRKREARKRVQTGEHSWGPPPESKPSEYPPMGVPPPGNYPFHLGKRKGPKSPPKIKNWGNFPLFSLGGGGGKRIFWGR

SEQ ID NO: 72368 - DNA, 517 bp, Zea mays
  misc_feature: Ceres CLONE 1555347
  misc_feature: Encodes the peptide sequence at SEQ ID NO. 72369
cgattgggtaccgggccccccctcgagccactgcagtggtaaaggctaccgccgccgcgtctaaaccctccaccgccgcggtgcgtcagaggcagaggcagagaggcagaggcagaggcagccatggggagccgcctcgggcgccgcgtgatccactttgccaacctcccgctgaaggtcatgctgccccccgcgccgctctcctccgtgcaggagttcgccgtgcggaccgtcccctccgcttccaaggtggacatcccggcggctgccctccgagtcccttggaacgggttttttccctccccccaaaggtccccccccttaacgggggggaaaaactcccgggggcccttttctcccaaacccaaataaaaaggcttttttcctctcccccccttcgggtttcccccaactttttcccctgggggcccccccggggggggggggggaaaaaccccccccccccccccaaaaaaaaaaaggggggggaggcccccccccctggggggggggggaa

SEQ ID NO: 72369 - protein, 82 aa, Zea mays
  misc_feature: Ceres CLONE 1555347
MGSRLGRRVIHFANLPLKVMLPPAPLSSVQEFAVRTVPSASKVDIPAAALRVPWNGFFPSPQRSPPLTGGKNSRGPFSPKPK

SEQ ID NO: 72370 - DNA, 598 bp, Zea mays
  misc_feature: Ceres CLONE 1555349
  misc_feature: Encodes the peptide sequence at SEQ ID NO. 72371
cgattgggtccgggccccccctcgagccactgcagtggtaaaggactgaggctgtggcggtggcgctagccagcctcgcatgcgttgttccgggccggtgatggcagtgcccgcacgcgcctgctcccagacgacgacggcagccaccccgcgcgcctgctttggggccgcggcatggccagagcgcgtgctcgcctacccatggcgatgacgcagcccgattccgcagcgtggccagatcccgtgctcgcctgcttgcgcggcgggggcggcccgcgcttgaccgcatctgctcgaccagcgctcacatgcctgctcacggcggtggcggggacgggcctgcgcgcctgctcgcatgctgggcggcaggaggcgctcgcccgcgcgctcgcggcatgcggtgctcgacgtgtgctgtctgcgaagcacaccctgcgcgctggtggtgcgacgccgcttggcgttcgtgctcgttggctgctcaaaggcgggaacataacccggtgctggaacaacaaggaaccgactttattgtttccaaaacgtaaacatgccttcccccgggaaaggggaaccccggggctccaagataaaaaat

SEQ ID NO: 72371 - protein, 132 aa, Zea mays
  misc_feature: Ceres CLONE 1555349
MAMTQPDSAAWPDPVLACLRGGGGPRLTASARPALTCLLTAVAGTGLRACSHAGRQEALARALAACGARRVLSAKHTLRAGGATPLGVRARWLLKGGNITRCWNNKEPTLLFPKRKHAFPRERGTPGLQDKK

SEQ ID NO: 72372 - DNA, 613 bp, Zea mays
  misc_feature: Ceres CLONE 1555355
  misc_feature: Encodes the peptide sequence at SEQ ID NO. 72373
  misc_feature (342)..(342): n is a, c, t, g, unknown, or other
  misc_feature (368)..(368): n is a, c, t, g, unknown, or other
  misc_feature (375)..(375): n is a, c, t, g, unknown, or other
caattgggtaccgggccccccctcgagccctgcagtggtaaaggctgcgatccaaacgcgcgacgcgacttattcagcaccaccgccgcctttcattttttccttcgcatcttgagagagagagagagagagagcggaggaggagagcaaggagatgggcggcttcgaccagcaggtgaaggagcggaccaaggagctgaagcacctcaagaccgcggcgatgaagggcatcaaggcggccggcgagtcgtgcaagaaggcgtgggagcaagggtcagggagcagcatcaagcgctaaaaggccctaggcgtttgtgctctgctgctgcgtgggtttctgangtgtggactggtgtagatttgccctngtggttnctgttggtggatctaccttattatttgggattccatctgggtgaaaaaaaaaaaaaaaaacccgaaccccttggaaatccctgcccccccgggggatcccccttttgtttttaaaaggggcgcccccccccccggggggggacccccccctttttttttcccccctttgggggaggggggttaattttttcgggggtttgggggggaaaaaaacaggggggcaaaaaagcgggttttt

SEQ ID NO: 72373 - protein, 47 aa, Zea mays
  misc_feature: Ceres CLONE 1555355
MGGFDQQVKERTKELKHLKTAAMKGIKAAGESCKKAWEQGSGSSIKR

SEQ ID NO: 72374 - DNA, 673 bp, Zea mays
  misc_feature: Ceres CLONE 1555356
  misc_feature: SWISSPROT Homolog: EC 1.11.1.6 Catalase
acgattgtgtaccgggccccccctcgagccctgcagtggtaaaggggaagagaagacggcgatggaggaggagatggagaagctgaggcggcagcaagcagaggccgcgcgcatggagaaggagaaggaacgggagaagagagctaagcagcagcaacaggttgctatgcccggcctgaagaagggtgcgacttatctgaggcccaagagaatgggtctgtagataagacctgatataacttaactgtctccggtgattttgttactaggctgagggaacttgtaatgtgtagcctgctcaagcagcatgtaaaacaacacgtcaatgtgaatgtatacaacatcgacatgtgaaaaaatgaaaagaaaaatagagtgttgtcgacatagagtttgattaaaaaaaaaaaaaaaaaaccagagctctgggaattcctgcagcccgggggatccactagttctagagcggccgccaccgcggtggagctccagcttttgttccctttagtgagggttaatttcgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactg

SEQ ID NO: 72375 - DNA, 588 bp, Zea mays
  misc_feature: Ceres CLONE 1555359
  misc_feature: Encodes the peptide sequence at SEQ ID NO. 72376
  misc_feature (222)..(222): n is a, c, t, g, unknown, or other
  misc_feature (223)..(223): n is a, c, t, g, unknown, or other
  misc_feature (317)..(317): n is a, c, t, g, unknown, or other
  misc_feature (337)..(337): n is a, c, t, g, unknown, or other
cgattgggtacgggcccccctcgagccctgcagtggtaaaggctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaagaaagagttctgctgcaatggtacagtggtccaggacccanngaacttggacaggtcattcagctcccagggtgatcagaaggagaacgtctcgaatttcccctcgtcagccggcattgtgaaagaagagcacatncagattcatggtttctgagncaccgccggggtcatagcaaaacaaccctgcatgcagggccagcttattattattatattctgaggtgaagctatctttctggttggtactacaagcagggctagtaagcccccctgccctttccttccttttaccaataaaaacaattagcccccctcccccgccgggattcccttttttcccccccgttgtcaaactttgaccaaaaaaggccccccaaaaccccgagggggtggtttttttttaaaaa

SEQ ID NO: 72376 - protein, 110 aa, Zea mays
  misc_feature: Ceres CLONE 1555359
  misc_feature (21)..(103): Pfam Name: SUI1 Pfam Description: Translation initiation factor SUI1
  misc_feature (74)..(74): Xaa is any aa, unknown, or other
  misc_feature (105)..(105): Xaa is any aa, unknown, or other
IGYGPPSSPAVVKAGDSGAAAGSKDYVHVRIQQRNGRKSLTTVQGLKKEFSYSKILKDLKKEFCCNGTVVQDPXNLDRSFSSQGDQKENVSNFPSSAGIVKEEHXQIHGF

SEQ ID NO: 72377 - DNA, 543 bp, Zea mays
  misc_feature: Ceres CLONE 1555360
  misc_feature: Encodes the peptide sequence at SEQ ID NO. 72378
  misc_feature (248)..(248): n is a, c, t, g, unknown, or other
  misc_feature (357)..(357): n is a, c, t, g, unknown, or other
  misc_feature (543)..(543): n is a, c, t, g, unknown, or other
tacgggcccccctcgagcactgcagtggtaaaggaagagcaccaaggaccttcggcgcccgttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaaggcaatgctggggactctggtgcagcagcanggtcaaaggactacgttcacgtgcgcatcccagcagcgttaatggtcgcaaagagcctgaccaccgtccaggattgaagaggagtcagctacagcagatcctcaaaatncaagaagagtctgctcgcatggtcaatggtccggaacaaaaactggaacagtccatcacctcccaggtgaatcaaagaaaaaacctctcaaattttccccttcccaccccgccttttttaaaaaaggggcccctccaaattttttggtttttttaaacaaacccccggggcccttattaaaaaaan

SEQ ID NO: 72378 - protein, 52 aa, Zea mays
  misc_feature: Ceres CLONE 1555360
  misc_feature (28)..(28): Xaa is any aa, unknown, or other
MSDLDIQIPTAFDPFAEGNAGDSGAAAXSKDYVHVRIPAALMVAKSLTTVQD

SEQ ID NO: 72379 - DNA, 651 bp, Zea mays
  misc_feature: Ceres CLONE 1555378
  misc_feature: Encodes the peptide sequence at SEQ ID NO. 72380
cgattgggtccgggccccccctcgagccactgcagtggtaaaggctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctaccgtggtggccttggacgcggctgctaccgctgatgcggacgccgtgatggcggctgctgctacggcggtggcgggcgcagctactgtggctgcggtggctaccgtggtgggtggttgcggctacggccgttggcaacctgggggggggttacggaaattccaacggtaacttaaggaacctgaccggggggggcccggcccggccaagtttcccggtttc

SEQ ID NO: 72380 - protein, 107 aa, Zea mays
  misc_feature: Ceres CLONE 1555378
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYRGGLGRGCYR

SEQ ID NO: 72381 - DNA, 660 bp, Zea mays
  misc_feature: Ceres CLONE 1555381
  misc_feature: Translation starting site: 169
  misc_feature: SWISSPROT Homolog: EC 1.11.1.15 Peroxiredoxin
ccgattgggtacgggccccccctcgagccctgcagtggtaaaggaggggccttttaaccccagcccggccctgcgagcgagaccaccccacccattcactcgcctgcgctccctcgccgccccagttccccaccccctgctcacccacccgtcccctcctgctcgcccatggctcccatcgctgtcggcgacgccctccccgacggccagctcgggtggttcgacgagaacgaccagctgcagcaggtctccgtccacgcgctcgccgccggcaagaaggtcatcctcttcggcgtccccggcgccttcaccccgacctgcagcaaccagcatgtgccaggcttcatcacacaggctgagcagctcaaagccaagggtgtagacgagatcctgcttatcagcgttaacgaccccttcgtcatgaaggcgtgggcgaagacctaccccgagaacaagcacgtgaagttcctcgccgacggatctggagcgtacaccaaggcgctcgacctcgagctcgatctcacggacaaagggctgggcgtgcgctcgaagaggttcgctctcctggccgacgacctcacggtcaccgtcgcaaacatcgaggaaggcgggcagttcacgatctccggcgctgaggagatcctgaaggcgctttagaag

SEQ ID NO: 72382 - DNA, 641 bp, Zea mays
  misc_feature: Ceres CLONE 1555403
  misc_feature: Encodes the peptide sequence at SEQ ID NO. 72383
ccgattgggtacgtggccccccctcgagccctgcagtggtaaaggaagaaataagacgacttgtttcattgattcttcaagagatcgagcttcttttgcaccacaaggtcgaggatgtcttgcagctgcggatcaagctgcggctgcggctcaagctgcaagtgcggcaagaagtaccctgacctggaggagacgagcaccgccgcgcagcccaccgtcgtcctcggggtggccccggagaagaaggccgcgcccgagttcgtcgaggccgcggcggagtccggcgaggccgcccacggctgcagctgcggtagcggctgcaagtgcgacccctgcaactgctgatcacatcgatcgacgaccatggatatgattattatctatctagcttgtggtggtggttgaacaataataagcgaggccgagctggctgccatacataggtattgtgtggtgtgtgtgtgacaaagagagaaacagaagtcttcagtttgctatctctctctgcatgtttggcgtccgtctttgtgctcatgtacgtgtgtctacatgcatgttgggtgatcccaattgcgtccggctgaaaccatatattatttgggcccacgaagaattgatttgaaacccttttatttatccca

SEQ ID NO: 72383 - protein, 76 aa, Zea mays
  misc_feature: Ceres CLONE 1555403
  misc_feature (1)..(76): Pfam Name: Metallothio_2 Pfam Description: Metallothionein
MSCSCGSSCGCGSSCKCGKKYPDLEETSTAAQPTVVLGVAPEKKAAPEFVEAAAESGEAAHGCSCGSGCKCDPCNC

SEQ ID NO: 72384 - DNA, 693 bp, Zea mays
  misc_feature: Ceres CLONE 1555404
  misc_feature: Encodes the peptide sequence at SEQ ID NO. 72385
  misc_feature (312)..(312): n is a, c, t, g, unknown, or other
  misc_feature (313)..(313): n is a, c, t, g, unknown, or other
  misc_feature (352)..(352): n is a, c, t, g, unknown, or other
  misc_feature (378)..(378): n is a, c, t, g, unknown, or other
cgattgggtaccgggccccccctcgagcactgcagtggtaaagggtagaccatggagcacgcgtccgccttcctcgcgcgcgcgctcaccactccgctcccggcacccgccgccctcccgcggcgccgcccggctcgcgtggccgtcgccgccgcggcgccggagcgcaggccgccgggcgcggtggcgtccaccaccaactacgtcgtgccgctcgacgcggcgccgtccgggatcacgcgcccgctcgtcgagatcctccgcgacctcaacagcgcgtcccggacgccatcgtgcggcccctctccgggnngcgctcgactcgaccccgtcatcccctggtaccatgccnataggatgctcagcttttatgctcangttggtgtggggaagttcgtgatgttaattacactgaacgtggaaggtgacggtcatttaccccggacttgtgcccgaacaaattgaaagggttccaggggagggtggtggaaaacctcccttaaacataaaccggttcaaaaccccctttttttgggaaaaaaaagcatctttttgaaaaacctcgcggaaggggggttttcggcccttctcctgtcccttggaaaaaaaaacccctttaaaaaaaaaatttttttttccccatttttttttccgcggcgggggttttttttcaaaaaaaaaaaaggagggggg

SEQ ID NO: 72385 - protein, 137 aa, Zea mays
  misc_feature: Ceres CLONE 1555404
  misc_feature (88)..(88): Xaa is any aa, unknown, or other
  misc_feature (101)..(101): Xaa is any aa, unknown, or other
  misc_feature (109)..(109): Xaa is any aa, unknown, or other
MEHASAFLARALTTPLPAPAALPRRRPARVAVAAAAPERRPPGAVASTTNYVVPLDAAPSGITRPLVEILRDLNSASRTPSCGPSPGXARLDPVIPWYHAXRMLSFYAXVGVGKFVMLITLNVEGDGHLPRTCARTN

SEQ ID NO: 72386 - DNA, 696 bp, Zea mays
  misc_feature: Ceres CLONE 1555407
  misc_feature: Translation starting site: 352
ccgattgggtaccgggccccccctcgagccctgcagtggtaaaggggacgtgagttatcttctccatcgattgcttcctcggtctaggttggaaagcgcctcccagatctccggtaagtagcggagacctccccagctccggagcagcgacgtggaggctcgtggatccattagtcgttttctgtgcagccgccgaagaccactccatggaagggctgagctggacaacggcgtgttgttcatctgtgctatgtgcctcgatgttcttacgcccaggcgacggcatccccttctcgatccactcgcaacagagcttgtcacacaaaacgcaatacaagggggatactgtccatgtctgcatcgccgtcatataagcttacaccacgtcgaattacaccgaggacggcgacgatcttgcggttaaggactgtggtggccctcaaggccgtgattaccgagataacactagccacaatggcgagttcatacttcagaagagaggcgtgcttcgcttctgcttcacgaacaagtccccatatcacgcaaacaatggacttcgatgttcatgttgggcttctgtcacttctacagcaacttgacgaagatgaccatgttgcaccacctttcgagctatcctgctagctggatgaagctcttcactatatccaattcgaacaccactggctagacgcccat

SEQ ID NO: 72387 - DNA, 664 bp, Zea mays
  misc_feature: Ceres CLONE 1555424
  misc_feature: Encodes the peptide sequence at SEQ ID NO. 72388
tggagctccccgcggtggcggccgctctagaactagtggatcccccgggctgcaggaattcgtctcacccctagaaaaaaccaccagttccttgttcggtcggaacgcagcgcagcggcggcggcgatagggagagaggagagagtctgcaggatccagcaggccgagggaggagtcagcggcgggccggagaatatgagcggcaacggcgcgaagaaggtggtcgatgcggcggtgaaggccggcaggacgatcatcgactgggacggcatggccaagttgctcgtcaccgacgaggcgcgcaaggagttcgccgccctccgccgcgctttcgatgacgtcaaccaccagctccagaccaagttctcccacgaaccccagccgattgattgggagtactacagaaaaggaattggatcaaaagtggtggatatgtacaaagagggcttttgaagcatcgagatcccgaagtacgtcgacacagttactccccagtacaagccaaagtttgatgctgtgattgctgaattaaagggagctgagaaagagcatcaaaaggagtcagaaagggtagagaaggaacttgcttgaaatggaggaaatgaggaaaaagatcggtacattgacggcaaatgattacctttggagaagacccctggactcc

SEQ ID NO: 72388 - protein, 85 aa, Zea mays
  misc_feature: Ceres CLONE 1555424
MSGNGAKKVVDAAVKAGRTIIDWDGMAKLLVTDEARKEFAALRRAFDDVNHQLQTKFSHEPQPIDWEYYRKGIGSKVVDMYKEGF

SEQ ID NO: 72389 - DNA, 620 bp, Zea mays
  misc_feature: Ceres CLONE 1555429
  misc_feature: Encodes the peptide sequence at SEQ ID NO. 72390
  misc_feature (620)..(620): n is a, c, t, g, unknown, or other
tggcggccgctctagaactagtggatcccccgggctgcaggaattcgtctcacccctagaaaaagtcactcttaccgccagccccacatcacggagcatcccccttaataacagcaaactaccacacccatgtccacctccgtctccgccgccgccgttgccgctctcgtcccacccctcaccggccgccggtcgccgccggcatctcgcgtaccgcagatttgccgcagaagaatcagatccaaaccccgtatcttctcttcttccccctccttccccattgtccccgccgctgccatggccaccggcggcgccgcccccaccgcctccgatgccgggtccaagaagaagttgctcatcttcgactccgaggaggatctcgcggtttctcttgcgaagtacactgcggagctgtcggaaaagttcgcgggccgaaaaggggtgcctttcaccgcccgtgctctcttggcggaatccctcatcgaaggacctcaagaaaactgaacggaacccgcccttaccctggaatttcagggggaattggaaacaaggggggcaccgttctttctgggggtggaattgaaaaagggtccgtggccccaaagggaaccattggtggn

SEQ ID NO: 72390 - protein, 124 aa, Zea mays
  misc_feature: Ceres CLONE 1555429
MSTSVSAAAVAALVPPLTGRRSPPASRVPQICRRRIRSKPRIFSSSPSFPIVPAAAMATGGAAPTASDAGSKKKLLIFDSEEDLAVSLAKYTAELSEKFAGRKGVPFTARALLAESLIEGPQEN

SEQ ID NO: 72391 - DNA, 634 bp, Zea mays
  misc_feature: Ceres CLONE 1555433
  misc_feature: Encodes the peptide sequence at SEQ ID NO. 72392
ccccgcggtggcggccgctctagaactagtggatcccccgggctgcaggaattcgtctcacccctagaaaaattgcagtagtcgcagctgacggacgactgaaccaccgacagacaacatggccgcctccgcctccaccgtctccggcctcgccggcgcctccctggccagccgcccggcgttctccaccagcttcacgcggggcagccgggtgtcggcgaggaaccccctgatgagcaggaacctggagaggaatggcaggatcacctgcatgacgtgagttgactgagctttttattacgagctttctgtgaaatactagtatagtctctgctgatcctccgtacgcgctcgatcgccaggtttccccgggactggctgcggagggacctgagcgtcatcggcttcgggctcatcggctggatggggccgtccagcgtcccggccatcaacggcaacagcctcacggggctcttcttctccagcatcggccaggagctggcccacttccccacgcccccgcccgtcacctcccagtttctgtgagtacgtgtgtgtacctctcgatccgggcatatgcatggcatcgggacgcgtcctggcgtggcggccttccctggtggaattccttctt

SEQ ID NO: 72392 - protein, 53 aa, Zea mays
  misc_feature: Ceres CLONE 1555433
MAASASTVSGLAGASLASRPAFSTSFTRGSRVSARNPLMSRNLERNGRITCMT

SEQ ID NO: 72393 - DNA, 656 bp, Zea mays
  misc_feature: Ceres CLONE 1555436
  misc_feature: Encodes the peptide sequence at SEQ ID NO. 72394
  misc_feature (574)..(574): n is a, c, t, g, unknown, or other
  misc_feature (656)..(656): n is a, c, t, g, unknown, or other
tccccgcggtggcggccgctctagaactagtggatcccccgggctgcaggaattcgtctcacccctagaaaaaagcagccagcttccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatccaccggcagccggcccgtgctggagccgtcctcgtcgtcacctgcaggcggagctcctccgcgaccgtccgcgccgcagccgctgccacggcggcggcgccggctgccgtagagctgcagaacaagggggtgtcgctgccgacgtgggcggagttcgagctcgggcgggcgccggtctactggaagaccagcagcggcctcccgccctcgctgggcgaggggctgaccctgttctactacccggcggcgacgaagatggccccgaacgagttgttcggcgtggcgtttcacggcggcttcaaccagccatcatgtgcngcggaaagcgaagcagatgacgctgcaggagcggggcaaagccgactcgcccatctaccccatcaggatacgcgtgccgcan

SEQ ID NO: 72394 - protein, 152 aa, Zea mays
  misc_feature: Ceres CLONE 1555436
MATLSSCSRLSSGTGAAAIHRQPARAGAVLVVTCRRSSSATVRAAAAATAAAPAAVELQNKGVSLPTWAEFELGRAPVYWKTSSGLPPSLGEGLTLFYYPAATKMAPNELFGVAFHGGFNQPSCAAESEADDAAGAGQSRLAHLPHQDTRAA

SEQ ID NO: 72395 - DNA, 634 bp, Zea mays
  misc_feature: Ceres CLONE 1555438
  misc_feature: Translation starting site: 203
  misc_feature: SWISSPROT Homolog: EC 2.1.1.43 Histone-lysine N-methyltransferase
ggcggccgctctagaactagtggatcccccgggctgcaggaattcgtctcacccctagaaaaatgtatctggtgggtatgaggatgatgatgatcacggcgatgtacttgtgtacactgggcatggcggccgtgatcccaacctccacaagcattgcgtcgatcagaagctggagggcggcaatcttgccctcgagcgcagcatggcttatggtattgagattcgtgtaatccgtgctgtcaagtcaagacgaagccctgttggtaaggtttacttctacgatggcctctacaaggttgttgactactggctcgaccgtgggaaatctgggtttggtgtttataagtatagactgctgcggattgagggccaagaaacccatgggtagtgtgaattatcgagtagctgaacagcttaaggtggatgtgtttgctataaggccaacagggtatttgagctttgatatctccatgggccgtgataccttgtcagttgcactcttcaatgatgtggatgatgatcaggacccactcctatttcgatatctggcacgtccaatatttcctacctctgctgtccaggggaagtttgctgaaagtgggggggggggttgtgattgtgctgagaattgccc

SEQ ID NO: 72396 - DNA, 653 bp, Zea mays
  misc_feature: Ceres CLONE 1555440
  misc_feature: Encodes the peptide sequence at SEQ ID NO. 72397
  misc_feature (401)..(401): n is a, c, t, g, unknown, or other
agctccccgcggtggcggccgctctagaactagtggatcccccgggctgcaggaattcgtctcacccctagaaaaagccaagatccagcaaaccagagttctccaaagcgcgaagctccagctcaagctccaggcaaccgtcaccgtcagggaacgcgcgcgcagcaatggccttttactacggcgtgggcggacagtcgtcggcgtgggcggcgccgggcggcagcaggccatggaccaaggcggaggacaaggtgttcgagggcgcgctggtgatgttcccggagcacttgccgaaccggtgggcgctggtggcgtcccggctgtacgaccgcacgccgcaggaggcctgggaccacccccccgcgctggtgagggacgtcgacctcatcaagcgcggnatggtggaggccccggaatcctgggacaacaaccccggccccgccggaaggggaccctcgggccgcggccgcgggggcggcaacggcatcccccatccaaaaaaaacccccccccccgggtggccctgggacccaggaaccaaaccccgcctgttttctggaagagagcttgacaaaaaaaagggcgcgggctatacgcccggaaaccttttccccgccttgccaggtgtaaataaacagaaatcccccccc

SEQ ID NO: 72397 - protein, 162 aa, Zea mays
  misc_feature: Ceres CLONE 1555440
MAFYYGVGGQSSAWAAPGGSRPWTKAEDKVFEGALVMFPEHLPNRWALVASRLYDRTPQEAWDHPPALVRDVDLIKRGMVEAPESWDNNPGPAGRGPSGRGRGGGNGIPHPKKTPPPGWPWDPGTKPRLFSGRELDKKKGAGYTPGNLFPALPGVNKQKSPP

SEQ ID NO: 72398 - DNA, 658 bp, Zea mays
  misc_feature: Ceres CLONE 1555444
  misc_feature: Encodes the peptide sequence at SEQ ID NO. 72399
  misc_feature (387)..(387): n is a, c, t, g, unknown, or other
acccgcggtggcggccgctctagaactagtggatcccccgggctgcaggaattcgtctcacccctagaaaaaaattgttgaagcagccacttcaccttggggccatacagaaatggcggcttcttgcgcctccacactccctccactttccttcgtttcctcctccagttcaccccgccgattcaggcgctctggtgtggtggccatggccagcgttgggcagaaggtgtatgcgcccggtgtggcggtgtcggagggcaatggcgggctgccgaaaatcgacctcaaatccccgcacgggagcgaggctgatatttatctgtttggagcgtgtgttacttctttcaaagtcccccccgcccaagagcgggggcggtggtcaaccanatgctgtgttttatggacagaaacccatcagcggggggatttcccctttgtttcccccagttttggcccaagtcccaatgcaaaaacaatgggttttgccccggaatgggaatttggtctatcccacaattccaaagtcccccaaaagagaatcccgcttgtaacttttggaacatgaaaaaatgaacctttttgcccgtctttatggggggaaattcacctttcccaggccccgggaaaagggtttccccggcctcctcaaaacatgtgg

SEQ ID NO: 72399 - protein, 150 aa, Zea mays
  misc_feature: Ceres CLONE 1555444
  misc_feature (92)..(92): Xaa is any aa, unknown, or other
MAASCASTLPPLSFVSSSSSPRRFRRSGVVAMASVGQKVYAPGVAVSEGNGGLPKIDLKSPHGSEADIYLFGACVTSFKVPPAQERGRWSTXCCVLWTETHQRGDFPFVSPSFGPSPNAKTMGFAPEWEFGLSHNSKVPQKRIPLVTFGT

SEQ ID NO: 72400 - DNA, 685 bp, Zea mays
  misc_feature: Ceres CLONE 1555447
  misc_feature: Encodes the peptide sequence at SEQ ID NO. 72401
  misc_feature (685)..(685): n is a, c, t, g, unknown, or other
ggagctccccgcggtggcggccgctctagaactagtggatcccccgggctgcaggaattcgtctcacccctagaaaaagcccgcactaccacgcgaccacgcccccgctcctctcgtctctttcttcgcctcttccatgcgcaggattcggcggccatgggcggcggcaacggccacaagtccaagatggagcgcgagaggaacgccgataagaacaagggcggcaaaagcagccagctggaggccaacaagaacgccatgaacatccagagcaagatctgcatgcagaccttcagctgcaccacctccgaggccgagtgcaaagaacatgcggaggcgacgcatcccaagaatgacttctacccccgcttcccccggggggggggatgagtaagcggccaactcatatgatctgctcagctgacagacaagtgctacatagatgtttccaccgcggcggggaaactaaggggtttgacgctgcagaagatgccccctgccttcttccaagatgccccgcctgaaatatgtactggtaacccctctggagcgcaaagtaatagtgctaaaaaacccctggcttgccggggggaatacatgccccccccaaaacgaaacaccaaaaaaataccaaatgcctgggaccccccccaaaaaacacgagggcggaccctctccgcccttn

SEQ ID NO: 72401 - protein, 77 aa, Zea mays
  misc_feature: Ceres CLONE 1555447
  misc_feature (4)..(73): Pfam Name: DUF1909 Pfam Description: Domain of unknown function (DUF1909)
MGGGNGHKSKMERERNADKNKGGKSSQLEANKNAMNIQSKICMQTFSCTTSEAECKEHAEATHPKNDFYPRFPRGGG

SEQ ID NO: 72402 - DNA, 816 bp, Zea mays
  misc_feature: Ceres CLONE 1555457
  misc_feature: Encodes the peptide sequence at SEQ ID NO. 72403
  misc_feature (1)..(1): n is a, c, t, g, unknown, or other
  misc_feature (27)..(27): n is a, c, t, g, unknown, or other
  misc_feature (28)..(28): n is a, c, t, g, unknown, or other
  misc_feature (31)..(31): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
naattttatttttcctctttttttttnnaanannnnnattttnnnnnntaactcatggactccccgcggtggcggccgctctagactagtggatcccccgggctgcaggaattcgtctcacccctagaaaaacccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggttcgccgttccgccttgagctgtttacgccgcggatggtgggaatactggctgatttttttggttatgtttttgggatcttgggcttgggttactaacaaggaaggaaacctgggttaattcttgctgggcgggttggtttccccccccccccctcggggggggggggacccctttgcccctctccacttacccaaaaaattttttttgaaggagaatataccccatggtcctacccactaaataccttcttggggcattttaaatttttttctcggcccccgcgatattcttcattcccatagaacaacgggggcctttttttgtgttggcgaatttttggaccgtgtttcttttcttcccctcttttttgcgggagacctattccaaggttctgtcgacattttaccccccctccaccccgcgcgtttaccctcgcgtcgcgcgctcccctcattgacccctcaacaaacacttatatctctccccatctcataaatcgccgctactcagggccctccatgggatgtcttattccatcc

SEQ ID NO: 72403 - protein, 64 aa, Zea mays
  misc_feature: Ceres CLONE 1555457
MAAQGSLVMWRAVFAALGLLMVATLVYTLATDGSPFRLELFTPRMVGILADFFGYVFGILGLGY

SEQ ID NO: 72404 - DNA, 638 bp, Zea mays
  misc_feature: Ceres CLONE 1555458
  misc_feature: Encodes the peptide sequence at SEQ ID NO. 72405
agtggatcccccgggctgcaggaattcgtctcacccctagaaaaaaggacgacccaagcaagcaagcaagcagcgagtacatacatactaggcagccaggcagccatggcgcccaccgtgatgatggcctcgtcggccaccgccgtcgctccgttccaggggctcaagtccaccgccagcctccccatcgcccgccgctcctccagaagcctcggcaacgtcagcaacggcggaaggatccggtgcatgcaggtgtggccggcctacggcaacaagaagttcgagacgctgtcgtacctgccgccgctgtcgacggacgacctgctgaagcaggtggactacctgctgcgcaacggctggatatcctgcctcgagttaagcaaggtcggcttcgggtaccgcgagaattccacctccccgtgctactacgacgggcgctactggaccatgtggaaactgcccatgtttggcttgcaacgacgccacccagggggtacaaggaagctgcaggaaggccttcaaaatcctaacccggacgcccttccaccggggtaattgggtgttgccccccccccccaaccaaaaaccaaggggggccaaacttttaattggcctaaaaaaggccccccggggcaggc

SEQ ID NO: 72405 - protein, 149 aa, Zea mays
  misc_feature: Ceres CLONE 1555458
  misc_feature (58)..(141): Pfam Name: RuBisCO_small Pfam Description: Ribulose bisphosphate carboxylase, small chain
  misc_feature: SWISSPROT Homolog: EC 4.1.1.39 Ribulose-bisphosphate carboxylase
MAPTVMMASSATAVAPFQGLKSTASLPIARRSSRSLGNVSNGGRIRCMQVWPAYGNKKFETLSYLPPLSTDDLLKQVDYLLRNGWISCLELSKVGFGYRENSTSPCYYDGRYWTMWKLPMFGLQRRHPGGTRKLQEGLQNPNPDALPPG

SEQ ID NO: 72406 - DNA, 633 bp, Zea mays
  misc_feature: Ceres CLONE 1555461
  misc_feature: Encodes the peptide sequence at SEQ ID NO. 72407
  misc_feature (524)..(524): n is a, c, t, g, unknown, or other
ggtggcggccgctctataactagtggatcccccgggctgcaggaattcgtctcacccctagaaaaaaacccaacacggcgtccccgtcccgagtcaccaccgacccaagcaaaaccgcacgcaccctgccagcggccccccaactcccaacccaacccctactccagctagctcgcggcggcggccagcggccatggccttccggctgagcaacaacctgatcggggtcctaaacttcgtcaccttcctgctctccgtcccgatcctgggcgcgggcatctggctgggccaccgcgccgacggcaccgagtgcgagcgctacctctcggcgcccgtcatcgcgctgggggccttcctcctcgccgtctccctggcgggcctcgtcggcgcctgctgccgcgtcacctggctgctctgggcctacctcctcgccatgttcgtcctcatcctcgtcctcttctgcttcaccgtcttcgccttcgtcgtcaccaacaggggcgccggcgaagccgtctccggccgcngatacaaggagtaccgcctcggggactactccaactggctgcaaaagcgcgtcaaaaacacaagaaactggaccgggatcagagctgccctcaggactcaaggtctgga

SEQ ID NO: 72407 - protein, 146 aa, Zea mays
  misc_feature: Ceres CLONE 1555461
  misc_feature (5)..(144): Pfam Name: Tetraspannin Pfam Description: Tetraspanin family
  misc_feature (111)..(111): Xaa is any aa, unknown, or other
MAFRLSNNLIGVLNFVTFLLSVPILGAGIWLGHRADGTECERYLSAPVIALGAFLLAVSLAGLVGACCRVTWLLWAYLLAMFVLILVLFCFTVFAFVVTNRGAGEAVSGRXYKEYRLGDYSNWLQKRVKNTRNWTGIRAALRTQGL

SEQ ID NO: 72408 - DNA, 649 bp, Zea mays
  misc_feature: Ceres CLONE 1555466
ggagctccccgcggtggcggccgctctagaactagtggatcccccgggctgcaggaattcgtctcacccctagaaaaagagagaaggaggacaaggacgacaagtggcaccgcgtcgagcgcagcagtggccagttcgtcaggcgcttccgcctgccggagaacgccaaggtggatcaggtgaaggctggccttgagaatggcgtgctcacggtcaccgtgcccaaggcggaggagaagaagcctgaggtgaaggctattgagatatctggttgagcatccaatccaatatggacgtggaaggaaggtgtactgctgctgctggtccgtggctgtcgctgtcttgtgggatgtttcctgtgtcttctaccatatataacggacttctgtttgtttcctttcctatgtacaatcttccgggtattgttcatgtatccctttgaataataacaaataaaatcgagttttcacggtaaaaaaaaaaaaaaaaaaaaaaaacccccccaggaatttctcaaagcccctagcaaaagcatacttcccccaacccctcttgcaatccactggagttctgttttgttgagacccctaaaagcttgcttgctaacgctcaaaaatggcccttcgggaggcgcaaccaaccggtttcc

SEQ ID NO: 72409 - DNA, 822 bp, Zea mays
  misc_feature: Ceres CLONE 1555473
  misc_feature (20)..(20): n is a, c, t, g, unknown, or other
  misc_feature (28)..(28): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (471)..(471): n is a, c, t, g, unknown, or other
ttcccccctaatccccgatnttataganaaaannnnnnnnnnngtttatnnnnaaaaaacaacatcccccccccgtccgccgctctaaactaatggatcccccgggctgcaggaaatcatctcacccctcaaaaaaagttaaagcgacgccgccgcccctagccgtccgccttgcccttcacgaaggcttggtcctcctccttgtatctccatctccccccttcagagatccgttcctccagctagggttagcgttcctctgcagcgatggcgatcaagcggaccaacgcggataaaaatatctcgtactacaagaagctgtgcagtctgctcgatgagtatttcaaggtgcggaagagcctcgcccgacaacgttttttttatttagctcccttaaatctttttagggtcttttttttttaccccccccccaggagggaagaagggggaaacattccattcccccccttncataaatgttggatacgcccaaaaaaaaaaaaaatagacctttatccctttttaaccccttttaacaggcaaccctcctgacctccacacaatctctacggcattattccccatccaaacaaccgagaataatccaccaccagaaataacgcgcaccacgcttttttttcacccggtgtcacaagctgtccgtcccctactttctctttcccttttcactcgtctttctcctctttccatgaaatatcatattaccctacctatcacatcatatacaccccactataaacaatattcgacaataacaaataatcttttcacaaaccatcatatttcaacgtaacaacaaag

SEQ ID NO: 72410 - DNA, 837 bp, Zea mays
  misc_feature: Ceres CLONE 1555479
  misc_feature: Encodes the peptide sequence at SEQ ID NO. 72411
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (19)..(19): n is a, c, t, g, unknown, or other
  misc_feature (27)..(27): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (429)..(429): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
nccgtnntttccggcactntttttttnaaaaannnnnnnnggcccaannnagttcaaggtattccaccgcgtggcggccgctctataatagtggatcccccgggctgcaggaattcctctcacccctagaaaaatccactactttactcaaagtctagagctagctttttgctttgctcaccagacaaaccgcagcagatggcgtctacgatcatgggcgccacctcccgcatcgtcgcggccaagacaccgtttcttggccagggtcgcgcccccgccgccgccgccaatgacagccccctccgcgacgtcgccgccgccgcctgctggcggcctgatccccatggggaaaggacctgtggtacggccccgtattcttttcaagaaacttgggtatatttctccgcccaatatttttttcccaacttnccccgggggaatgccaggggggaaatttnnnctttttacaccttttccttttttttctcttctaaaccccaaaaaaaaactcataacctcaacccacggtgggggggggaaaccgcaatccaccaagacatccacgagaccgaatgaatcagcgttaatatatataggtctgctgtctcctcctcctaacggtaaataatcaacaatagtaccctgttcacttaatgcactacttttaccctaacctactattttttacctctactaccacgcccaaccctccgccgcaaaatcacctcatgaggggccgcattcaacaaacatacaacaatagagaagtaacccaaccccaatagtcgctcttgaccgtccccccacactagcctcccgcgccgcttctccatcttc

SEQ ID NO: 72411 - protein, 125 aa, Zea mays
  misc_feature: Ceres CLONE 1555479
  misc_feature (77)..(77): Xaa is any aa, unknown, or other
  misc_feature (87)..(87): Xaa is any aa, unknown, or other
  misc_feature (88)..(88): Xaa is any aa, unknown, or other
MASTIMGATSRIVAAKTPFLGQGRAPAAAANDSPLRDVAAAACWRPDPHGERTCGTAPYSFQETWVYFSAQYFFPNXPRGNARGEIXXFYTFSFFFSSKPQKKTHNLNPRWGGETAIHQDIHETE

SEQ ID NO: 72412 - DNA, 672 bp, Zea mays
  misc_feature: Ceres CLONE 1555484
  misc_feature: Encodes the peptide sequence at SEQ ID NO. 72413
cgattgggtacgggccccccctcgagccactgcagtggtaaaggcgagtgacaaggagctcgaccgtttcttctgcaagcaagcaaagatggccactgcgagagggatagccgccatggcgatgttcttcctggtcgcgctctccgcctcccacacggcgtcctccctccgccccggcgccggcctcggcacgtgccgcgccagcggatacctcccgggccgctccggcaactgcgagaagagcaacgacccggactgctgcgaggacggcaagatgtacccgcagtaccgctgctcgccgccggtgacggcgagcaccaaggccgtgctgacgctgaacagcttcgagaagggcaaggacggcggcggcccctcggagtgcgacaacgcgtaccacagcgactcggagaaggtggtggcgctctccacggggtggttcagcaacatggcgcgctgcgggcaccgaatcaagatcagcgccaacggcaactccgtgtacgccaaggtggtggacgagtgcgactccgtgcacggctgcgacgacgagcacaactttgagccgccgtgcgacaacaacatcgtcgatgcctcgccggcggtttggaacgccctgggactcgaccagaacgtcgggatggtggacatcacctggtctgaggagtgagaggcagt

SEQ ID NO: 72413 - protein, 191 aa, Zea mays
  misc_feature: Ceres CLONE 1555484
MATARGIAAMAMFFLVALSASHTASSLRPGAGLGTCRASGYLPGRSGNCEKSNDPDCCEDGKMYPQYRCSPPVTASTKAVLTLNSFEKGKDGGGPSECDNAYHSDSEKVVALSTGWFSNMARCGHRIKISANGNSVYAKVVDECDSVHGCDDEHNFEPPCDNNIVDASPAVWNALGLDQNVGMVDITWSEE

SEQ ID NO: 72414 - DNA, 967 bp, Zea mays
  misc_feature: Ceres CLONE 1555487
  misc_feature: Encodes the peptide sequence at SEQ ID NO. 72415
  misc_feature (14)..(14): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (521)..(521): n is a, c, t, g, unknown, or other
  misc_feature (601)..(601): n is a, c, t, g, unknown, or other
  misc_feature (669)..(669): n is a, c, t, g, unknown, or other
  misc_feature (683)..(683): n is a, c, t, g, unknown, or other
  misc_feature (738)..(738): n is a, c, t, g, unknown, or other
  misc_feature (967)..(967): n is a, c, t, g, unknown, or other
ttttgtttttgccnccctcattcacaaaataataaccccgctgtttcctctttttttggtcttttattttttttttttttttttnnnncccaattgggtactggcgcgccctctagctctgttattgtaaaacgtgcctgtagccgcgcccatctcgccgacgcccagccggcgctggccgacccggaggagccggacaacaacgcctccgggaacgggaaggagcacgagaagatcgagttccctgacctcaatctcgtggaggagaaccggatcatggtctccgagttctccaggttggcgtgctcggccgtggaaacgcagagctccgagagcctcctcacctcggagcacggggacggcgccccgaccctgggacacgacaccggcgtccgcctcgtgaagagcttctctacggacatacagacccccgactcggtgagcacctttcccgagccacccccccggtgtggaagtgtgtccatctacagaatatttgcgcccccccccccggcccccanttacccgggcccatccccttcctgtcccaaacttttcaaccctccgaaaaccccgtcccttggggaaaacggcccccaancgtcgagtacgctgcctttgaacccggcccacaagggagaagtaatatcccaccgcgccgattttttngtagaagtaacggnataccgcggaactttcccagtgaatggagttgcgttctctttgggtgttgcctcnctcttaacccgggcctctccaaaataaatgttcccccccggtgctgtggccgctaaccttctcgacccccagaacagtcctcgccatatcctggggaatggcccagtcccctccgtaaaaacaaaaatcctgggtcgttctctcattgctcggcgtatcacccttcctggcccgtgagaaagaccgaaatacgatgcccccccgtcccaacccgcgagcctccaggggn

SEQ ID NO: 72415 - protein, 254 aa, Zea mays
  misc_feature: Ceres CLONE 1555487
  misc_feature (5)..(5): Xaa is any aa, unknown, or other
  misc_feature (29)..(29): Xaa is any aa, unknown, or other
  misc_feature (30)..(30): Xaa is any aa, unknown, or other
  misc_feature (174)..(174): Xaa is any aa, unknown, or other
  misc_feature (201)..(201): Xaa is any aa, unknown, or other
  misc_feature (223)..(223): Xaa is any aa, unknown, or other
  misc_feature (228)..(228): Xaa is any aa, unknown, or other
FCFCXPHSQNNNPAVSSFFGLLFFFFFFXXQLGTGAPSSSVIVKRACSRAHLADAQPALADPEEPDNNASGNGKEHEKIEFPDLNLVEENRIMVSEFSRLACSAVETQSSESLLTSEHGDGAPTLGHDTGVRLVKSFSTDIQTPDSVSTFPEPPPRCGSVSIYRIFAPPPPAPXYPGPSPSCPKLFNPPKTPSLGENGPQXSSTLPLNPAHKGEVISHRADFXVEVTXYRGTFPVNGVAFSLGVASLLTRASPK

SEQ ID NO: 72416 - DNA, 618 bp, Zea mays
  misc_feature: Ceres CLONE 1555490
  misc_feature: Encodes the peptide sequence at SEQ ID NO. 72417
  misc_feature (331)..(331): n is a, c, t, g, unknown, or other
cgattgggtaccgggccccccctcgagccactgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtcctagattatcctcgatcgggagacgcagaggtcccgcggcttcggcttcgtcacgtgctacacggcagaggcgatgcngaacgccatcgatggcatcgacggcaatgtagctggacggctcgcacatcatcgtctacgaggcccattccccccgctgccaatgaagcggcggcggcagctacgttggtgacatgaaggctggcggttacggcggtggccggcctccctattggcggcgggtgattacgggagttggcggcgggcgctactgtgggcggccgtgggctaccgtggggggggggggcgggttcccgggggggggaaccctggggggggggtaccgggaaacccccaagggggacggg

SEQ ID NO: 72417 - protein, 37 aa, Zea mays
  misc_feature: Ceres CLONE 1555490
MAASDVEYRCFVGGLAWATDDHSLHNAFSTYGEVLES

SEQ ID NO: 72418 - DNA, 556 bp, Zea mays
  misc_feature: Ceres CLONE 1555491
  misc_feature (484)..(484): n is a, c, t, g, unknown, or other
cgattgggtaccgggccccccctcgagccactgcagtggtaaagggaaggcagtggtgccacctcaactgctcgaatcagcaggtgtgggaatctgggcagggcgccgcggagaagaggaggcccagcgctctacgtccgccatggcgggctcttccgaccccgacaagctcatgaacaaagccgacaaactgtaattaggcttgcacggaagctaccaacaggtgatctgcaggccatcaagaaagctgacgatggcgaggaatccttggacgaggatgaacctgacttaaacgatctccgagccaaagtgcagagacaacgtcatagttgccatcgtggggaacatctgtaaaagaagtatgcgagtacgtactaaaactgtgggcacatcccattctataacatgaaattgtagggcccattatgttgatccgtaccggggggttggcaatggggggtaccgaaacagcaaaccttaaggnatggttatgggggcccgggcccaaggaatcttgcaaaacgacatgggggaaaaaattaaattttggcccaac

SEQ ID NO: 72419 - DNA, 667 bp, Zea mays
  misc_feature: Ceres CLONE 1555495
  misc_feature: Encodes the peptide sequence at SEQ ID NO. 72420
cgattgggtaccgggccccccctcgagccactgcagtggtaaaggtttccctcttccctcacttcccaaacccaaccggcggcgcagcatcgccaccaccgtccaaagatggtgaagttcctcaagcccggcaaggccgttatcctcctccagggccggttcgccggccggaaggctgtgatcgtgcgcgttttcgaggagggcacccgtgatcgtccctacgggcactgcctcgtcgcgggcctcgctaagtaccccaagaaggtgatccgcaaggactccgccaagaagacggccaagaagtcccgcgtcaagtgtttcatcaagctcgtcaacttcacgcacctaatgcccacccgctacaccctcgacgtcgacttcaaggacgtcgcatcgggcgggcccgacgcgctctccacccgggacaagaaggtcgaagcctgcaaggccgccaaggcgcgcctcgaggagaggttcaagaccggcaagaacaggtggttctttaccaagctccgcttctagatgtcgggcgtccctcatagtgtctgatctagttgtcaatttcttgtacctgaaaccctttaaggtatctctgttttgctatttccatgaaggcttcgtgcttggtatggatcttggagaggattttgttaaaaacatgtcgatg

SEQ ID NO: 72420 - protein, 137 aa, Zea mays; identical to SEQ ID NO: 5495
  misc_feature: Ceres CLONE 1555495
  misc_feature (52)..(137): Pfam Name: Ribosomal_L27e Pfam Description: Ribosomal L27e protein family
  misc_feature (7)..(40): Pfam Name: KOW Pfam Description: KOW motif

SEQ ID NO: 72421 - DNA, 652 bp, Zea mays
  misc_feature: Ceres CLONE 1555496
  misc_feature: Encodes the peptide sequence at SEQ ID NO. 72422
cgattgggtccgggcccccctcgagccctgcagtgtatcgctttgcctggcttggatgcctgatcttcagcgcactcttcttttgtggaaagaggttccatgtctggttcaccaacctccacaactccatcagggatgaccgctatctgattggccgaaggctgcacaactttggtgaggacacacccgagccgagtgaatctggagcaactatagggtcagatgatcaggaccaagctcttgtcctgcgagatcaggaagaggaagtggggttgaggatgaggcgcaataatatgcgtgcaaaccaacaacccaggctggctttttaaggaggagatagttttggatatagagctcataaccatggtataagctttggcctgcagcttctgcttgtgctttgtaatgggagttgtagagggggtttatgtggttgcgataggaaagagtctaaggactgttctacgacaagcctgggagaaagctaaagtggttagtgattataagaactggtggcaactccctttcctgtggtagtcttggctgactgtaaatatcgtttgacagacactaccaggccaactcagtttgttgtttcttgtaatgactaatgaattaagctgaactgttgggtagacacaaggtactaggt

SEQ ID NO: 72422 - protein, 108 aa, Zea mays
  misc_feature: Ceres CLONE 1555496
IGSGPPSSPAVYRFAWLGCLIFSALFFCGKRFHVWFTNLHNSIRDDRYLIGRRLHNFGEDTPEPSESGATIGSDDQDQALVLRDQEEEVGLRMRRNNMRANQQPRLAF

SEQ ID NO: 72423 - DNA, 676 bp, Zea mays
  misc_feature: Ceres CLONE 1555504
  misc_feature: Encodes the peptide sequence at SEQ ID NO. 72424
  misc_feature (276)..(276): n is a, c, t, g, unknown, or other
  misc_feature (321)..(321): n is a, c, t, g, unknown, or other
  misc_feature (350)..(350): n is a, c, t, g, unknown, or other
cgaattgggtaccgggccccccctcgagccactgcagtggtaaaggaaggaaaaaatggcggcgagagcataagaaaaaaaaacacacacacacacagcgcacttttcaaatcgacaaaggggaaaggttcgcttcttgtggcatcttgctttccttcgagtgccatggccgatccggcggaggagaacgttgtctcgccgccaccgacccctgcggccccagccgtgggcgcatcagactcgcccctgcagcctgctgctgacggcgccctcacnggagtgtctgccccggcgccggaggtaagggtcccggggattcanggctttttggagaggacacttcccgtgcnacaagcccttgggggggcgggaaaaactgcctgacggttctggtattggaaagacaagaaaaactttctgcctggttgtaaatagtggggcgcaacctggtcatcctggggtccctgttcccaaggggctttgatttccccccctccccggacccctgaatttcccccaggtacccggtattgggggggggctttggccccccctttatttcccgggggggggccccaaaaaaaaaacccccccgtttttctttcaaaaaaaaagcccccccccggaaattttcccccctggggggggggggtttccttaaaagaacccctttttt

SEQ ID NO: 72424 - protein, 72 aa, Zea mays
  misc_feature: Ceres CLONE 1555504
  misc_feature (52)..(52): Xaa is any aa, unknown, or other
  misc_feature (62)..(62): Xaa is any aa, unknown, or other
MADPAEENVVSPPPTPAAPAVGASDSPLQPAADGALTGVSAPAPEVRVPGIXGFLERTLPVXQALGGAGKTA

SEQ ID NO: 72425 - DNA, 788 bp, Zea mays
  misc_feature: Ceres CLONE 1555510
  misc_feature: Encodes the peptide sequence at SEQ ID NO. 72426
  misc_feature (15)..(15): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (85)..(85): n is a, c, t, g, unknown, or other
  misc_feature (86)..(86): n is a, c, t, g, unknown, or other
taaattgattggcgnaaagcagaacaacaaaaagtagggtacgaacacgatcaccgtctttggggggaaatttatnnnntttttnntttttccaattgggtaccgggccccccctcgagccactgcagtggtaaaggaggggccatcagatccaagaagagggaagagcaccattgcaccaaggaccttcggcgcccgttcaggatccacatcttcccgagcgagttcttggttgacctcttcctcttcggaccacctccaaggctcttggtgtagcttgccactctcacaaatcaagttttcatgtctgatctcgacattcagatcccaactgccttcgatcccttcgctgaggccaatgctggggactctggtgcggcagcagggtcaaaggactacgttcacgtgcgcatccagcagcgtaatggtcgcaagagcctgactaccgtccagggattgaagaaggagttcagctacagcaagatcctcaaagatctcaacaaagagttctgctgcaatggtacagtggtccaggacccagaacttggacaggtcattcagctccagggtgatcagaggaagaacgtctcgaatttcctcgtccaggccggcattgtgaagaaggagcacatcaagattcatgggtttctgacgcaaccgccgggttcccatagcaaaccaaccccctgcatgcaggggccaggctttaattatataataaatatctggaaggggggagccattatcctaatccttgggctggtggtactaacaaagccagggcgcca

SEQ ID NO: 72426 - protein, 161 aa, Zea mays
  misc_feature: Ceres CLONE 1555510
  misc_feature (27)..(108): Pfam Name: SUI1 Pfam Description: Translation initiation factor SUI1
MSDLDIQIPTAFDPFAEANAGDSGAAAGSKDYVHVRIQQRNGRKSLTTVQGLKKEFSYSKILKDLNKEFCCNGTVVQDPELGQVIQLQGDQRKNVSNFLVQAGIVKKEHIKIHGFLTQPPGSHSKPTPCMQGPGFNYIINIWKGGAIILILGLVVLTKPGR

SEQ ID NO: 72427 - DNA, 570 bp, Zea mays
  misc_feature: Ceres CLONE 1555513
  misc_feature: Encodes the peptide sequence at SEQ ID NO. 72428
cgattgggtaccgggccccccctcgagccactgcagtggtaaaggggacgcatccgcgaaatccaagagcagcagcagcagcagaccaagatcgagggagggaggaagacagacagacagacagagagatggagcggatgagctcgtcggtgcagtcctgggtggaggaacacaagctctcgtccatcggagccgtgtgggcgacggcggtgggcgcgtccgtggcgtacagccggcggagggcgccggcgcgggccacgagcctgctcctcatccacgccaggatgcacgcccaggcgctcacgctcgccgtgctcgggggagccggcgctcgcgcacccgctattacggcagcagcgagaggaagcagaagccaggaggacctggactacgggttttaattcccaggtgccgcccggccaccggaggccccagggggaaaccaggaaaacaaaccctggaactggttatggcgggccaaattccctggatgccccgggggccctccaaatgctcccttccaatccaaaaaaaggggagggaaaagggcccttttttgttttttttttt

SEQ ID NO: 72428 - protein, 90 aa, Zea mays
  misc_feature: Ceres CLONE 1555513
MERMSSSVQSWVEEHKLSSIGAVWATAVGASVAYSRRRAPARATSLLLIHARMHAQALTLAVLGGAGARAPAITAAARGSRSQEDLDYGF

SEQ ID NO: 72429 - DNA, 579 bp, Zea mays
  misc_feature: Ceres CLONE 1555514
  misc_feature: Encodes the peptide sequence at SEQ ID NO. 72430
  misc_feature (366)..(366): n is a, c, t, g, unknown, or other
  misc_feature (462)..(462): n is a, c, t, g, unknown, or other
cgattgggtccgggcccccctcgagccactgcagtggtaaaggagctgtgacgaactcgaagcttgcgttcttgtagtagaggtcggcagcaagcggtggtagagcgagaggtcgagaagatgaagagcagcactctgttggcgatcctagttctccaggcccttctggtctctgcggccgtggccaaaggacctgcagggccgacgacgaagaagcagtgctggtgcggcgagtgcaccagctggtcgggcgtgtggacctgcgacgacctcctcaccaagtgcgccgccacctgcaagaactgcgtccccgtgtccacggacaagggggccatcaagtacaggtgccgcgacttcctccccganaactgcggctgcatgatccactagagactcatccaattgcaccatgcccgcgcgccacagcggcacagccgaatggatctttccatgttccttcgntccggtccgccttgcttcaaggagggcagccacccccaataaagccagcccttggggggttggtttttggaaaggtttaaaatgggggggttccccttcccccaggtcgaaaaaagg

SEQ ID NO: 72430 - protein, 89 aa, Zea mays
  misc_feature: Ceres CLONE 1555514
  misc_feature (82)..(82): Xaa is any aa, unknown, or other
MKSSTLLAILVLQALLVSAAVAKGPAGPTTKKQCWCGECTSWSGVWTCDDLLTKCAATCKNCVPVSTDKGAIKYRCRDFLPXNCGCMIH

SEQ ID NO: 72431 - DNA, 709 bp, Zea mays
  misc_feature: Ceres CLONE 1555515
  misc_feature: Encodes the peptide sequence at SEQ ID NO. 72432
cgattgggtacgggccccccctcgagccctgcagtggtaaagggtgctggtcgacgtggtcgtcctgtcccttctctcctctcgtctccacagtccaacacaccgtgtgcggcggtagctgctgctgcccgtgcctaccgaagaagacaagtccaacactgttgttctgttccgtgattgcggaatttgcttcaccacaccttcatcagagagccgagacgacacgctcgggacccagcaaggcaagaagaacacgagagagatagcaggcaccaggcagggatcaatcatccgtccatggagaacctaaaggagcagcggggccacgacgcggcgggcgccaacgcctggatgacggtgccggcgttcggggactgggacacgaagaacggcgcgctgccggactactccatggacttctccaagatccgcgagatgcgcaagcagaacaagaaggagctctcccgcgccagcctcggcggcgacgacgacctcctcgcccacgcccaggcccaggccctgaagccgcaggccagtaacgccccgcccaaagctcggcccgcccccgtccccggccccggccgaaggaccactcccccaacggggagggaaagaaattttcctgaagctactttccgggtgtttgttatccaagggcccttgaagaagggggcttgcctcctaggtggccctggccagccccccttgt

SEQ ID NO: 72432 - protein, 137 aa, Zea mays
  misc_feature: Ceres CLONE 1555515
MENLKEQRGHDAAGANAWMTVPAFGDWDTKNGALPDYSMDFSKIREMRKQNKKELSRASLGGDDDLLAHAQAQALKPQASNAPPKARPAPVPGPGRRTTPPTGRERNFPEATFRVFVIQGPLKKGACLLGGPGQPPL

SEQ ID NO: 72433 - DNA, 673 bp, Zea mays
  misc_feature: Ceres CLONE 1555520
  misc_feature: Encodes the peptide sequence at SEQ ID NO. 72434
  misc_feature (673)..(673): n is a, c, t, g, unknown, or other
caattgggtacgggccccccctcgagccctgcagtggtaaagggcaattcgtttatagcgagacacaccagcgtaccatagattcatcagagtggcgatggccccgagcgcgtcaatgctgttcctgagctactaccagctccacaggccgacggaggtggggacgccgccgccgccgccgctcaaggaggcggctgcccccagtggcttctggatgaggatgagcgtgagcatcatgctctcacccgctttgtatgcagtggcggccggagggggaggcgactctgcacgagcgcgacgccggcgaggagatcaagtcatcggcgccggccgacgctgataaggagctggaaagcaagttccaggaggcgctgcgcctcagctgctggtcttcatgagcatccatccatcatggggaacggatagacgcgagcgtgccgctgaatcgaagcgacctctcctctaaacagccgtcctgtatatcttcctccgtgtatcaaaatccatccttttgctttagatttttgtacatttgtaatcgtcacatccgctcaaatatgttatatatatttgagctgggagcaaacaaaataaataagatcagagctctgggaattcctgcagcccgggggatccacttgttctagagcggccgcctccgcggtggatctcn

SEQ ID NO: 72434 - protein, 47 aa, Zea mays
  misc_feature: Ceres CLONE 1555520
MQWRPEGEATLHERDAGEEIKSSAPADADKELESKFQEALRLSCWSS

SEQ ID NO: 72435 - DNA, 665 bp, Zea mays
  misc_feature: Ceres CLONE 1555538
  misc_feature: Encodes the peptide sequence at SEQ ID NO. 72436
ccgattgggtaccgggccccccctcgagccctgcagtggtaaaggggaggagcgtccccttcgtcttcctagagagggttagggaagacttcatgcagcggtatgggtccagtatcgatgaggaggggcagcacccgctcgctgatgatgctgatgaggatgactttctgttcgaagaccggttcagcattgcctacaatcttgaccgtgaattcggcccgaggttgaaggaccatatgcagtattgtgttaatcatccagaggaaattaacaagctctccaaggttaaagcccacctatcggatgtcaaagggatcatgatggacaacattgaaaagatattggatcgcggggagaagattgagcttttggtgggtaagacagagaccctacagtcacaggcggacagcttccacaggcatggcagagagttgaggcgaaagatgtggcttcagaacctgaggtttaagctgatggtgggtggcggcattgcggctctgatccttatcatttggctgatggtctgcaggggattcaaatgttagagcacaccaagttgctcgcccttttttttttttcttttcaggcgttttgatatgcacagaacttttcaaccaaattgtggttttccagtgtcacgggtatccccaatgtaggtggactta

SEQ ID NO: 72436 - protein, 180 aa, Zea mays
  misc_feature: Ceres CLONE 1555538
  misc_feature (88)..(176): Pfam Name: Synaptobrevin Pfam Description: Synaptobrevin
DWVPGPPSSPAVVKGRSVPFVFLERVREDFMQRYGSSIDEEGQHPLADDADEDDFLFEDRFSIAYNLDREFGPRLKDHMQYCVNHPEEINKLSKVKAHLSDVKGIMMDNIEKILDRGEKIELLVGKTETLQSQADSFHRHGRELRRKMWLQNLRFKLMVGGGIAALILIIWLMVCRGFKC

SEQ ID NO: 72437 - DNA, 656 bp, Zea mays
  misc_feature: Ceres CLONE 1555539
  misc_feature: Translation starting site: 387
cgattgggtccgggcccccctcgagccactgcagtggtaaaggagggttcgcggatcccccacgtacacctataagcaccaacgctagcgcgaaaacccgcttccgcgttagaggctctgcgcatgcgctcctcgctgccgccgccgcgtctcctcctgtacaggtaaagagaggatgagggcgaaatggtgaagcacagacaacgtcatccccaacgggcacttcaagaagcactggcaaaactatgtcaagacatggttcaaccagcccgcccgcaagcagaggcgccgcatctctcgccaaaagaaggctgtgaagatattcccccgcccgactgctggtcctctactccccattgttcaatgccagactttaaagtagcaacatgaagtcaagggctgggagaggctttacccttgaggagctgaaggctgctggcatcccaaagaagcttgctccaaccattggtatttctgttgatcaccgccgcaagaacaaatcacttgagggactgcaggccaatgtccagaggcttaagacatacaaggccaagctggttatcttcccaaggcgtgcacacaaggttaaggctggtgactctactccagaggagcttgccaccgctacccatgtccagggtgactacatgccattt

SEQ ID NO: 72438 - DNA, 637 bp, Zea mays
  misc_feature: Ceres CLONE 1555541
  misc_feature: Encodes the peptide sequence at SEQ ID NO. 72439
cgattgggtaccgggcccccctcgagccctgcagtggtaaagggggttttgagctccgacgaaccctaataatcgccggggaccggcgaccgatcgcctgccggtatgtaccattagtagcggatgaagcaggcagcggcggccgcggccgcggcgcaacaggcactgctcctgcagcagctgtcgcagccgcccttgttccccgtgcaccacccgcaccgcggcctcctcgccgcaccacagatagagcccatagtcagtggaaacctgcctcctgggtttgattcacgtacatgccgcatcgtgtatgtttgcaatatccatcttcaagtgaccgacgcagtactgaaggaagtcttccaaagcattggtccagtagaagggtgcaagctcatcacaaaagaaaagtcatcctttggtatcattgactaccatgatcgcagatatgctgcactagcaattttatctctcaatggcagacaactgtatggtcagccgattaaagtcaattgggcatatacaagtactccgagggagggcacatcaggtcattttaatatttttgatggggatctttgcccggaagtcactgatgctacgttgtgtgacattctctctggttactctacttgctcag

SEQ ID NO: 72439 - protein, 171 aa, Zea mays
  misc_feature: Ceres CLONE 1555541
  misc_feature (61)..(128): Pfam Name: RRM_1 Pfam Description: RNA recognition motif. (a.k.a. RRM, RBD, or RNP domain)
MKQAAAAAAAAQQALLLQQLSQPPLFPVHHPHRGLLAAPQIEPIVSGNLPPGFDSRTCRIVYVCNIHLQVTDAVLKEVFQSIGPVEGCKLITKEKSSFGIIDYHDRRYAALAILSLNGRQLYGQPIKVNWAYTSTPREGTSGHFNIFDGDLCPEVTDATLCDILSGYSTCS

SEQ ID NO: 72440 - DNA, 596 bp, Zea mays
  misc_feature: Ceres CLONE 1555542
  misc_feature: Encodes the peptide sequence at SEQ ID NO. 72441
ggagctgcgggagacggggagagactgacggactgacagtcgaggtcgcggtcggaaacagacagacatactgaaccgattccgtggtggcggatggagtgggacgacgactgggtggcccccgacaagctgcagcacgccgtggcctgcctcctcatcgccctgctctccgccgcgctcgccgcccgcagcgcccgccctggcctccgccgccgcgctgcggctgtcggctccgcggcctcgctcgcggccggcgccgccaaggaggccgcggacgaggcccggctcttcggctccgccggcgcctcgcccaaggacgccgcggccgacctcctgggcgtcgcggccgcggcgctggcgctcgccctgctccgccgcctgcgccgccgtcgcgagaggaaggcgcgcgaggacggggacggggacggccgcggcggcgccgccgtctccatggtgtgactgtgacggcgaggtcagctgctccgatctgttttaaaggctgttgggtactgatttagtttgcgatactctgcccggattgatgcgacttaactatatctatatactcgttgcatcattatacaaaaaaaaaaaaa

SEQ ID NO: 72441 - protein, 121 aa, Zea mays
  misc_feature: Ceres CLONE 1555542
MEWDDDWVAPDKLQHAVACLLIALLSAALAARSARPGLRRRAAAVGSAASLAAGAAKEAADEARLFGSAGASPKDAAADLLGVAAAALALALLRRLRRRRERKAREDGDGDGRGGAAVSMV

SEQ ID NO: 72442 - DNA, 679 bp, Zea mays
  misc_feature: Ceres CLONE 1555545
  misc_feature: Translation starting site: 457
cgattgggtccgggccccccctcgagccctgcagtggtaaaggtggtttcttagatgcgggttggcttctcgtccccctgccgttcgggttccggttcccgatgttctccggggtcctggtgcttgggtgagccctatccagatgtcggcgtacggatgttgagtacggtttcttcgtcgtgcgtgcctcgcctggtccaccgacgaccactccctccacaacatcttccgcacctcctgcaaggtcctcgagtccaataccatcgtcaatgagaagacccagaagggcctcggcttccgcttccatcccttctcccctgacgatgagatgcggaattccttctagggtctgaacggtcacgtagctggacgggcgctacatcaccctcaacagaggaccgagtcgcgcggcggacgtgcacgcagcggaggtgggtacggctggtgcgacagttgatgtcgatcgctacgaccgtgacggacaccatgatggccgtggcggctacagtggcggcggaggctaccgtggctgcggccgctacagtggtggtagctgctgatagcacggtggcaaccgtcccggcggcgacgataactgataccgtaactggtagaacttacccgtggggaccgcgctgcccagtgatcctgttcgcgacattgatgattaccctagtcc

SEQ ID NO: 72443 - DNA, 590 bp, Zea mays
  misc_feature: Ceres CLONE 1555552
  misc_feature: Encodes the peptide sequence at SEQ ID NO. 72444
cgattgggtaccgggccccccctcgagccactgcagtggtaaagggagaggagaaaagcgggggcggcaagcaaccacgggcggagctcggagcgtcctcctcctcccgtctataaattcccctctttttcttcctccatatataggggccatcagatccaagaagagggaagagcaccaaggaccttcggcgcccgttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcagcagcaggggtcaaaagactacgtcacgtggcatcagcagcgtatggtcgcaagagctgaccaccgtcagggattgaagaggagtcaactacagcaagatctcaaaaatctccagaaaaattctgctgcaagggtaaatggggccaggaccccaaaacttggaaagggtcttcccctcccggggggaaaaaaaagaaaaaaactccccaaatt

SEQ ID NO: 72444 - protein, 44 aa, Zea mays
  misc_feature: Ceres CLONE 1555552
MSDLDIQIPTAFDPFAEANAGDSGAAAGVKRLRHVASAAYGRKS

SEQ ID NO: 72445 - DNA, 624 bp, Zea mays
  misc_feature: Ceres CLONE 1555555
  misc_feature: Encodes the peptide sequence at SEQ ID NO. 72446
cgattgggtccgggccccccctcgagccactgcagtggtaaaggtgcaaacatcgaatcgtctcgctcgtggctgccctgctcatactgcttgccctcgccgtatcgtccacccgcaacgcacaggaggattccatggccgacaacaccgggacgttggcgggcggcatcaaggacgtgccggggaacgagaacgaccttcacctccaggaactcgcccgcttcgccgtcgatgagcacaacaagaaggccaatgctcttctggggttcgagaagcttgtgaaggccaagacacaagtggttgctggcacgatgtactatctcactattgaagtgaaggatggcgaagtgaagaagctctacgaagctaaggtctgggagaagccatgggagaacttcaaggagctgcaggaattcaagcctgttgaagagggtgctagcgcctaaggatctctccttctccatgtgcgagcctgaagctcaaagcaaagttgcagaataagaatccatgctcccttgtgtaattttataaaattacaaccctcttagggcttgttcggttgtgtctgtaccgaagggaaatgaaggtgattaaatttccttctatacaaatagaggggcttta

SEQ ID NO: 72446 - protein, 103 aa, Zea mays
  misc_feature: Ceres CLONE 1555555
  misc_feature (10)..(98): Pfam Name: Cystatin Pfam Description: Cystatin domain
MADNTGTLAGGIKDVPGNENDLHLQELARFAVDEHNKKANALLGFEKLVKAKTQVVAGTMYYLTIEVKDGEVKKLYEAKVWEKPWENFKELQEFKPVEEGASA

SEQ ID NO: 72447 - DNA, 671 bp, Zea mays
  misc_feature: Ceres CLONE 1555565
  misc_feature: Encodes the peptide sequence at SEQ ID NO. 72448
cgattgggtacgggccccccctcgagcactgcagtggtaaaggagagtagccaatcctccatcaccatcaccgccaccgcccgaggcctaggccctgatctctgcctaccaaacaatggaagccgcagcagccaccttgtcccgctccgcctccctctccgccggccgcccccaccgctcccgcaccgccaggttcccgccaccacccccacacgtcaccccgctctcggctgccgcgtcgccgcgcgccctcccgctccgccgagccaggtccgacgccgaggtcgcctacttcgcgagatccgccgtcctcgtccgccacgctccgatccccgccattatcgtggcggacgaggaagagcgccaggacgacaacagcaaggcgccagcgggcctcgacggcgccggcgccggcaggaacggcagcagccaccgcggcggcagcggaggccgtggcggcggcggcggcggctgtgacatgggcgagtactaccgccgcgtgctgcgggtggatcccgggaacccgctgctgctgcgcaactacggcaagtacctgcacgaggtggagcgcgacctggcgggcgccgagggctgctacgcgcgcgcgctgctggcgtgccccggggacgccgacctgctcagcctctacggccgcgtcatctgggaggcgc

SEQ ID NO: 72448 - protein, 185 aa, Zea mays
  misc_feature: Ceres CLONE 1555565
MEAAAATLSRSASLSAGRPHRSRTARFPPPPPHVTPLSAAASPRALPLRRARSDAEVAYFARSAVLVRHAPIPAIIVADEEERQDDNSKAPAGLDGAGAGRNGSSHRGGSGGRGGGGGGCDMGEYYRRVLRVDPGNPLLLRNYGKYLHEVERDLAGAEGCYARALLACPGDADLLSLYGRVIWEA

SEQ ID NO: 72449 - DNA, 613 bp, Zea mays
  misc_feature: Ceres CLONE 1555567
  misc_feature: Encodes the peptide sequence at SEQ ID NO. 72450
cgattgggtaccgggcccccctcgagccctgcagtggtaaaggactgcgactgtgagcttcgttcgttcagttcatccgtgttcttgtttgcgaggtcgagagagagaggatgtcgtgctgcggaggcaactgtgggtgcggctccggctgcaagtgcggcaacggctgctgagggtgcagcaagatgtacccggacatggctgagcaggtgaccaccaccacccaggctctcatcatgggtgtcgcaccatccaaggggcacgccgagggcgggttcgaggcggccgccggagctgagaacggcgggtgcaagtgcggcggcaactgccagtgcgacccctgcaactgcggcaagtgagctaggtgctccaccctgcaggccggccggaggaagctagctaattataaagcttaataaagtatagcggcgtcgctgtgtgtgtttcgagtcagtcagtcagttgcgtgccatggcatgctctgagtctgagatgatgatgatggctgatggcggcgtcgtgtcctcccctggcctcctggggcgcttctggcgagcagtgtgttgtgttgtgtgggtgccgcacgctagcaggctagccatgtgccctgctg

SEQ ID NO: 72450 - protein, 57 aa, Zea mays
  misc_feature: Ceres CLONE 1555567
  misc_feature (1)..(55): Pfam Name: Metallothio_2 Pfam Description: Metallothionein
MYPDMAEQVTTTTQALIMGVAPSKGHAEGGFEAAAGAENGGCKCGGNCQCDPCNCGK

SEQ ID NO: 72451 - DNA, 584 bp, Zea mays
  misc_feature: Ceres CLONE 1555568
  misc_feature: Encodes the peptide sequence at SEQ ID NO. 72452
  misc_feature (411)..(411): n is a, c, t, g, unknown, or other
cgattgggtaccgggccccccctcgagccctgcagtggtaaaggtagctccatcagtttcagttccaccctcacgcttcattcacgatttagctccacctcaaagtcctcggcttgtcaccgtccttctgccgacctccatcggtcgtcgacacacaggccgcgatcgaatcagttgaattgaagccgaaatcctgaaacggcgcgcatggcgggctacggcgacgacggcgtggacctcaccgagctgacgctggggccacccggcgtcagtgcgcgcaaggcgagacgagcgaggaagaacggccagcagccgtcgtcgtccgcatgacgatgcaagcgttcgtgaaggtgagcatggacgggacgccgtacctcaggaaggtgggacgtgccgcgtacgacgactacngcgagctcgtggagggcgctcacgagtttgtctgctgctgctccatcgggctgatggacggctacggccagtgggaccacgccttggtgtacaaagaacgcgacggcgactggatgctcttcgggcacttggcgtggggaaaagttcttgtccccctggcaaccggatggggg

SEQ ID NO: 72452 - protein, 86 aa, Zea mays
  misc_feature: Ceres CLONE 1555568
  misc_feature (29)..(29): Xaa is any aa, unknown, or other
MTMQAFVKVSMDGTPYLRKVGRAAYDDYXELVEGAHEFVCCCSIGLMDGYGQWDHALVYKERDGDWMLFGHLAWGKVLVPLATGWG

SEQ ID NO: 72453 - DNA, 639 bp, Zea mays
  misc_feature: Ceres CLONE 1555570
  misc_feature: Encodes the peptide sequence at SEQ ID NO. 72454
  misc_feature (639)..(639): n is a, c, t, g, unknown, or other
cgattgggtacgggccccccctcgagccactgcagtggtaaagggagctggccatggaatccattggccccggccagccgagggtgaggatagctaatctgacggctggctgacgactgcactgacatcggcgtgagctgcagtgctcctgtctacgtgccctggcgtgcctgtctgcctctccttgggatggatgttgcccacatgcgatcccgggattctcatcctccatgacgtacttggactgtgtcatggagattatgctctatcctgttccatgggcgtcacgacatctcttctgctggaactacatcaccgagcagactgcctactgcttattgatgctgacggctcgactatcggcatgctcttcctacgggggtctacttgagatcccgtgtatcaagacactaatcaccttctctgatgccgctatataatgctgttatgctctggtgatagctaagtctatggctgtgatgttcaagtacttgaagctgtctatcagcacgaacatagttcctgatgagatcaaagggagggtgctacctctttgcttccctgcatctcggttgatgccccggtatgtccgattggaccacaagacattgaaccttctgaattgttgcacctggtgan

SEQ ID NO: 72454 - protein, 69 aa, Zea mays
  misc_feature: Ceres CLONE 1555570
MTYLDCVMEIMLYPVPWASRHLFCWNYITEQTAYCLLMLTARLSACSSYGGLLEIPCIKTLITFSDAAI

SEQ ID NO: 72455 - DNA, 631 bp, Zea mays
  misc_feature: Ceres CLONE 1555574
  misc_feature: Encodes the peptide sequence at SEQ ID NO. 72456
  misc_feature (631)..(631): n is a, c, t, g, unknown, or other
cgattgggtccgggcccccctcgagccactgcagtggtaaaggtgctttcttagaggtgggttggcttctcctccccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcagctactgtggtggccgtggaggcggcggctacagcggtggcgggcgccgtgatggccgctgcggctacagcggtggcggcagcggctactgtggcggcggtggctacagtgagtggtggtggcggctacagcggtggcaaccgtggcggcggctaccgcaactccgacggtgactggaggaactgagcggtggggcccgcgcgn

SEQ ID NO: 72456 - protein, 152 aa, Zea mays
  misc_feature: Ceres CLONE 1555574
  misc_feature (10)..(81): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGSYCGGRGGGGYSGGGRRDGRCGYSGGGSGYCGGGGYSEWWWRLQRWQPWRRLPQLRR

SEQ ID NO: 72457 - DNA, 694 bp, Zea mays
  misc_feature: Ceres CLONE 1555578
  misc_feature: Encodes the peptide sequence at SEQ ID NO. 72458
  misc_feature (180)..(180): n is a, c, t, g, unknown, or other
cgattgggtaccgggccccccctcgagccactgcagtggtaaaggtggcttaaaccctcactgattgtatacttatcctgctggtaccacgagaatgccacttgttacaactgtagcagttgcagctgcttttgtgtttcacagcttgtacttcttcttttccatacccatggaagtgangggtgcattgcaacctccagctgaacaggtactctgtccgagtgactccagcatctccaattgatgtctatatcatcacatattcctattttgccctgcccgctctgctctgtctgtatcatctagcgctttgttaatctcacgcatagctatgtgtatctgatatcttttgcaacggaaccaacacacgacgtgcttttcatctgaggcaaaactggcatcttttgttctttttcacacagtaactataggcgccggaacctctgacctgataatagggcatgcaaacttctaaagaagtgcatcagctaatgcaaaatagatgaattgctgctaaaaatacaaaaaaatcacccagctctggcaatcctgcagcccgggggatacacaccttctagaacggcccccaccgcgatggagctccaactattgttccctgtacacacgcttaatttcggactagacttactcttgcccataccagtttacatgtgtgaaatcgttattcgactcc

SEQ ID NO: 72458 - protein, 49 aa, Zea mays
  misc_feature: Ceres CLONE 1555578
  misc_feature (29)..(29): Xaa is any aa, unknown, or other
MPLVTTVAVAAAFVFHSLYFFFSIPMEVXGALQPPAEQVLCPSDSSISN

SEQ ID NO: 72459 - DNA, 692 bp, Zea mays
  misc_feature: Ceres CLONE 1555584
  misc_feature: Encodes the peptide sequence at SEQ ID NO. 72460
ccgattgggtaccgggccccccctcgagccctgcagtggtaaaggaggggccatcagatccaagaagagggaagagcaccaaggaccttcggcgcccgttcaggatccacatcttcccgagcgagttcttggttggcctcttcctcttcggaccacctccaaggctcttggtgtagcttgccactctcaccaatcaagttttcatgtctgatctcgacattcagatcccaactgccttcgatcccttcgctgaggccaatgctggggactctggtgcagcagcagggtcaaaggactacgttcacgtgcgcatccagcagcgtaatggtcgcaagagcctgaccaccgtccagggattgaagaaggagttcagctacagcaagatcctcaaagatctcaagaaagagttctgctgcaatggtacagtggtccaggaccccagaacttggacaggctgccccgctataagtcattcagctcccagggtgatcaaaaggaaagaaacgtctccgaattttccctcgtcccaaggcccggatttggtgaaaaaaaggggcccccttctaagatttcctggggttttttaaaaaaaaaccccccgggggccccttttttaaaaaacaaaacccccttgtgtttggggagggggggattcccctaaatttaaaaaaaaaaaaaaaaaaaaccccggt

SEQ ID NO: 72460 - protein, 127 aa, Zea mays
  misc_feature: Ceres CLONE 1555584
  misc_feature (27)..(89): Pfam Name: SUI1 Pfam Description: Translation initiation factor SUI1
MSDLDIQIPTAFDPFAEANAGDSGAAAGSKDYVHVRIQQRNGRKSLTTVQGLKKEFSYSKILKDLKKEFCCNGTVVQDPRTWTGCPAISHSAPRVIKRKETSPNFPSSQGPDLVKKRGPLLRFPGVF

SEQ ID NO: 72461 - DNA, 900 bp, Zea mays
  misc_feature: Ceres CLONE 1555587
  misc_feature (1)..(1): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (583)..(583): n is a, c, t, g, unknown, or other
  misc_feature (900)..(900): n is a, c, t, g, unknown, or other
ngttccgcaccccccagcataccataaaattaaataatagaaagggaaaaaggagaaaaaaaaaaannntattattttttttccgattgggtacgggccccccctcgagccctgcagtggtaaagggtcagcaacccaacccacatccaccggaagatgagagctccagctccaagctgctcctattcccgcgctgctctcccgctgctcctcgcctccctcctcggccccgcgccgcctcctctcctcctcccgcacgccagccgcctgctggcccgcctccggaagtcgtcgcgctctatcttcctcgaattgctggcggtccccgaggaaggccagctgtcgcgggacgccccctcccacaaacgcccttgcccgacacccctaattccctccctcccgtcccccgggggaaacaaccgtccaaccccgggggggccccgcctttccacccccccaaaaattccttttgaaaccaaaaaaccctcccctaaaaaacacaaaaaggggtttttggggaaaaaaaaaaccccctcaaaaaaatgctcgcaaaaattccccccccccccaagcacccccctcnttttgaaatatgaaaaaaaaaaaagagaccccccccccccccactatccattataaaaaagagggggagaagataaaagggggggggtaaataaaaacacccacctccctaagaaaacaccaccttcctataactaattataaccaccacgcgatcccaaaaacgcctggacaaaacgattgaataacaacttatgctttcgcaacactccaacaaattgggagcgatacaaaacctcccccctctttgtgagaaaaaatatttacttcctggccaaacacaatataaaaccacccccctttcacccccccaccatn

SEQ ID NO: 72462 - DNA, 677 bp, Zea mays
  misc_feature: Ceres CLONE 1555594
cgattgggtccgggcccccctcgagccactgcagtggtaaaggaggaaggaccctggcctaggcttggtacgtcggggtgccgcgggaactggaacagtgatggactgcgctgtgtacgccgagaccccgtggctggacttcctcctcctgcggctccgcgcgccgcgcgtacaacagttaatctcgttcacccctcttcgtgcgacttgaggacttgggcattcgagggctatccatggtagatgccttggggatccgagcaatctaatgttggggaaaaggggtagagatgtaccgtagttcatccggcccaccatccaaagcgtgtcgcgaacaaatgaggagggacaagccgagtgacaggttcctggaatgaagttcagctatgagtcgtggtaaggtagcaaagttagattaagcaatatgttgacgtgatgcagcccgttggtggcacaacttagaagtgaggcagataagcttattgaatcagacgagaagctgcgggagaatctctaggatctgaacgacgagaagaacgacctccgtgatgagaatgtgagactattggttgaaaaggataggctggagcagcaagtcaaagctatgagtgtagctcctacaggatatgtaccccatcctccctcatccagacttcatacgcatcctggctgcgttt

SEQ ID NO: 72463 - DNA, 570 bp, Zea mays
  misc_feature: Ceres CLONE 1555598
  misc_feature (214)..(214): n is a, c, t, g, unknown, or other
cgattgggtaccgggtcccccctcgagccactgcagtggtaaaggaggggccatcagatccaagaagagggaagagcaccaaggaccttcggcgcccgttcaggatccacatcttcccgagcgagttcttggttggcctcttcctcttcggaccacctccaaggctcttggtgtagcttgccactctcaccaatcaagttttcatgtctgatcntcgacattacaaaatcctaactgccccttcgatccccttcgactgagggcaaatgctgggggactctggtgcagcagcaggtcaaaggactacgttcacgtgcgcatccagcagcgttatggtcgcaagaacctgaaccacgtccaggattgaaaagggagtcagctaccgcaaatcctcaaaaactcaaaaaaaatttcggcctcaatgggaacaaggggctccagaaacccaaaaacttttgacaaagggtttttccgcccccccaggggggggtttttaaaaaagaaaaaaaaaccccccaaatattccccccccccacccccgcctttttttaaaaaaaaaaaaacaaccaa

SEQ ID NO: 72464 - DNA, 620 bp, Zea mays
  misc_feature: Ceres CLONE 1555601
  misc_feature (180)..(180): n is a, c, t, g, unknown, or other
  misc_feature (340)..(340): n is a, c, t, g, unknown, or other
  misc_feature (349)..(349): n is a, c, t, g, unknown, or other
cgattgggtccgggccccccctcgagccactgcagtggtaaaggagcgtgagagctagctactaccttattacctctctccgcagctgtaggcggcggcggcggcggccatggacttcgtgctccaggtcctgctgcgggtggtgatgagaagaagcatccgcaggctgcaagaggtcgnttgacatcgccgtggacatcggcacggctgtcttcgtggccgtgcgggtctccggcctcgtcttccgccgccggctgcccacgccgactacgacatcgtcgtcgtcgacgacgtactactactccccggggacgtcctcctcgatcggcatgcatgtccnagaggattnattattgacaggcactagatgagctagctagctagctagggccagaagatgtatacttctcgcgggggcatgtaagtactaaggtcatatatctgtgccgtcttttttgtggaatcaaactaattttcgctagctaccctaaattatttgttgtgcctactgctctacctttttacctgggtaaatttgagggaaaaaaaaaaaaaaaaaacccaagctctcgggaattcttgcacccccggggaaacccactatttttaaagcgggccgc

SEQ ID NO: 72465 - DNA, 664 bp, Zea mays
  misc_feature: Ceres CLONE 1555603
cgattgggtaccgggccccccctcgagccactgcagtggtaaaggtcatggacctcctcggtccaggaggccggagccctctatgtctgccgtggttcagctccttccgacggccaccaggtcatgcatccaaggcggattgctggctcttcgtttgcaccgaagcttctgatgtgtcatctgcttgccttcaccacctctgacgatatcatagtactccttgcctcaggtatgacctgacgtcaactgcattctctcgagcatgtcggtgccgacaacactcctcgtactttgccgtctgagtgcgtaactgctggaaatcgacgctttgccaattccttactagacaattgttgtcccccttcccctatctctctacatccaatttgtgactcccgattatgtcgtctccatcctgctggttttggtgtcccctgacacatcctgggctgggctggggtccttgtgctgcacgcttcttgcgaatctgcttagctgtgttgctcacatgctcttgcctcctctctccttgtacgagtcgaacttgtcgaatctcctggaattcctgctgcccggttgtactacttgtgttacttgccgcgccatcgtcgagtagctccagcttttgttcccttccgtgagctctagtattccctctcgccct

SEQ ID NO: 72466 - DNA, 636 bp, Zea mays
  misc_feature: Ceres CLONE 1555605
  misc_feature: Encodes the peptide sequence at SEQ ID NO. 72467
cgattgggtaccgggccccccctcgagccactgcagtggtaaaggggaggcggcggctacggcggcgggtacggtggaggtggcggcggcggcggccgcggctgcttcaagtgcggcgaggagggccacatggcaagggactgctcccagggcggcggctacggagggggaggcggcggccgcggcagcgagtgctacaactgcggccaggagggccacatctcccgcgactgccccaacaaaaggcgttaggcgcggcgccaccgtcgcctcggatccggcgggagtcccatgtcgcctctcgccgcatccctacccctccaaaggtatcgctcggctgactctcgcgtgaagtcgtcggagcaaactatctatcagtagtactagcagtgtcgtttcgttttggtctgtcgtggtagtaagaaatgcaagtgagcagcaccagtatctttccgtttgaatcagttgtaaggcagccatggtcatggttggctctgccggatctatctgtcatgaactatctataatatatcgttatcaatgttaaaaaaaaaaaaaaaaaaccagagctctgggaattcctgcagcccgggggatccactagttctagagcggccgccaccgcggtggagctcc

SEQ ID NO: 72467 - protein, 40 aa, Zea mays
  misc_feature: Ceres CLONE 1555605
  misc_feature (20)..(37): Pfam Name: zf-CCHC Pfam Description: Zinc knuckle
MARDCSQGGGYGGGGGGRGSECYNCGQEGHISRDCPNKRR

SEQ ID NO: 72468 - DNA, 675 bp, Zea mays
  misc_feature: Ceres CLONE 1555607
  misc_feature: SWISSPROT Homolog: EC 2.3.3.8 ATP citrate synthase
  misc_feature (629)..(629): n is a, c, t, g, unknown, or other
caattgggtaccgggccccccctcgagccctgcagtggtaaagggtttattgactattggtcaccgtttctctagatcaattgatgatgcagcccgatacttcgtagatgcatgtgatagaagcctcacatccatacacaatttgttgaacgactgaaaaagacgggactccgtgtgcctgggattgctcacaggattaaaagcaaacacacacggacaactgtgtgcagcttctacagaaatcatgctcacacacctttcccttcaatccaatgcatggaacacccactacacgtggaaacctacaccctttccaaaagccaacaatactgccttatgaatgccgatgatgcgatcgacatccccttccatcgatctaccaaccggaacaggaatgttctgggaagccgacatctatgacagtgtcgacatcgcttatctccatgctctctctggacttacaccatcaattggactaatcacgacataccttactacagaagatgctatggacagtcactcataccatctcccactgggaacgatgtactttttctacaaaagcgagaaaatgccccttctttttaccatggccctgacaacaagtgatttaattaatcggccgttangaaaactttccaaggtttggcccctgttaactacctgcgcaagata

SEQ ID NO: 72469 - DNA, 649 bp, Zea mays
  misc_feature: Ceres CLONE 1555614
  misc_feature: Encodes the peptide sequence at SEQ ID NO. 72470
cgattgggtaccgggccccccctcgagccctgcagtggtaaagggtgcccgcggtgctagtaacggttgctctagatccgttcatcctggtggttttgtgaggtcgaaagcggcgagcgaattagaagatgctggacaagctgtgggacgacgtggtggccgggcctcgcccggagacgggcctggagaagctccgcaaggccaccaccgcccgcccgctcgtcatcaacaaagacggcggacggcggcagctacaagcgggcgcagtcgacgccgtcgaccccgacgacgccggtgacgccgtcgtcgtcgtcgtcgtcgacaacgccccgcggcgccggcaacgtggtggcccaccgtctttccccccggggaacaccctggcccccaaggggatggggggccaaccttcttcaaccccccccagccccaaattcccccccctttttaaaaatgggtttttcaaggggcccgaaaccccgggggccccccccccccctttttaaatcgggcgcaaaaatgggcaacccttgtaaaaaggcccccccgggtttttcctcttttttacgggccccccttgtttttcgccggggggcccccctttggggggggttttttcttaaaaaaaaaaccccgcttgttgtctctc

SEQ ID NO: 72470 - protein, 125 aa, Zea mays
  misc_feature: Ceres CLONE 1555614
  misc_feature (5)..(122): Pfam Name: Auxin_repressed Pfam Description: Dormancy/auxin associated protein
MLDKLWDDVVAGPRPETGLEKLRKATTARPLVINKDGGRRQLQAGAVDAVDPDDAGDAVVVVVVDNAPRRRQRGGPPSFPPGNTLAPKGMGGQPSSTPPSPKFPPLFKNGFFKGPETPGAPPPPF

SEQ ID NO: 72471 - DNA, 877 bp, Zea mays
  misc_feature: Ceres CLONE 1555615
  misc_feature: Encodes the peptide sequence at SEQ ID NO. 72472
  misc_feature (1)..(1): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (372)..(372): n is a, c, t, g, unknown, or other
nttttnnnnnnaannnnnnngcttctatgctggacccttnnnnannnnnnnnccggattgggtccgggccccccctcgagccactgcagtggtaaagggcagttttgcctgtggtcaatggtcattgcttcgttggttaaaccttgagagcaccggttcaggcgttcagcaatcgcagagcggcgatggacggcagcggggtcgatacggccacgacggcggcctggatggagaagcaccggcagatgtacgagcgggcgacccggaacccgttcaccgtctccatccgcgacggtaccgtcgacatgtctgccttcgagcgctggctgagccaggactatctgtttgtaagggaatttgttgcattcatancaagtgtactgctaaaaatgcttcaagccaaaaagacaggttcgtatatggcacaccctcctggggtgggagggggggggcttttctatccgacaaagtatcctctcggccctcaaggaaacggaagcctttacccctattgccctgcccccgcaatccgacgcatacttgcttttcccccctcttttacaaagagcctaatttttgagcaagcaatcccaccaagggttttctctccccagaaagccccctgtcccatgaacccccaaagacaaacttaaatctcaattcgcttgatttcgcttagttaatctttacccctccccgggaatcctatcctaaacaccttgtctttccccgggggacccgcccttctcgttttttcgtggctatgaaaagaacgtccacactaatacaggctctccggggagcctccgcatgcgcccctctgcccgaactatttgatgtctaccccccaggagtttgaaaatattattcttattat

SEQ ID NO: 72472 - protein, 155 aa, Zea mays
  misc_feature: Ceres CLONE 1555615
  misc_feature (63)..(63): Xaa is any aa, unknown, or other
MDGSGVDTATTAAWMEKHRQMYERATRNPFTVSIRDGTVDMSAFERWLSQDYLFVREFVAFIXSVLLKMLQAKKTGSYMAHPPGVGGGGLFYPTKYPLGPQGNGSLYPYCPAPAIRRILAFPPSFTKSLIFEQAIPPRVFSPQKAPCPMNPQRQT

SEQ ID NO: 72473 - DNA, 680 bp, Zea mays
  misc_feature: Ceres CLONE 1555620
  misc_feature: Encodes the peptide sequence at SEQ ID NO. 72474
  misc_feature (680)..(680): n is a, c, t, g, unknown, or other
cgaattgggtaccgggccccccctcgagccactgcagtgtaaaggctactgcggcttcaggactcgacacctcttgcgccgccgccatgaccttcaagcgccgcaacggcggccgcaacaagcatggccgcggtcacgtcaagtacatccggtgctcaaactgcgccaagtgctgccccaaggacaaggcgatcaagaggtttcaggtgaggaacatcgtggaacaggcggccatcagggacgtccaggaagcatgcgtctatgatggctacgtcctcccgaagctgtacgccaaggtgcaccactgcgtctcgtgcgcgatccacgctcacatcgtccgcgtccgatcccgtgagaagcgcagggaccgcaagccgccggagcgcttcaggcgcagggaggataggcctgctggtggacaaggaggcccccgccctggtcctggtgctgctgctccagctccagctccagcacctgttgctgctcgcccataggctttagcttttcgaccgtgttaagtcttctgcccactcagtttcggaattgtcgcctatgggtgtgtgaagctgctatattagagttactttttgtctaaagcctgaacattttcaaagaatttgaatatctgaatatttgaatatttgtgctaagtttttcgaagaatttgaatatctgaacan

SEQ ID NO: 72474 - protein, 135 aa, Zea mays
  misc_feature: Ceres CLONE 1555620
  misc_feature (1)..(117): Pfam Name: Ribosomal_S26e Pfam Description: Ribosomal protein S26e
MTFKRRNGGRNKHGRGHVKYIRCSNCAKCCPKDKAIKRFQVRNIVEQAAIRDVQEACVYDGYVLPKLYAKVHHCVSCAIHAHIVRVRSREKRRDRKPPERFRRREDRPAGGQGGPRPGPGAAAPAPAPAPVAARP

SEQ ID NO: 72475 - DNA, 635 bp, Zea mays
  misc_feature: Ceres CLONE 1555622
  misc_feature: Encodes the peptide sequence at SEQ ID NO. 72476
cgattgggtaccgggcccccctcgagccactgcagtggtaaaggcggaccgcggcgaccacccggcgccgtccccgctcccttcgctcccgttcgagcagccccgcgggcggctctcggccgccgcgcgcgtccttgccgccgtggacgccatctcctcgctcgcggcagcggccgcggccgccgtcctcgtcggaggacccgtcactttcccccgggtatccggcggcgtcggcgacctcccctgggcggagccgttcaacgcggtgtccggccagctcgcggcgctcggcgacggcgaggtggactcgttagacgaggccgtccggaggctcgcgtcggcgctggacgcctccggcgagggtgctgccgacggcgagacggccgtgcgcgctgcggcgcaggaggcggagaggcgcgccgagggggtcgcgccgctgctggaccacctgtctgacgccgtcggcggcgtgttccgcgccgcgctgggcctccgtaacgccgaggtggactccttcacggtgggacccgcggggaagccgagtagcacataaccgtcgcttcgtgtggactcgtagctgtctgtatagtgtatacagtagtgtactgggatactgctacagcctacagctcagt

SEQ ID NO: 72476 - protein, 183 aa, Zea mays
  misc_feature: Ceres CLONE 1555622
DWVPGPPRATAVVKADRGDHPAPSPLPSLPFEQPRGRLSAAARVLAAVDAISSLAAAAAAAVLVGGPVTFPRVSGGVGDLPWAEPFNAVSGQLAALGDGEVDSLDEAVRRLASALDASGEGAADGETAVRAAAQEAERRAEGVAPLLDHLSDAVGGVFRAALGLRNAEVDSFTVGPAGKPSST

SEQ ID NO: 72477 - DNA, 669 bp, Zea mays
  misc_feature: Ceres CLONE 1555624
cgattgggtaccgggccccccctcgagccactgcagtggtaaagggcggaggaggtggacgaggtgctcggctcgcggcgcgagaaggggttccttcctggccccgaggagagcggcgaccacgaggagcgggagcaggaggaggaggaacgcgaagaacgccacggcgggcgtggggagagggaacgccacggacgtgaggagcgggagaaagaggaggaacgcgaaggacgccacggcggccgtgaggagcgggaggaggaggaacgccacggccgcgggcgccgcgaggaggtggcggagacgctcatgaggatggtgaccgccaggatgtgaggccgccgcgctcgccaaaacgagcaagcaggaagcaacgagaggatggcgcgcgaccgacgtgcgtacgtagcatgagcctgagtggagacgttggacgtgtatgtatatacctctctgcgtgttaactatgtacgtaagcggcaggcagtgcaataagtgtggctctgtagtatgtacgtgcgggtacgatgctgtaagctactgaggcaagtccataaataaataatgacacgtgcgtgttctataaaaaaaaaaaaaaaaacagagctctgggaattcctgcagcccgggggatccactagttctagagcggccgccaccgcgtggagc

SEQ ID NO: 72478 - DNA, 624 bp, Zea mays
  misc_feature: Ceres CLONE 1555627
  misc_feature: Encodes the peptide sequence at SEQ ID NO. 72479
cgattgggtccgggccccccctcgagccactgcagtggtaaaggttgctttcttagaggtgggttggcttctccttcccctccggttcgggttcgggttcgtgaggttctccggggttcggtttcgtgggtgagcggatcgagatggcggcgtcggatgttgagtaccgctgcttcgtcggcggcctcgcctgggccacggacgaccactccctccacaacgccttcagcacctacggcgaggtcctcgagtccaagattatcctcgatcgggagacgcagaggtcccgcggcttcggcttcgtcaccttctccacggaggaggcgatgcggaacgccatcgagggcatgaacggcaaggagctggacggccgcaacatcaccgtcaacgaggcccagtcccgcggcggccgtggaggcggcggcggcggctactgtggtggccgtggaggcggcggctacggcggtggcgggcgccgtgatggcggcggcggctactgcggtggcggcggcggctacggtggcggcggtggctacggtcggtggtggtggcggctacagcggtggcactgcgcgtcgaccacgatggatacgggcccgcatctgtccggtctcagtctttctg

SEQ ID NO: 72479 - protein, 160 aa, Zea mays
  misc_feature: Ceres CLONE 1555627
  misc_feature (10)..(81): Pfam Name: RRM_1 Pfam Description: RNA recognition motif. (a.k.a. RRM, RBD, or RNP domain)
  misc_feature (48)..(135): Pfam Name: GRP Pfam Description: Glycine rich protein family
  misc_feature: SWISSPROT Homolog: EC 5.2.1.8 Peptidylprolyl isomerase
MAASDVEYRCFVGGLAWATDDHSLHNAFSTYGEVLESKIILDRETQRSRGFGFVTFSTEEAMRNAIEGMNGKELDGRNITVNEAQSRGGRGGGGGGYCGGRGGGGYGGGGRRDGGGGYCGGGGGYGGGGGYGRWWWRLQRWHCASTTMDTGPHLSGLSLS

SEQ ID NO: 72480 - DNA, 641 bp, Zea mays
  misc_feature: Ceres CLONE 1555629
  misc_feature: Translation starting site: 123
  misc_feature: SWISSPROT Homolog: EC 2.4.1.207 Xyloglucan:xyloglucosyl transferase
cgattgggtacgggccccccctcgagccctgcagtggtaaaggggctgaggaggccatcggacgcacaaggacagcagagtgcaggaccggagcggagcgaccgagagtgtgtgggagagagatggcgtccagcgcctcgtctaccctgccgctgccaacgctctcgctcgccgtgatcctgctcgcgctgtgcgcccgcggcggcgaggccaggccgccaccgccgctccacggcgtgcgcccgctcgccttcgacgaggggtacacccagatcttcggcagcgccaacctcgcgctcctccgcgacggtaggcgcgtccgcctcacgctcgacgagtccaccggagccgggttcgcgtcgcaggacgtcttcctccacggtttcttcagcgccgccatcaagctgcccgccgactacgcggcgggcgtcgtcgtcgcgttctacctgtcgaacggcgacgtgtacgagaagacgcacgacgagctggacttcgagttcctgggcaacggtgcgggcccgcgagtggcgggtgcagaccaacgtgtacgggcaacggcagcacccgacgccggccggggaggaagcgctaccaacctcccaattcgaccccaccgaacgactttcaccaactactccatt

SEQ ID NO: 72481 - DNA, 674 bp, Zea mays
  misc_feature: Ceres CLONE 1555633
  misc_feature: Encodes the peptide sequence at SEQ ID NO. 72482
cgattgggtccgggccccccctcgagccctgcagtggtaaagggtgctctctcagaggtgggctggcttctcctccccctcttaccaagtcctcctcgggttagggttccttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtcatcaccgaccgggagacggggaggtcccgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacggcggcggtcgcggcggcggcggcggttatggtggcgggcgccgtgacggcggttatggcggcggtggcggctacggcggtcggcgcgaaggtggcggcggcggctacagaggcggtggcggctacagcggtcggcgcgagggtggcggtggcggctactgcggcggtggcggcggcggctggagggactgatgtgtgggcccatcctggcttcggccgagttatcttatctatctatagtatcgtgttaccgtt

SEQ ID NO: 72482 - protein, 159 aa, Zea mays
  misc_feature: Ceres CLONE 1555633
  misc_feature (10)..(81): Pfam Name: RRM_1 Pfam Description: RNA recognition motif. (a.k.a. RRM, RBD, or RNP domain)
  misc_feature (48)..(153): Pfam Name: GRP Pfam Description: Glycine rich protein family
  misc_feature: SWISSPROT Homolog: EC 5.2.1.8 Peptidylprolyl isomerase
MAAADVEYRCFVGGLAWATSNESLENAFASYGEILDSKVITDRETGRSRGFGFVTFSSENSMLDAIENMNGKELDGRNITVNQAQSRGGGGGGGGYGGGRGGGGGYGGGRRDGGYGGGGGYGGRREGGGGGYRGGGGYSGRREGGGGGYCGGGGGGWRD

SEQ ID NO: 72483 - DNA, 691 bp, Zea mays
  misc_feature: Ceres CLONE 1555646
  misc_feature: Translation starting site: 122
cgattgggtaccgggccccccctcgagccctgcagtggtaaaggagtctcctctagccgtctcgcgcgcttcaccttccccaccccgccgccgccatcgcacgcccgcagccgcatccgctatgggtgcgtacaagtacgtctcggagctatggcggaggaagcagtccgatgtgatgcggttcgtgcagcgcgtgcgctgctgggagtacaggcagcagccggccatcgtccgcctcacaaggcccactcgtcctgacaaggcgcgccgcctcggctacaaggccaagcagggttatgttgtttaccgtgtccgtgttaggcgtggtggcaggaagatgcctgtgcctaaaggtattgtctatggggcagccaagcaccaggggtatcacccagctcatgttccagaagaacaagaggtctgttgctgaggagaaggctgaacaaaagcttggtggactcagggtcctcaactcctactgggtgaatgaagatagcccctacagtactttggaaatcattccttgtggatgtggccccccctaccttccccaatggtccaggggtcaacgggcttggaaacctgggcaaaagccccggggagcccccgggtctcaccctccccaggaaaaaaattcccggggccctggtgggaaaggccccccctccccccaaagaaaagggccccccgg

SEQ ID NO: 72484 - DNA, 666 bp, Zea mays
  misc_feature: Ceres CLONE 1555649
  misc_feature: Translation starting site: 109
  misc_feature (513)..(513): n is a, c, t, g, unknown, or other
ccgattgggtaccgggccccccctcgagccctgcagtggtaaaggcagaaccgccgacaactctctctaccgtccgagaccccaagcaccagcgcggcggcggcgaccatggctgtcggaaagaacaagaggatctccaagggaaagaagggtggcaagaaaaagaccgtcgaccctttctctaagaaggattggtatgacatcaaggcaccgtcggtgttcagtgtgcgcaacatcgggaagactctcgtatccaggacacagggtaccaggattgcttctgagggtctgaagcacagagtctttgaggtttgcctagctgatcttcagggcgatgaggatcaagcttacaggaaaatcaggctccgtgctgaagatgtgcagggcaggaatgtgctcacaaacttttggggtatgaattttaccactgataaactcagatccctagtaaagaagtggcagacattaatcgaagcccatgtcgatgtcaagacaaccgacaactacatgttngcgtttgttctgcatcggcttcaccaagaggcgcccaaaccaagtcaagagaacctgctatgctcaggcatcccagatccgtcagatccgccgtaagatggttgagattatgatcaaccaggcgtctacatgtgacctgaaagaacttgtttc

SEQ ID NO: 72485 - DNA, 648 bp, Zea mays
  misc_feature: Ceres CLONE 1555655
  misc_feature: Encodes the peptide sequence at SEQ ID NO. 72486
  misc_feature (550)..(550): n is a, c, t, g, unknown, or other
ccgattgggtacctggccccccctcgagccctgcagtggtaaaggtctgacggtaaagtttcgtccgtatgcagattgacggctccaattggcgcccatggcggaagaaaccaacataaaaaaggaggaagaggagttcagcaccggtcctctctcggtgctcatgatgagcgtcaagaataatacccaggttcttatcaactgccggaacaacaagaagttgcttggtcgcgtgcgagccttcgatcggcactgcaacatggttcttgagaacgttcgtgagatgtggaccgaggtaccaaagaccggtaaaggcaagaagaaggctctcccggtgaacaaggacaggttcataagcaagatgttcctccgcggggattcggtcatcatcgtcctcaggaacccgaaatgagtagcctgtacacgtagagagtctgtttgctagcagtacgttgtgctattgggtgtaaggtgtatgccaaatgctcaaagcatgggagtgtaagtcgcggcagaattcgccatgtgtgttgatgggtggggggattcnagcttaagacaggatgctagggctggggttttgcttcttgtagcagacttgaacatgatgctcggcaatctctttgtcccccgtcagctcggcaatct

SEQ ID NO: 72486 - protein, 104 aa, Zea mays
  misc_feature: Ceres CLONE 1555655
  misc_feature (22)..(101): Pfam Name: LSM Pfam Description: LSM domain
MAEETNIKKEEEEFSTGPLSVLMMSVKNNTQVLINCRNNKKLLGRVRAFDRHCNMVLENVREMWTEVPKTGKGKKKALPVNKDRFISKMFLRGDSVIIVLRNPK

SEQ ID NO: 72487 - DNA, 613 bp, Zea mays
  misc_feature: Ceres CLONE 1555659
  misc_feature: Encodes the peptide sequence at SEQ ID NO. 72488
  misc_feature (408)..(408): n is a, c, t, g, unknown, or other
  misc_feature (409)..(409): n is a, c, t, g, unknown, or other
  misc_feature (410)..(410): n is a, c, t, g, unknown, or other
  misc_feature (411)..(411): n is a, c, t, g, unknown, or other
  misc_feature (415)..(415): n is a, c, t, g, unknown, or other
  misc_feature (416)..(416): n is a, c, t, g, unknown, or other
  misc_feature (417)..(417): n is a, c, t, g, unknown, or other
  misc_feature (424)..(424): n is a, c, t, g, unknown, or other
aagctggagctccccgcggtggcggccgctctagaactagtggatcccccgggctgcaggaattcgtctcacccctagaaaaaattcaccgtccacgttccatatggcttcctgcaggatggcactcctccttggcttgctgctgctagtagtagcttcgcccgcgatcgctgatgacgactccggtatctactaccagctggctcttatgtggcccaggagcatactgcgagcagaaccagcgctggggtgctgcaaagccgaacaacgggggtctcggcggcgcgcgacttctaaataacgggctcaccgtccttaacgcgacaccgacctgcgtgacgggatggacaaaaaagtcctttcgaccctacctgattccgggttccagggctgaaatattacggagannnnaaannntcttccnggggtggcccccaaacacgggaaaaaactgggaaaaacccctgaaaaaagcccggcccccttcccgccctccccaaaaaaaaaaatttggaaaagcccccctccttctcgagaggggaaaaaagcaactttgtttccccctaaaaaaaaagtgttttgggggggattttttgggtccttcgcccccaga

SEQ ID NO: 72488 - protein, 65 aa, Zea mays
  misc_feature: Ceres CLONE 1555659
MASCRMALLLGLLLLVVASPAIADDDSGIYYQLALMWPRSILRAEPALGCCKAEQRGSRRRATSK

SEQ ID NO: 72489 - DNA, 679 bp, Zea mays
  misc_feature: Ceres CLONE 1555680
  misc_feature: Encodes the peptide sequence at SEQ ID NO. 72490
aagctggagctccccgcggtggcggccgctctagaactagtggatcccccgggctgcaggaattcgtctcacccctagaaaaaaattctaaacttctgatcagcagaatccagcatctgtttttctcaaactgttatgcttttagatcgcgggtacttgttagtatccatgcacagcacacagtgtggccgtgtggtgaacaaatctcttttcagatttgcactcagctcatcgtgtgtggtgtacctaattaagctttcgtttcttttctgtattctttctttccttttttataagggtgctcctgttaaatcggttgaaacaaaagcgacatcattggttattagcaaatcctggagaatgcatgcaagttcttctttatttgtatcactatctcttagcacagttctctaactttcgatgcacgtacaagtctatttttttataaaaaactatctatatatgggggcacacaaaattatgtggacgtgtgcatcaaccatcacatgttgttatgcctgatgtcctgtggattggtgttcgatctcgtgaattcgagctgttctccatttctcctgcatggcagatatactagacatttggaactattatttttgcagctacatatataccaactgacagacatttggaactgttttttgtgtgtgttcaggttact

SEQ ID NO: 72490 - protein, 57 aa, Zea mays
  misc_feature: Ceres CLONE 1555680
MLLCLMSCGLVFDLVNSSCSPFLLHGRYTRHLELLFLQLHIYQLTDIWNCFLCVFRL

SEQ ID NO: 72491 - DNA, 673 bp, Zea mays
  misc_feature: Ceres CLONE 1555687
  misc_feature (451)..(451): n is a, c, t, g, unknown, or other
tggagctccccgcggtggcggccgctctagaactagtggatcccccgggctgcaggaattcgtctcacccctagaaaaaagctgcctgcctcggcacgcgctcgcgccctggtgactggtgaacactgaggactggaggcggtgggcgcggcgggtccagccaccgcgcggttcacggcgcgggcgaatgccggccgtttcaacggcgggcggatcggcctgttcccctggcgctgctggcccccctgggcggtgactgcgaggcccgatcctgaggcgggcggcgactccgagagggcggttggctggttttcttgccaagtgccagtcagtctctctcgtctcggcgacgccgcgcgaaggtcggaactcggaatcctcttcccggcgtcgtcatcccacccccgtcggttcccttctaactcctggctcctggggccgccgccgagcncgaggagaggcgcacgcgcctcgggaatggagctggcgcctccgctccgcctacgggatccgagcctgggatggcttcctgcaacttgcgcaggactcaagtgtgatgaactgatggggactcttggactataactggtttcctcttattcttccagccaatcctgacaaatgtggcatctcaagctgatagctttaatttatggctctcttttctttatgc

SEQ ID NO: 72492 - DNA, 661 bp, Zea mays
  misc_feature: Ceres CLONE 1555690
  misc_feature: Encodes the peptide sequence at SEQ ID NO. 72493
ctggagctccccgcggtggcggccgctctagaactagtggatcccccgggctgcaggaattcgtctcacccctagaaaaaaccatacctgaaacttcactgcctttttaattgtcaggcacactggtctggaaatcagtagcctgttggctgctgttgctattaatcagttgggagagagggagatggccaggaggaacatcggagtcgcagtggacttctcgtcgtgcagcaaagcggctttgcggtgggcgtcgacgaaccttgccaggaacggcgacaggctcatactcatccacgtgaacagctcctgccagaacgagcggggcgccgttcatctctgggagcagagtggttccccattgatccctctggccgagttttcagacgtcgccaggacatacggtgtgtcaccggacaaggagacgatcgagatcctcactcaagcggcaaaccatagagggatcgaagtctttgcaaaggtgttctacggcgacccagcaaagaagctctacgaagcagccgacctggtcccgcttagctgcatgtccgtcgggagcagaggactaagcacgctcaagaggtaacatgcgagggagctcggtccctctgatttacggcccaaaagcttctgcactccaaatcgttgccgacctgcccta

SEQ ID NO: 72493 - protein, 133 aa, Zea mays
  misc_feature: Ceres CLONE 1555690
MARRNIGVAVDFSSCSKAALRWASTNLARNGDRLILIHVNSSCQNERGAVHLWEQSGSPLIPLAEFSDVARTYGVSPDKETIEILTQAANHRGIEVFAKVFYGDPAKKLYEAADLVPLSCMSVGSRGLSTLKR

SEQ ID NO: 72494 - DNA, 694 bp, Zea mays
  misc_feature: Ceres CLONE 1555697
  misc_feature: Encodes the peptide sequence at SEQ ID NO. 72495
ctggagctccccgcggtggcggccgctctagaactagtggatcccccgggctgcaggaattcgtctcacccctagaaaaaacccagcaccgcagagctctcatcctctctctctctctctttctcgcgctcgctttgcttcctcgtcgaggtccaagttcctgcattgatggcgaccgaggtggctgagactcccgcgccgttggcggaggcggtccccgagacccccgcggaggcaccggcggcgcccgccgccgaggcgaagcctaccaaggccaagaaggcctctgcgcccaagaagcgtgccaacccgacccacccgccgtacgccgagatgatctcggaggctgtcacgtcgctcaaggagcggacggggtccagccagtacgcgatcgccaagttcgtcgaggacaagcacaaggacaagctcccgcccaacttccgcaagctcctgctcggccagctcaagaagctcgtcgccggcggcaagctcaccagggtgaagactccctacagctgcccgcaggcgcccgggcccgcggcaagccgaggccccagtccaagaccgcttgtgaggaaccccaagggcggtgcccagaagccaagggcgccacccaagcccaggcgaaaccccaagggcaagtccccccgccaggggaaaacccccccccaaaaccccagggaccccccaaaac

SEQ ID NO: 72495 - protein, 175 aa, Zea mays
  misc_feature: Ceres CLONE 1555697
  misc_feature (49)..(119): Pfam Name: Linker_histone Pfam Description: linker histone H1 and H5 family
MATEVAETPAPLAEAVPETPAEAPAAPAAEAKPTKAKKASAPKKRANPTHPPYAEMISEAVTSLKERTGSSQYAIAKFVEDKHKDKLPPNFRKLLLGQLKKLVAGGKLTRVKTPYSCPQAPGPAASRGPSPRPLVRNPKGGAQKPRAPPKPRRNPKGKSPRQGKTPPQNPRDPPK

SEQ ID NO: 72496 - DNA, 504 bp, Zea mays
  misc_feature: Ceres CLONE 1555702
  misc_feature: Encodes the peptide sequence at SEQ ID NO. 72497
  misc_feature (295)..(295): n is a, c, t, g, unknown, or other
tggagctccccgcggtggcggccgctctagaactagtggatcccccgggctgcaggaattcgtctcacccctagaaaaaagctccgcctccctttcctaccttcttccctccgtctcccagctcgcgcaggcaggcgacacagcgacgctaaaaaccctagagcgaggaggcgtgccaggccagcggtttgcgatgacggcaccggcggacaaggggaagaaggccaagaccgatgccgacggcggcgaggagaacgagcaaatcgacggcgcccttgtcttctccatcgagaangctccaggagattcaggacagctcgagaagttaatgaggaagcagtgacagttatgaggtggacagaatacgtgagattcgcagactgtctatctcagagggtgacatatcagacatccggacttttgctcacagcgttttgagcatcctctactagtgagcttctgactgaagggatcagaagatatcaagtacttggactccattga

SEQ ID NO: 72497 - protein, 49 aa, Zea mays
  misc_feature: Ceres CLONE 1555702
  misc_feature (34)..(34): Xaa is any aa, unknown, or other
MTAPADKGKKAKTDADGGEENEQIDGALVFSIEXAPGDSGQLEKLMRKQ

SEQ ID NO: 72498 - DNA, 677 bp, Zea mays
  misc_feature: Ceres CLONE 1555706
  misc_feature: Encodes the peptide sequence at SEQ ID NO. 72499
tggagctccccgcggtggcggccgctctagaactagtggatcccccgggctgcaggaattcgtctcacccctagaaaaagcaactcgcaacacagacgccgccgcccaaagaaaagacgtcaactccaggagacaagacagtgagaactgaagagaaggatgggcttcgagaagcagatcctgagatccggcaccggccccaagccgataaagggccagaaggtcaccgttcactgcaccggctacggttcgcttcttcccttcacctccatagacctctgatttacttactacgttgttcttggatctgaatcactttagggtttagagttagatgctttcagatccattcgtgcagtagcctccatgtataagcggcgactcctttttcgtcggctttgatgcttgggatgcgatgttcagtcgtaggattgagatcggtctgatccagagttgcaagcggaccttgtgcactgcataattcgtttctcttcctttttgtattatatgactaacaccatctgatctgcagtagttgttcgctaacttttgcttgctgctctgggtttgttttcagggaaggatcgtgatctgtccaagaaattttggagcaccaaggaccctgggcagcagccattcagtttcagcattggtcagggttcagtgatcaaaggatg

SEQ ID NO: 72499 - protein, 40 aa, Zea mays
  misc_feature: Ceres CLONE 1555706
  misc_feature: SWISSPROT Homolog: EC 5.2.1.8 Peptidylprolyl isomerase
MGFEKQILRSGTGPKPIKGQKVTVHCTGYGSLLPFTSIDL

SEQ ID NO: 72500 - DNA, 566 bp, Zea mays
  misc_feature: Ceres CLONE 1555712
  misc_feature: Encodes the peptide sequence at SEQ ID NO. 72501
  misc_feature (382)..(382): n is a, c, t, g, unknown, or other
ctccccgcggtggcggccgctctagaactagtggatcccccgggctgcaggaattcgtctcacccctagaaaaaatgagtgaccaggtcacgtcacgaggagcggaacacacacacactcgggtttccgatggcggcggccgcaccaacacacgcgcccgtgtcctcctcagcgtgccgttcgggattctcctctagcgatgtatccttccccaattttcgctcggcggcggcttcggcccctgggtggcggcgcagggagccgtacccggcagtctccgtagtgtcgagctccccgcagtctgtgccaggagctataactgtcgacaccgaggttgacacattgctagacagtgtgaagtgggacagcaaagggttggctngtgccattgcacaaaatgtggatactggagccattccttatgcaggggttttgctaataaagaaagcccttgggaaaaccttttttccacccggaaagttcctttttttacccgttccgggtttcctgggggcaaaggggggaacccccaaaactcttaagggggggaaatttttcccaaaagg

SEQ ID NO: 72501 - protein, 145 aa, Zea mays
  misc_feature: Ceres CLONE 1555712
  misc_feature (85)..(85): Xaa is any aa, unknown, or other
MAAAAPTHAPVSSSACRSGFSSSDVSFPNFRSAAASAPGWRRREPYPAVSVVSSSPQSVPGAITVDTEVDTLLDSVKWDSKGLAXAIAQNVDTGAIPYAGVLLIKKALGKTFFPPGKFLFLPVPGFLGAKGGTPKTLKGGKFFPK

SEQ ID NO: 72502 - DNA, 684 bp, Zea mays
  misc_feature: Ceres CLONE 1555718
  misc_feature: Encodes the peptide sequence at SEQ ID NO. 72503
ggagctccccgcggtggcggccgctctagaactagtggatcccccgggctgcaggaattcgtctcacccctagaaaaaagccttatccccttcgtacaacactatcaccaggaattcccttgcctttgctcgttctcatggccgagcacaagtcttcctcaagcgtcgcctgctgtaccagtgtcgagctccccacgcccaccgctactcctagcccctctcctccctggatttcgcccagtctccatctctctttctagccatggacggcgacctctcctgcctacagcaggtcagcgccccatctcctcaacatctcggctccctgtcccatctctctcacgagccactcttctcgttctccatggcgtcgacatggggctcgcccctgcaacctcgcctcgctgggtttcctcagggcgccgggatgctgcttcctatacatcgtgcgactccctggtgcttgctctcgccctagtccatggagcagtagcagccacgacactccttcgtgtcgcgccctcgacgtgttcgatgaaatactgcagcgagctccaactcgatctgcacagcccctgcgcgacgtcacaaactccgctcgttgtcgatgtcgtgcttcgggcatcgcgtgttcgacgaaaatcccaagtccatggacagcacatgcacaactcaaatccgatc

SEQ ID NO: 72503 - protein, 228 aa, Zea mays
  misc_feature: Ceres CLONE 1555718
GAPRGGGRSRTSGSPGLQEFVSPLEKSLIPFVQHYHQEFPCLCSFSWPSTSLPQASPAVPVSSSPRPPLLLAPLLPGFRPVSISLSSHGRRPLLPTAGQRPISSTSRLPVPSLSRATLLVLHGVDMGLAPATSPRWVSSGRRDAASYTSCDSLVLALALVHGAVAATTLLRVAPSTCSMKYCSELQLDLHSPCATSQTPLVVDVVLRASRVRRKSQVHGQHMHNSNPI

SEQ ID NO: 72504 - DNA, 695 bp, Zea mays
  misc_feature: Ceres CLONE 1555719
  misc_feature: Encodes the peptide sequence at SEQ ID NO. 72505
aaagctggagctccccgcggtggcggccgctctagaactagtggatcccccgggctgcaggaattcgtctcacccctagaaaaagcacacggcttttggcagctacaaaccacccaaaagccacccccagaaaccggcggtccttgggtgttccggatctgagccagcagctgagaagaggatgagcgccgtggccgccatggcgacgtcgtcgctgaaccccaacgcgccgctcttcatcccggcggcgtaccggcaggtggaggaattctcgcccgagtggtatgagctcgtcaacaccaccgcctggttccgggaccactggttccgccagcaccagcaccacgaggccgccttcgccgccgccgccgacgccgagctcgacgtcgccgcgctcctccccgacgactccgtcgacctcctcgacaccgacgacctcttctacgcgcctgacgtccaccacccccacaacgccaaagcggggctgctgcccggggtacaacctccacatggtcagggcgcttgagcttcaactccccccggggccgccgcccggcccttccccttcccggttggttgcgcccccagcagcaaaaggccgcggaaaggcccgggcccccacccccggggggcccccgcgccccggtttttaatcaaccaacctttgttaaaaacacaccccggctcatgggggg

SEQ ID NO: 72505 - protein, 114 aa, Zea mays
  misc_feature: Ceres CLONE 1555719
MSAVAAMATSSLNPNAPLFIPAAYRQVEEFSPEWYELVNTTAWFRDHWFRQHQHHEAAFAAAADAELDVAALLPDDSVDLLDTDDLFYAPDVHHPHNAKAGLLPGVQPPHGQGA

SEQ ID NO: 72506 - DNA, 698 bp, Zea mays
  misc_feature: Ceres CLONE 1555724
  misc_feature: Encodes the peptide sequence at SEQ ID NO. 72507
aagctggagctccccgcggtggcggccgctctagaactagtggatcccccgggctgcaggaattcgtctcacccctagaaaaaacccacgatggggctcaccaccgcctccacggtactcctctgcctcccgaatcatccgccgctctctcttcttctcaagactgtcgccgcccttcctcgctcctacatctcgccccgcgccgaggacccggggattccgcgcgcgcctgtagctggcaccggctcgttgtgcgccggatgggctgggcggcgcaagcgctcctcggcggattatgcggacgccggcgccagtgagagctactaggaggaggagcacgtcctactagtggggcagcgggagggcgagatcgacgacgccgtggagctctccgcggcggtcgttgggccagatagatgggacgtgctgggcctcggccaggcgatcgttgacttctcgcggatggtggatgacgagtgccttgacggattgggcatatagaagggcacgagaaacgtcttaaaccatgatgagaggggacgggtcttgcatgccatggatggatgcagctacaatgctgcagctggatgctccctgtccaactcggtcgttgagctggctaggcttggtatgctcctagtctgctagctaccctgagcttaatattgtgatgggctgacagtgctgggcagtcgacc

SEQ ID NO: 72507 - protein, 30 aa, Zea mays
  misc_feature: Ceres CLONE 1555724
MDGCSYNAAAGCSLSNSVVELARLGMLLVC

SEQ ID NO: 72508 - DNA, 644 bp, Zea mays
  misc_feature: Ceres CLONE 1555731
  misc_feature: Encodes the peptide sequence at SEQ ID NO. 72509
  misc_feature (158)..(158): n is a, c, t, g, unknown, or other
  misc_feature (163)..(163): n is a, c, t, g, unknown, or other
  misc_feature (165)..(165): n is a, c, t, g, unknown, or other
aaagctggagctccccgcggtggcggccgctctagaactagtggatcccccgggctgcaggaattcgtctcacccctagaaaaaaacttgcgtagagagttgggcgcagagaatccccaagcaaacaaacagggtagagggagaggagaggagagganagganangagaggttgggtctgggacaccatggctccgatgaagctgtacggggcggtgatgtcgtggaacgtgacgaggtgcgcaacggcgctggaggaggctggctccgactacgagatcgtgcccatcaacttcgccaccgccgagcacaagagccccgagcacctcgtccgcaacccgtttgggtcagttccaactctgcacgattgtgactttgtactctttcaatcaccagcaatcttccagttcgcttctctccaaaacaagcccgagctgttttaggaaaggaacctctaggaggccgccattgttggttttttgatctaggtggaggcttatcagtttaccgctttactgtaaccccttctctttccggttctctttatttccattcttttggggaaccccccacccaaaagttgttggtttgaaacttttggaaactttaaaaattgcttttagtgtttaaggcacccttttacga

SEQ ID NO: 72509 - protein, 84 aa, Zea mays
  misc_feature: Ceres CLONE 1555731
  misc_feature (2)..(77): Pfam Name: GST_N Pfam Description: Glutathione S-transferase, N-terminal domain
  misc_feature: SWISSPROT Homolog: EC 2.5.1.18 Glutathione transferase
MAPMKLYGAVMSWNVTRCATALEEAGSDYEIVPINFATAEHKSPEHLVRNPFGSVPTLHDCDFVLFQSPAIFQFASLQNKPELF

SEQ ID NO: 72510 - DNA, 1185 bp, Zea mays
  misc_feature: Ceres CLONE 1555733
  misc_feature: Encodes the peptide sequence at SEQ ID NO. 72511
aaccgcgccacgcagtaaacgaaaagacgggcccactccctcaatcctccgcacgccccttccatggggcagccgcacctcttgccgcagctctccccctccccggtcctctactccctcttctcgccgccggagacgggggccacgccctggcggcggccgctgaaccggggacgggccttccaaccgccgctctcctcgctgcgggagaccaacaaggccacgctccgcaaggccacgcccaacgcccccttccgcctcggcggtggcgggggcggcagccccaaggatcgccgccccgccgccgacgacaaggaggacgaggacgagggtcgcggcggcgccggggcactcacagggacgctgatcgcaggagcattactggttggtttcgtaggggggtttggggcggccggttacgtgtacaaggaccagatcaacaccttcctcacgcagttctcggggttccttgacggctatggtccagccggatatgctctgttcgtacttgtatatgcagggttggaggttctcgcaattcccgcaatacctttaaccatgtcagctggtctattatttggtaatgtgactggtacaattattgtttcagtcggtggaacgctagctgcagcggtggccttccttattgctagatactttgccagagagagaattcttaaattggttgaaggaaataagaagtttctggcaattgataaggcaataggtgaaaatgggtttaaggttgttactttgctacgcttgagtcccctgttacctttctcccttgggaactatctatatggccttacttcagtgaagttcttgccgtatgtcttgggcagttggttgggaatgcttccaggttcatgggcttacgtcagtgccggtgcattcgggcgagctttaatccaagatgagtcggaaattggtttgggaggaaacgaacagctatggacactgggcgttggattattgtttacagccattgctgccgcttatgtaacgaggctcgcaaaggacgctgtaaaggagatcgacgactagaatggtaggattctctaggagaaagggccatctggatagtgtactagcctagcacattgtacatcactggcacctttggtgcgataaaatcttatagaaagccagagcaattttatgaggtgaaaaaaaaaaaaaaaa

SEQ ID NO: 72511 - protein, 327 aa, Zea mays
  misc_feature: Ceres CLONE 1555733
  misc_feature (159)..(278): Pfam Name: SNARE_assoc Pfam Description: SNARE associated Golgi protein
MGQPHLLPQLSPSPVLYSLFSPPETGATPWRRPLNRGRAFQPPLSSLRETNKATLRKATPNAPFRLGGGGGGSPKDRRPAADDKEDEDEGRGGAGALTGTLIAGALLVGFVGGFGAAGYVYKDQINTFLTQFSGFLDGYGPAGYALFVLVYAGLEVLAIPAIPLTMSAGLLFGNVTGTIIVSVGGTLAAAVAFLIARYFARERILKLVEGNKKFLAIDKAIGENGFKVVTLLRLSPLLPFSLGNYLYGLTSVKFLPYVLGSWLGMLPGSWAYVSAGAFGRALIQDESEIGLGGNEQLWTLGVGLLFTAIAAAYVTRLAKDAVKEIDD

SEQ ID NO: 72512 - DNA, 693 bp, Zea mays
  misc_feature: Ceres CLONE 1555734
  misc_feature: Translation starting site: 178
ggagctccccgcggtggcggccgctctagaactagtggatcccccgggctgcaggaattcgtctcacccctagataaagtgctttctttcaggtgggttggcttctcctccccctccggttctggttcgggttcttgaggttctccaggggtcaggttctggggtgaccggatttagatggctgggtccgatgttgcatatcgctgcttcgtctgctgcctcacatgggccacggactaccacttcctccacaatgccttcaccaccatagcggcaaggtcctcgagtccaagatcatcctcgatcagtacacgcagaagttccgcggcttcagcttctttttcttctccacagaggaagctatgcgaaatcccttctagggcatgaaaagcaaccgactggacggtcactgcttctccgtctacgaagcccagtcccccatcagacaaggaggactccgcggtggatacggagagtgacctttaacgcggcgattacccactacgtgaaccctctgattgatctagcttttacgggtctagctgccgttacggtgtcaacggcaactatagaggtagtcgccgatttctaggttgacgcaaaaatgccggcaactacggcaactccgacgggaactgaacgaactgagcggtcgctaccgcgctggcaagtgatcctgtccccctccgcgaa

SEQ ID NO: 72513 - DNA, 677 bp, Zea mays
  misc_feature: Ceres CLONE 1555744
  misc_feature: Encodes the peptide sequence at SEQ ID NO. 72514
  misc_feature (608)..(608): n is a, c, t, g, unknown, or other
atagctggagctccccgcggtggcggccgctctagaactagtggatcccccgggctgcaggaattcgtctcacccctagaaaaagtgctctctcagaggtgggctggcttctcctccccctcttaccaagtcctcttcgggttagggttacttagggttttgtggaggggcgatggcggcggctgatgtggagtaccgttgcttcgtcggcgggcttgcctgggccaccagcaacgagtcgctggagaatgccttcgcctcctacggcgagatcctcgactccaaggtttgcttcgtcctcgctaggtttcattccgcggtctgtttgtgccgttggggctagatccgggtcgtggttcaacagatctgcttcgttttggtacagatctgcgttcgctcgaatcgagcatgacgttttcatgtgattatgcaggtcatcaccgaccgggagacggggaggtctcgcggcttcggcttcgttaccttctcctccgagaactccatgctcgacgctatcgagaacatgaacggcaaggagctcgacggccgtaacatcaccgttaaccaggcccagtcccgtggcggtggcggtggcggcggtggctacngcggcggtcgcggcggcggcggctatggtggcgggcgccgtgacggcggttatggcggcggtggcggct

SEQ ID NO: 72514 - protein, 83 aa, Zea mays
  misc_feature: Ceres CLONE 1555744
  misc_feature (1)..(45): Pfam Name: RRM_1 Pfam Description: RNA recognition motif. (a.k.a. RRM, RBD, or RNP domain)
  misc_feature: SWISSPROT Homolog: EC 5.2.1.8 Peptidylprolyl isomerase
  misc_feature (61)..(61): Xaa is any aa, unknown, or other
MQVITDRETGRSRGFGFVTFSSENSMLDAIENMNGKELDGRNITVNQAQSRGGGGGGGGYXGGRGGGGYGGGRRDGGYGGGGG

SEQ ID NO: 72515 - DNA, 675 bp, Zea mays
  misc_feature: Ceres CLONE 1555745
  misc_feature: Encodes the peptide sequence at SEQ ID NO. 72516
ctggagctccccgcggtggcggccgctctagaactagtggatcccccgggctgcaggaattcgtctcacccctagaaaaaatccccaaccagatccccccgcttctcccgcaaccgcgtcggcgatggcatccgcggcggcgacgaccggcgacggcgagaaggcgcacgcgcacctagggcagcctctcctcgtgccgccgcagccccctcagcaaccctactacgcctacccggccgcctcctacgtgcaggtgcagcccgccccgccgccgccgccgcccccgacgctcgtcttcgtcccgtccccctgctccccggtgctcgtccgcctccgccgcctgcgcccgcgccgcgcgtcctgcctccgccgattctgcgcgcgcgggctcccgctcctcctcttcctcgggctcctcgcggggctcgccttcctcctctacccgtacgcccccgccgcccgcgtcgccgacctccgtgtcgactgctgccgagcgcagcctcccgtcctcggcctcggcctcgcgctgcggctccgcgtcgtgaaccccggcttcgtcctccagctccgctagcgcgcggtctccgccgccgtctcctacagaggacacctgctcggggccgccagagcgtgagaccggtccggagagcttgctgccacgcatgaggtctatgc

SEQ ID NO: 72516 - protein, 149 aa, Zea mays
  misc_feature: Ceres CLONE 1555745
MASAAATTGDGEKAHAHLGQPLLVPPQPPQQPYYAYPAASYVQVQPAPPPPPPPTLVFVPSPCSPVLVRLRRLRPRRASCLRRFCARGLPLLLFLGLLAGLAFLLYPYAPAARVADLRVDCCRAQPPVLGLGLALRLRVVNPGFVLQLR

SEQ ID NO: 72517 - DNA, 691 bp, Zea mays
  misc_feature: Ceres CLONE 1555771
  misc_feature: Encodes the peptide sequence at SEQ ID NO. 72518
tggagctccccgcggtggcggccgctctagaactagtggatcccccgggctgcaggaattcgtctcacccctagaaaaaactgctccaccgagctgagcctgagcgcgagcctccgtccgaagtccaaataatcttcagctctcctcgacgcatgcccggatcgatcggtccagttctacccgccggaggaggaggaggaggaggcagatcgaccggcagctgactaaggtggatccacggaggaggcatggcaagaggcccctacccgccgccgagggtggaagaggaggaggaggaggaggcgctgcccccgggcccgccgcccgcaaagcacgagcagctggaggagcctcaccacgccgccgtctcgcagctgcaaggagccacctttagcggcggcggagggtcgtcgtcgtcttccgtgatcggtggcccgtcgccgccgcaggcgtacgcgcagtactactactcggcgcgcgccgacaacgacgcctccgccgtggcctccgcgcttgcccacgtcatccgggccttgcctgaccagcttccgccgcagcaggtgccggccttgtacggcgccggcgtcccgggcagccttcggctgggagaccacccgcaagcgtctgcgcaccactatcccggtcccgggcgccacgtcgccgcccccgaggaggaacaaagtcggaagcg

SEQ ID NO: 72518 - protein, 147 aa, Zea mays
  misc_feature: Ceres CLONE 1555771
MARGPYPPPRVEEEEEEEALPPGPPPAKHEQLEEPHHAAVSQLQGATFSGGGGSSSSSVIGGPSPPQAYAQYYYSARADNDASAVASALAHVIRALPDQLPPQQVPALYGAGVPGSLRLGDHPQASAHHYPGPGRHVAAPEEEQSRK

SEQ ID NO: 72519 - DNA, 690 bp, Zea mays
  misc_feature: Ceres CLONE 1555773
  misc_feature: Encodes the peptide sequence at SEQ ID NO. 72520
ctccccgcggtggcggccgctctagaactagtggatcccccgggctgcaggaattcgtctcacccctagaaaaagccgtctcctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagacccgcgtcctcatcgagaccctcaccgcgctcggcgccgaagtccgctggtgctcctgcacatctttctcacgcaggaacacggcgcccgcgccatcgggcgcgactcggccgcgtgttcccctggaaggggaaaaccctggagaagtctgggtggtgcaccaaccccgccctgactggggcaaagggggggggccccaacctattttttaaaaaaggggggaaacccaccttgtttttccaaaaagggtttaaggcccaaagaaaaattccaaaaaaacccgggaaaaccccccccccggggtcccccccacaccccggtattttaaaaatccgggcccc

SEQ ID NO: 72520 - protein, 136 aa, Zea mays
  misc_feature: Ceres CLONE 1555773
  misc_feature (12)..(136): Pfam Name: AdoHcyase Pfam Description: S-adenosyl-L-homocysteine hydrolase
  misc_feature: SWISSPROT Homolog: EC 3.3.1.1 Adenosylhomocysteinase
MALSVEKTSSGREYKVKDLSQADFGRLEIELAEVEMPGLMACRAEFGPSKPFAGARISGSLHMTIQTRVLIETLTALGAEVRWCSCTSFSRRNTAPAPSGATRPRVPLEGENPGEVWVVHQPRPDWGKGGGPQPIF

SEQ ID NO: 72521 - DNA, 673 bp, Zea mays
  misc_feature: Ceres CLONE 1555778
  misc_feature: Encodes the peptide sequence at SEQ ID NO. 72522
  misc_feature (522)..(522): n is a, c, t, g, unknown, or other
  misc_feature (536)..(536): n is a, c, t, g, unknown, or other
  misc_feature (578)..(578): n is a, c, t, g, unknown, or other
  misc_feature (591)..(591): n is a, c, t, g, unknown, or other
  misc_feature (596)..(596): n is a, c, t, g, unknown, or other
ctggagctccccgcggtggcggccgctctagaactagtggatcccccgggctgcaggaattcgtctcacccctagaaaaaaccaccgcatcccacaccccccgagctcagcttagctccactccagctccaatcacagtcgtgaccagagcgcgagagctagctagagggccgtgaaaatgccgatcaataggatcgccctggggagccaccaggaggtgtaccacccgggcgccctcaaggcggcgttcgctgagttcatctccaccctcatcttcgtcttcgccggccagggctccggcatggccttcagcaagctgaccggcggcggcccgacgaccccggcgggcctgatcgcggcggcggtggcgcacgcgttcgcgctgttcgtggcggtgtctgtgggcgcgaacatctccggcgggcacgtgaaccctgccgtgaccttcggcgccttcgtgggcggcaacatcaccctgttccgggggctcctgtactgggtggcgcagctgctgggggtcanccgtggcgtgcttncctgctcgcttctcgacgggcgggcagggcacgggcaccttncggctgacgggcnggtcngtgtgggaggggctggtgctggaaatcctgatgaccttcgggctggtgtacacggggacgcccacggcggtgaacca

SEQ ID NO: 72522 - protein, 165 aa, Zea mays
  misc_feature: Ceres CLONE 1555778
  misc_feature (13)..(163): Pfam Name: MIP Pfam Description: Major intrinsic protein
  misc_feature (115)..(115): Xaa is any aa, unknown, or other
  misc_feature (120)..(120): Xaa is any aa, unknown, or other
  misc_feature (134)..(134): Xaa is any aa, unknown, or other
  misc_feature (138)..(138): Xaa is any aa, unknown, or other
  misc_feature (140)..(140): Xaa is any aa, unknown, or other
MPINRIALGSHQEVYHPGALKAAFAEFISTLIFVFAGQGSGMAFSKLTGGGPTTPAGLIAAAVAHAFALFVAVSVGANISGGHVNPAVTFGAFVGGNITLFRGLLYWVAQLLGVXRGVLXCSLLDGRAGHGHLXADGXVXVGGAGAGNPDDLRAGVHGDAHGGEP

SEQ ID NO: 72523 - DNA, 664 bp, Zea mays
  misc_feature: Ceres CLONE 1555779
  misc_feature: Encodes the peptide sequence at SEQ ID NO. 72524
ggagctccccgcggtggcggccgctctagaactagtggatcccccgggctgcaggaattcgtctcacccctagaaaaaaaccaaatcccccctcccctcgcttccacaccttccgcctcgtctccctctctctctgtctctctctctctctcacacacacacacgcatcaggtcgggacgggaggggaggtctcgtgcgcgcccggctttcctctcctctcctcgccgcacgacgcgcgcgcggtcccggtcgccgatggccaaggcacgcaggccgccgttcgccgccgccgagcggttcctcggcttcccccgcggcgggccctcgccgggggccgtggcgccggcgcccgccgccctcgacgacctgccggacctcgccgaggccgacgtctggtactcggctgccgacccgggtagcccgtatcccgcggcgtcccgacatgcggcggcggagggcaggagcgcaggccagcgcggcccgcggcgcggcgtgcagggcggcctgagccgggcgttcggggacgggtccgggtccgggtccgggcggcaggcggcggcgtcggcgcccgtcgaggtggccgcgtggccggcccgcgtctccgtgccggacgcggagccgacgctgctgttcgagatggagatgggggaccacgacgacggg

SEQ ID NO: 72524 - protein, 136 aa, Zea mays
  misc_feature: Ceres CLONE 1555779
MAKARRPPFAAAERFLGFPRGGPSPGAVAPAPAALDDLPDLAEADVWYSAADPGSPYPAASRHAAAEGRSAGQRGPRRGVQGGLSRAFGDGSGSGSGRQAAASAPVEVAAWPARVSVPDAEPTLLFEMEMGDHDDG

SEQ ID NO: 72525 - DNA, 681 bp, Zea mays
  misc_feature: Ceres CLONE 1555783
  misc_feature: Encodes the peptide sequence at SEQ ID NO. 72526
  misc_feature (463)..(463): n is a, c, t, g, unknown, or other
  misc_feature (483)..(483): n is a, c, t, g, unknown, or other
  misc_feature (518)..(518): n is a, c, t, g, unknown, or other
  misc_feature (542)..(542): n is a, c, t, g, unknown, or other
  misc_feature (564)..(564): n is a, c, t, g, unknown, or other
  misc_feature (565)..(565): n is a, c, t, g, unknown, or other
  misc_feature (576)..(576): n is a, c, t, g, unknown, or other
agctccccgcggtggcggccgctctagaactagtggatcccccgggctgcaggaattcgtctcacccctagaaaaagcagagaattaagccaacggaaaaaaaagaagagagctactacagcaatggccggaggagatgacctgaagctgctgggcctgtgggcgagcccgtacgtgctgcgggtgaagctcgcgctcagcctcaagggcctgagctacgagtacgtggaggaggatctgagggacaagagcgagctcctgctcaagtccaaccccgtccaccagaaggtccccgtgctgatccacgacggcaagcccgtctgcgagtcgcagatcatcctgcagtacatcgacgaggctttcgccggcaccggcccgtccctcctccccgccgacccctacgagcgcgccgtcgctcgcttctgggccgcctacatcgacgacaagatgctgcccgcctggnaacagtcgagatggggcaangacggaagaggagagggctgaagggaaagaaacantcggtcgtgacggtggagacgctngagggcgcgctgagggactgcnngcgcccaaggnaagcctttcttcgtgggggacaggtcgggttacttcgacttctggttcggcggcctgctttggtgggtggcccccttccgaaggacttcacaggtttcggccttt

SEQ ID NO: 72526 - protein, 126 aa, Zea mays
  misc_feature: Ceres CLONE 1555783
  misc_feature (5)..(78): Pfam Name: GST_N Pfam Description: Glutathione S-transferase, N-terminal domain
  misc_feature: SWISSPROT Homolog: EC 4.4.1.5 Lactoylglutathione lyase
  misc_feature (114)..(114): Xaa is any aa, unknown, or other
  misc_feature (120)..(120): Xaa is any aa, unknown, or other
MAGGDDLKLLGLWASPYVLRVKLALSLKGLSYEYVEEDLRDKSELLLKSNPVHQKVPVLIHDGKPVCESQIILQYIDEAFAGTGPSLLPADPYERAVARFWAAYIDDKMLPAWXQSRWGXDGRGEG

SEQ ID NO: 72527 - DNA, 1006 bp, Zea mays
  misc_feature: Ceres CLONE 1555799
  misc_feature: Encodes the peptide sequence at SEQ ID NO. 72528
aaaagcgtcccctcaacatttcagtgtgtgccaagaagttctcaggctcaaactgagcaatggcagctcagtttgcagcggcaacagcagtcttcctgagctgccttcttgctcttgcagcacttgcaagctgcaacactgaaggtgacatcctgtacaaacaaagggcgacatggaaggacccaaacgatgtgctcgtgagctgggatccgactcttgccaatccctgcacctggctccatatcacttgcaacaacgacaacagtgttattcgtgtagatttggggaacgcaggcttatcaggcactctgattccagatttgggaggactgcagaacctccagtacctgatgttgtatgggaacaatctgacagggcccatacctgaatctctgggcaatttgacgagccttgagaggctggagcttcagaggaatgcgctgagcggtgcaatcccatcctctctcgggaacatcaaaacattgcagttcatgaagttgaacgcgaatatgctgaccggcacggttccattggaagtcctctctcttgtcattgctgggaatctgaccgagctaaatattgcaaacaacgacttggccggcacagtcagatcatctggtttgagagtgactgcaatcatccaggacaagctgaagactacatgatgagtccctgggtgtggacattggctttcttcatgacaatgtttgacaaaaaaaatagtaaataaataaatccagtgacatggattgatctagacatcttgtagtatgatgatatggctgctggataaattctattcttctccgatttttccctcgagcagcattagctaatgagaatatatggggcgtcactgtgctagagaaaaaaattgtacccagttttcttttttatgtaagttcttactttacataaatttctatagattattgaaacatcatgacgtatgacatatttatattaatgataccactataaacacttctttcaaaaaaaaaaaaaa

SEQ ID NO: 72528 - protein, 201 aa, Zea mays
  misc_feature: Ceres CLONE 1555799
  misc_feature (25)..(65): Pfam Name: LRRNT_2 Pfam Description: Leucine rich repeat N-terminal domain
  misc_feature: SWISSPROT Homolog: EC 2.7.11.1 Non-specific serine/threonine protein kinase
MAAQFAAATAVFLSCLLALAALASCNTEGDILYKQRATWKDPNDVLVSWDPTLANPCTWLHITCNNDNSVIRVDLGNAGLSGTLIPDLGGLQNLQYLMLYGNNLTGPIPESLGNLTSLERLELQRNALSGAIPSSLGNIKTLQFMKLNANMLTGTVPLEVLSLVIAGNLTELNIANNDLAGTVRSSGLRVTAIIQDKLKTT

SEQ ID NO: 72529 - DNA, 689 bp, Zea mays
  misc_feature: Ceres CLONE 1555800
  misc_feature: Encodes the peptide sequence at SEQ ID NO. 72530
atagctggagctccccgcggtggcggccgctctagaactagtggatcccccgggctgcaggaattcgtctcacccctagaaaaaaccgtccacctcagctcccatatccgctcccctacctctccagcatctcccgtctccgtcgtctcgtctctgctcctcacctcgccgccagccatgggcaagatcaagatcggaatcaacggtttcggaaggatcggcaggctcgtggccagggtcgccctgcagagcgaggatgtcgagctcgtcgccgtcaacgaccccttcatcaccacggattacatgacctacatgttcaagtacgacaccgtgcacggccaatggaagcacagcgacatcaccctcaaggactccaagacgcttctcttcggcgagaagccggtcaccgtctttggcatcaggaaccccgaggagatcccgtggggtgaggctggtgctcactatgtcctggagtccaccggtgtcttccctgacaaggacaaaggtgctgcacatctgaagggcggtgcccagaaggttgttatctctgcccccagcgaagatgcgcccatgtttggtgttgggggccatgaggacaaagacgcctcccatgttaacaatgtgttcaatggctagcggcccaaagaagggtgttggtcgcgtgggtaggtgatgtctgaacactttgg

SEQ ID NO: 72530 - protein, 152 aa, Zea mays
  misc_feature: Ceres CLONE 1555800
  misc_feature (4)..(146): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGQWKHSDITLKDSKTLLFGEKPVTVFGIRNPEEIPWGEAGAHYVLESTGVFPDKDKGAAHLKGGAQKVVISAPSEDAPMFGVGGHEDKDASHVNNVFNG

SEQ ID NO: 72531 - DNA, 688 bp, Zea mays
  misc_feature: Ceres CLONE 1555807
  misc_feature: SWISSPROT Homolog: EC 3.5.2.6 Beta-lactamase
tggagctccccgcggtggcggccgctctagaactagtggatcccccgggctgcaggaattcgtctcacccctagaaaaagaactcgtcgggttacatggaggctccatcttctaaacgctcccgacttcttgcgggttctgccaccacccgcccaactgctcctgctgactccaaatggctagccaatgcttcacagatccaacatcacctggtggctccattgggttaattccaactggaaatcatgtgctgtaagattcttgagagttttccccactgagaacattttctaatgaagagcacttttaaagtactgctatgtgtctaggaattatccagtattgacgcccggcaagagtaactcggtcgcctgatacactattctcacaatgacttggttgagtactctccagtcacagaaaaccatcttatggatggtatgacagtaagacaattatgtagtgctgccataaccatgagtgataacactgcggccaacttacttctgactacgataggaggaccgaaggagctaactgcttttttgcacaacatgggggatcatgtaactctacttgatctttgggaaccggagctgaatgaagacgtacctgatcaccagcgtgacaccactatgcctgtagcaatggcaacatcgttgctctaactattaactggcggactgct

SEQ ID NO: 72532 - DNA, 679 bp, Zea mays
  misc_feature: Ceres CLONE 1555810
  misc_feature: Encodes the peptide sequence at SEQ ID NO. 72533
ctggagctccccgcggtggcggccgctctagaactagtggatcccccgggctgcaggaattcgtctcacccctagaaaaaacttagctcttgtcctgctatgttttgtagaccagtgagcctagcagaaatcgattaaaataatacggagcagccaattgcactcgatcaatatcaatagaagtgacaactccatctctggtctcccagactcccacgcctataatctcattcccctccttcaaagccctctggcgatcgagattcttccccctccgtctccagatatggcaaacaaaaggattcagaaggaactcatggatctgcaaaaggacccaccgacatcatgcagtgcagggccagctggagaggatctattccactggcaggccacaatcatgggtcctagcgacagcccctatgcaggaggggttttctttgttaatatccattttcctcctgactacccgtttaagcctccaaaagtgaacttccaaacaaaagtttatcacccgaacatcaactctaacgggagcatctgccttgatatcctcaaggagcagtggagccctgcactgaccatatcaaaggtcctcctctccatcagctcgcttctgactgaccccaacccagacgaccccctcgtccccgagatcgcccacatgtacaagaaccagagg

SEQ ID NO: 72533 - protein, 131 aa, Zea mays
  misc_feature: Ceres CLONE 1555810
  misc_feature (5)..(131): Pfam Name: UQ_con Pfam Description: Ubiquitin-conjugating enzyme
  misc_feature: SWISSPROT Homolog: EC 6.3.2.19 Ubiquitin--protein ligase
MANKRIQKELMDLQKDPPTSCSAGPAGEDLFHWQATIMGPSDSPYAGGVFFVNIHFPPDYPFKPPKVNFQTKVYHPNINSNGSICLDILKEQWSPALTISKVLLSISSLLTDPNPDDPLVPEIAHMYKNQR

SEQ ID NO: 72534 - DNA, 695 bp, Zea mays
  misc_feature: Ceres CLONE 1555813
  misc_feature: Encodes the peptide sequence at SEQ ID NO. 72535
aagctggagctccccgcggtggcggccgctctagaactagtggatcccccgggctgcaggaattcgtctcacccctagaaaaagagtatgaagaatgaacaagggtgggaggaactcagtctcaaaagggggaagatgggggctagctaatgtgcatttgtgcattgcaagtaaagagtttcagcatgcttctttggaaacctgacttatgtgcatcgcctcatctttcgattataaaaattttctcggctgatcggcggctgtccgtagaatctttgaaattaaattcgttttgcagaaaaaaaaactcgcacagtcgcaccacagcgagcgagaacaaggcgcccaagcaaccaccgcgagaacaagtcgcagccaaagagccccgtctcccagcgaagcttgagcttgcatccatactaccatgtcttccatggagctgctccacgccgtcgtcccggagaagcaagcgagggaggaggtcgcgcccgcagcgacgaccacgagcagcagcgccaccgccacgagcggggacgagggcgcccacgtgccccaggggtgggccaagaggaagcgctcgcgccgccagcgatcggaggaggagaacctcgcgctctgcctcctcatgctctcccgcggtggccaccaccgcgtccaggcgccgccaacgccggtccctcccgcggcgccggccg

SEQ ID NO: 72535 - protein, 90 aa, Zea mays
  misc_feature: Ceres CLONE 1555813
MSSMELLHAVVPEKQAREEVAPAATTTSSSATATSGDEGAHVPQGWAKRKRSRRQRSEEENLALCLLMLSRGGHHRVQAPPTPVPPAAPA

SEQ ID NO: 72536 - DNA, 682 bp, Zea mays
  misc_feature: Ceres CLONE 1555822
  misc_feature: Encodes the peptide sequence at SEQ ID NO. 72537
ctggagctccccgcggtggcggccgctctagaactagtggatcccccgggctgcaggaattcgtctcacccctagaaaaaaaccgccgagccagaggcacccggagcagcgcacagcaacagagcacacgccgcacaccgccgccgcctccgcagcagcagcagcaatggcgcgcgccggcgctctctgcctggtgctgctctgcctcgtggccgtgcactcagccacggcgcagaagtccacgacagccccggccgccgcgccggccgccgccaccaccccgccggcgaccccgaccaagaagtcgcccgcgcccgccgccgcgccgcccaccaccccggccaccctggccccggccgacgcgccgcccaccacgccggccacccccgagcccgccactgcgccgcccactacccctgccaccgtggcaccagccgcggagccgccaaagtccaccccaaaggcgtctcctctcgccccgtctaccaaggccaaggccaccccgcaggtggccgagctgaagcaagctttttggcctccaggcgccgcacaggtctcgaaatcaaccaatgaccgatgacggccccgtacctgctccaatcccaaaatgataacgaaacccttcctcctcggcccggaaccacaaagaaagtgtgcgggcgcccccggctccagccaactc

SEQ ID NO: 72537 - protein, 137 aa, Zea mays
  misc_feature: Ceres CLONE 1555822
MARAGALCLVLLCLVAVHSATAQKSTTAPAAAPAAATTPPATPTKKSPAPAAAPPTTPATLAPADAPPTTPATPEPATAPPTTPATVAPAAEPPKSTPKASPLAPSTKAKATPQVAELKQAFWPPGAAQVSKSTNDR

SEQ ID NO: 72538 - DNA, 690 bp, Zea mays
  misc_feature: Ceres CLONE 1555835
  misc_feature: Encodes the peptide sequence at SEQ ID NO. 72539
  misc_feature (641)..(641): n is a, c, t, g, unknown, or other
  misc_feature (647)..(647): n is a, c, t, g, unknown, or other
  misc_feature (648)..(648): n is a, c, t, g, unknown, or other
agctccccgcggtggcggccgctctagaactagtggatcccccgggctgcaggaattcgtctcacccctagaaaaaaacacaaagccaaagcgcagcgcagccagagtaagcagagagttgcacttggggaaaaaattaccgtgcttcttcagttcttcttcctagcatgcactcgcttgtgaggcgtggcaatggctacggctacggctatggtggttacggcagcagcaatccccatatgaactaccaccgccaaaacaccgagtccgtgaccaccgtcgtcacggagatgaaccgaatggccgtcgacgacaagccctgctacggcggcggcgtgcagaagcaggcctgcaaggtggaggcgttccaggagcacgacgaagcgtacaagggcgccgtggccgtgcagcagaagcactcctccttcaaggaggacaaggaggaggtgcgcggtgctgctgccgccgtcagaagctggccacagtttttccccagggaggaggagggaggagaagcacgtcgtcgacacggagtacgggcgctttcccgcggggggggggcgccgcccgccgtgaaagaagccgggctacaactacaagcagcacgaggcatacggggaagaccgaaggtgcagggtacngctacnngcgccggcgccggcggcgtgaagaagcaagcaggctacagct

SEQ ID NO: 72539 - protein, 174 aa, Zea mays
  misc_feature: Ceres CLONE 1555835
  misc_feature (161)..(161): Xaa is any aa, unknown, or other
MHSLVRRGNGYGYGYGGYGSSNPHMNYHRQNTESVTTVVTEMNRMAVDDKPCYGGGVQKQACKVEAFQEHDEAYKGAVAVQQKHSSFKEDKEEVRGAAAAVRSWPQFFPREEEGGEARRRHGVRALSRGGGAPPAVKEAGLQLQAARGIRGRPKVQGTATXAGAGGVKKQAGYS

SEQ ID NO: 72540 - DNA, 684 bp, Zea mays
  misc_feature: Ceres CLONE 1555855
  misc_feature: Encodes the peptide sequence at SEQ ID NO. 72541
ctggagctccccgcggtggcggccgctctagaactagtggatcccccgggctgcaggaattcgtctcacccctagaaaaaaccaccagcagcgcatccaagccaagcggcctcctcttcccgggcaaagcagagcaagcagaagcagtgcaacaatggccgtggggttccgtcggacgctgaccacgctggcgtcgcccaagtcgatggctccgtcgttcctgctggactgcgcgcggcccaagaagctgtcgtacgcgcgggtgcggtcgaccagcctccccgtgcggctgcacccgctggcggcggcgctgcacgagtcggcgcgcgcgctgctggcgtgggcggacgcgccggcgcagacggggcccgcgtgggtggcggacggcgccgggcgcgcggggcgcgtgctgtcggggctggcggacctgctccaccacccgcaggcccgcgacgcgctccggcggcacccctggacgacggagcagctgctggacgacctgctcctgctggccgacctccacgggtgcttccgcgagtcgctggtggcgctgacgcagctcctggccgagacgcacgcggcgctgcgcaggcgcgacggcgcccgcctcgccgccgcgctgcgggcgcagcggcggtcgggcgcgggaggtgtcccgcctggcgtcctccgcgcgggacctct

SEQ ID NO: 72541 - protein, 176 aa, Zea mays
  misc_feature: Ceres CLONE 1555855
MAVGFRRTLTTLASPKSMAPSFLLDCARPKKLSYARVRSTSLPVRLHPLAAALHESARALLAWADAPAQTGPAWVADGAGRAGRVLSGLADLLHHPQARDALRRHPWTTEQLLDDLLLLADLHGCFRESLVALTQLLAETHAALRRRDGARLAAALRAQRRSGAGGVPPGVLRAGP

SEQ ID NO: 72542 - DNA, 654 bp, Zea mays
  misc_feature: Ceres CLONE 1555856
  misc_feature: Encodes the peptide sequence at SEQ ID NO. 72543
tccccgcggtggcggccgctctagaactagtggatcccccgggctgcaggaattcgtctcacccctagaaaaacccaatccgttcaacgacggcttcaggaacccttcctccggcggccgccacaacgagcctcgggcaccgcaaagcaaatcctatcctatcagtcgaatcgtgcgtctcgtcgagcctcgatcctatccccgccacgccgatccctcgtcggtcgtccgaatctggtggactatctccatcgccgggcgttcatttttggcccggtgagccgggggtggggggtgggtatttggtgccgtgagttgctgctcccgcccgtcgatgcttggttagcagaagagacggcggcggtaccatgttgcagtgcctggatggagtgaagcagctccttggcgtgctcctcaagtgctgccacatcgacctcaagcaacccaacggcctagaggatccggaggtgctcgctagggagaccgtgtttagcgtgagcgaggtcgaggcattgtatgagctgttcaagaagatcaatgagggctgtgattgatgatgggctgaacaacaaggaggagtttgcagtggcgcgggttcaggaccgataagaagggaagttttgtttgctgatcggggaatttgactttatttaa

SEQ ID NO: 72543 - protein, 61 aa, Zea mays
  misc_feature: Ceres CLONE 1555856
MLQCLDGVKQLLGVLLKCCHIDLKQPNGLEDPEVLARETVFSVSEVEALYELFKKINEGCD

SEQ ID NO: 72544 - DNA, 670 bp, Zea mays
  misc_feature: Ceres CLONE 1555858
  misc_feature (435)..(435): n is a, c, t, g, unknown, or other
  misc_feature (436)..(436): n is a, c, t, g, unknown, or other
  misc_feature (437)..(437): n is a, c, t, g, unknown, or other
  misc_feature (500)..(500): n is a, c, t, g, unknown, or other
ctccccgcggtggcggccgctctagaactagtggatcccccgggctgcaggaattcgtctcacccctagaaaaaaagagtgcagcaaggagaccctaaggtactggcagctcggtccagagaagactacttacagctgaaacaaagattacagtggttcactttaggcattggtggcgttggtgtaatctctgcttatatttcatacactcctgaaattgctgtcagctttggtgcagggttgattggatcattggtgtatctccgcatgcttggaaccagtatagattccctagcaggtggaactggagaaactgtcaagagtgctgctgcacaaccaaggttgcttattccagtggtacttgtgatgatgtataacagatggaatcagatattagttccggattatggtttcatgcagcttgagttaataccnnntgctgtgggttttttacctataagattgctacattcgctcaagcaatccaggaatctatgccntcagtccgaaattcgtgaaggttgaaaattgtcatgttgtatttaaaccaaggtgggaagccaggtcccctggccatgggtcaccccaaaaaataaggtcttgtaaaaaaaatctgggcccgggggccacccccaagtaaaataaaaacccctttaagaaccccttttga

SEQ ID NO: 72545 - DNA, 656 bp, Zea mays
  misc_feature: Ceres CLONE 1555859
  misc_feature: SWISSPROT Homolog: EC 3.2.1.18 Exo-alpha-sialidase
ctccccgcggtggcggccgctctagaactagtggatcccccgggctgcaggaattcgtctcacccctagaaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggcccccaccacgccgcctccgtccccaccagcgtcgccaccgcccgctcccaccactccgccaccgtctcccccggcaagcccgccgcccgctcccgccaccccgccaccgtctccgcccatggcgccacctcccgccacgccccctccacccgccaccccgacgccaccggccgcgcccacgccggccccgagcgtggccccgactcccccgcccggtggcgacaccggctgcgtccccccaagacccccaagacgccgagccccgcccgcc

SEQ ID NO: 72546 - DNA, 668 bp, Zea mays
  misc_feature: Ceres CLONE 1555865
  misc_feature: Encodes the peptide sequence at SEQ ID NO. 72547
ctggagctcaccgcggtggcggccgctctagaactagtggatcccccgggctgcaggaattcgtctcacccctagaaaaaattaacgccgcaagaatcaatccagtccctcccgcgagatgcggccgcatcccaattccatcccgtggccagtccctcccgcggcgcaatccagttcttccatcccgcaacggccgcatccagttcgcgcaacggccggatcccacttccatctcgcggccgcaccatcaacggcgcaacgaccggatccgtcgccacccccgtgggaggcgctccacctcgtcgcgccgttcctcgacgccgcatccctcgcggcggcgtcctacgtgtccacctcgtggcataccgccttcgccgcggacgacctctgggcgcggctctgcgcgcagcacttcctctccgcgctgggcctcctctccgacaccgacagcgaccggcggtgcttctcctcaccccaccgacgcctgttcaagctgttccgctcccgcgtcgtccgctggggggcgctcccggcccgggcctcgccctcgggaagtctcgttcaccgtcaacgtcgtcacggccggggggaaaagaccctgtcctcctagtaccccggaacaggccccccattcgaaaatcccgggggtgttcccgttaagggccaac

SEQ ID NO: 72547 - protein, 163 aa, Zea mays
  misc_feature: Ceres CLONE 1555865
MRPHPNSIPWPVPPAAQSSSSIPQRPHPVRATAGSHFHLAAAPSTAQRPDPSPPPWEALHLVAPFLDAASLAAASYVSTSWHTAFAADDLWARLCAQHFLSALGLLSDTDSDRRCFSSPHRRLFKLFRSRVVRWGALPARASPSGSLVHRQRRHGRGEKTLSS

SEQ ID NO: 72548 - DNA, 681 bp, Zea mays
  misc_feature: Ceres CLONE 1555872
  misc_feature: Encodes the peptide sequence at SEQ ID NO. 72549
aaagctggagctccccgcggtggcggccgctctagaactagtggatcccccgggctgcaggaattcgtctcacccctagaaaaaacggcccctctgccttttccttttccttccccgctttctccttccttcctccccactccccgctcccctcgcccagccactggccatgtcggtggagacggagcggagctccaccgagtcctccggggcttccgggctcgacttcgaggacaccgcgctcacgctcaccctccgcctcccgggctccgcgccttccgccgccgccgccgccgcggcctccctgtccctctcctcctcgtcgtcctccgccttccccgaccccgaccgcaagcgcgcgtcctccgacgccgaccccggccgctcctccccgctcgccgcgtcctccgacgctgcaccggcacccaaggctcgtgtggtgggctggccgccggtgaggtcgtaccgcaagaacgcgctcgccgacgccgcgggctccagcaaggccgccaagttcgtcaaggtggccgtcgacggcgcgccctacctgcggaaggtggacctgcaggcgtacgccggctacgaccagctgctccgcgcgctccaggacaagttcttctcccacttcaccatcaggaagttcgccgacgacgagaggaagctggtggacgcggtgaacgg

SEQ ID NO: 72549 - protein, 170 aa, Zea mays
  misc_feature: Ceres CLONE 1555872
  misc_feature (18)..(169): Pfam Name: AUX_IAA Pfam Description: AUX/IAA family
MSVETERSSTESSGASGLDFEDTALTLTLRLPGSAPSAAAAAAASLSLSSSSSSAFPDPDRKRASSDADPGRSSPLAASSDAAPAPKARVVGWPPVRSYRKNALADAAGSSKAAKFVKVAVDGAPYLRKVDLQAYAGYDQLLRALQDKFFSHFTIRKFADDERKLVDAVN

SEQ ID NO: 72550 - DNA, 613 bp, Zea mays
  misc_feature: Ceres CLONE 1555877
  misc_feature: Encodes the peptide sequence at SEQ ID NO. 72551
ctggagctccccgcggtggcggccgctctagaactagtggatcccccgggctgcaggaattcgtctcacccctagaaaaaattttgaatggctatagtctacatgcaccaacgttggaaggtttcgtcaatcagctccctgatctagctcttttccatgctgcttccaacaattttggtggcgatataccccagctaaccgcccttgggtacatgtacgagctcagtgtcgccgctaaagatgtgccattacagactagggatgcgatggaattttgtgggggggggaggggcatcggtcgcgtgcaattaggtagatgcgtaactgctgattttgacttttcatttaatgtcggaattaataagggtcacaaaatttccctggttttacgcatgcccaaggctctcccttctcaaccggcacaaatttgtcccggtccaacttccgtcaaaacctcggttttctcaaaaactggaacctaccttggcctccccaaacaaaaacttaaccgggcaaatccccccctcaatcaaaaaagctggaaaaaactctcttttaaggatacccctttctaaaaaaccaggttttcgggggggcccccccccgaaagtgg

SEQ ID NO: 72551 - protein, 190 aa, Zea mays
  misc_feature: Ceres CLONE 1555877
GAPRGGGRSRTSGSPGLQEFVSPLEKILNGYSLHAPTLEGFVNQLPDLALFHAASNNFGGDIPQLTALGYMYELSVAAKDVPLQTRDAMEFCGGGRGIGRVQLGRCVTADFDFSFNVGINKGHKISLVLRMPKALPSQPAQICPGPTSVKTSVFSKTGTYLGLPKQKLNRANPPLNQKSWKKLSFKDTPF

SEQ ID NO: 72552 - DNA, 691 bp, Zea mays
  misc_feature: Ceres CLONE 1555878
  misc_feature: Encodes the peptide sequence at SEQ ID NO. 72553
ctggagctccccgcggtggcggccgctctagaactagtggatcccccgggctgcaggaattcgtctcacccctagaaaaagaacgggcaatctcactcactctccttcgtagttgaaattgaactcgctggccgcctgtgtatagtccagtacttccagctagaatctgaaagaaactcgtcaccagctcgatctcgtccttcctcccttcgctcgactcctctgcttctcccccatccggtacgtgcggtgcggggaggctagccgggcggccggagctccaaccgcaatcggtctcttgctctgctgctgcgatggaggcgtcgtcgttggcgctcgtggccgccgtgctcctcctgtcctccacgcttgccgcgtcagatttctgcgtgtgcagttcggaccagccgacggcggtgctgcagaaggcgatcgacttcgcgtgcggtccgcaggggggcgccgactgcacggccatcctgcagggcggcgggtgctacagccccaacaccgtcgccgcgcactgctcctgggccgccaacagctactaccagaacaacaaggccaggggcgccacctgcgatttcggcggcgccgccgccgtctccaccacagaccccagtttctccgggtgcactttcgcttccagtgccaccagcgctggcgctgggaccgggacggcgggtaccac

SEQ ID NO: 72553 - protein, 125 aa, Zea mays
  misc_feature: Ceres CLONE 1555878
  misc_feature (23)..(109): Pfam Name: X8 Pfam Description: X8 domain
  misc_feature: SWISSPROT Homolog: EC 3.2.1.39 Glucan endo-1,3-beta-D-glucosidase
MEASSLALVAAVLLLSSTLAASDFCVCSSDQPTAVLQKAIDFACGPQGGADCTAILQGGGCYSPNTVAAHCSWAANSYYQNNKARGATCDFGGAAAVSTTDPSFSGCTFASSATSAGAGTGTAGT

SEQ ID NO: 72554 - DNA, 680 bp, Zea mays
  misc_feature: Ceres CLONE 1555882
ctccccgcggtggcggccgctctagaactagtggatcccccgggctgcaggaattcgtctcaccgctagaataaatggaatttgcttctatccccctgaaccggggcctgagcgttctcctcctctgttgcttgttttttctcgcactccccacctccgagagatatgacggatcgccctcaaatggcccacttctccctgtaaaactacctgctgaacctgcgctcaggccctcgccatggagagcaactccctccgtgtaagcacgcatcacccagaacgatctctaggccgatctggagggcgccatgtgcactttctggctaatacgcggcctcaatccctatgtcctcagctctccctcttcccccaaatagtcgtgtgggcctattacatcactcctgcaccctgcttggatagcatctcctctagttcattctgaccattctacatttccccgtccaccttattaacgattttgacagaagtttggcttatctgtcttactcctctcaatacacgcaggtcaagaagatcgatcctgggaatctcttcgaggtgcaactgcgtgtacgtactacctgatatcaactctagggacatccctgttggctctcgccgcggacagagatttccagagattatgacgcttctagctgtgcttgcccggacagtattct

SEQ ID NO: 72555 - DNA, 702 bp, Zea mays
  misc_feature: Ceres CLONE 1555885
  misc_feature: Encodes the peptide sequence at SEQ ID NO. 72556
aagctggagctcaccgcggtggcggccgctctagaactagtggatcccccgggctgcaggaattcgtctcacccctagaaaaaactggggatcagtgtgtgttgtgggttgctgggcaaggatacatgcagggggagctgatggttttgcaggggatgatgttgtgtagctggttggttggttggggtgtgtagaaggcattcattcccctttgtaacagcctaatctgtacattcttaccatcatctttgtcttgttgattgatcgagtcgcagacctcctgcgtttatttgcattaggaaaaaacacaacacacgaaatacgcacaaaaatcatcataccaaaccaagaaaacaaaaaaccggctgatcgagaagcaccggtcgggcgcggaggtccccttcgggcacaagctgtgcgagcccaagtcgcgcaagttcatggtggagctgggcctccccgacgggctcctcccgctgcccaggttcgacgaggtgggctacaaccggtcaacggggttcgtgtggttgcggtaggccgccggcctgacccacaccttcgggtccatcggcaagcaggtgtggtacgacagggaggtgaccgcgtttcgtggaacccggggcggattcaccgcctcccccggggtgaagagcaagggagctcctcttctgggtcaccatctccgagatcgtccctcgcccc

SEQ ID NO: 72556 - protein, 31 aa, Zea mays
  misc_feature: Ceres CLONE 1555885
MVELGLPDGLLPLPRFDEVGYNRSTGFVWLR

SEQ ID NO: 72557 - DNA, 688 bp, Zea mays
  misc_feature: Ceres CLONE 1555886
  misc_feature: Encodes the peptide sequence at SEQ ID NO. 72558
ctggagctccccgcggtggcggccgctctagaactagtggatcccccgggctgcaggaattcgtctcacccctagaaaaagaacatttttagacaatttgggtcactctggttggacagggtcacaatccacgtctcagtatttttgttcttatggtctcggtattgaatgcctaggtgagttttttttagctgtgcacaaaaaaacagttaaactcgatgggtatttcaactgctggagaaatgctagtgccctatttttggctgtggaaaaagccacagcccgcctcaaatccccggctcggaaacaaccaccgatcacaccaccacattgccgtcaccgtcaccgccggcccgccgccaccgcttcccaagctatctcatggcggcctccgcgtcctccctgcttgcagacgccgcatcctcatcctgcggggccatctctccgcgtccccggttgcttcgtggagctccggccgccgccttcgtcccctcgccgtcgcgtcactcctgctgttccctccgcgcttcccccgcgaggcgccatcggagccgctttgtagccagcgccgttcccacgatgcagcctccggcggagtccagggtctccacggtagtcgatgtcgacctcggcgatcgtagctacccgatctacatcggcgcaggcctcctcgacgagccggacctgc

SEQ ID NO: 72558 - protein, 102 aa, Zea mays
  misc_feature: Ceres CLONE 1555886
  misc_feature: SWISSPROT Homolog: EC 4.2.3.4 3-dehydroquinate synthase
MAASASSLLADAASSSCGAISPRPRLLRGAPAAAFVPSPSRHSCCSLRASPARRHRSRFVASAVPTMQPPAESRVSTVVDVDLGDRSYPIYIGAGLLDEPDL

SEQ ID NO: 72559 - DNA, 690 bp, Zea mays
  misc_feature: Ceres CLONE 1555891
  misc_feature: Encodes the peptide sequence at SEQ ID NO. 72560
tggagctccccgcggtggcggccgctctagaactagtggatcccccgggctgcaggaattcgtctcacccctagaaaaaatactttcccactgccgcagttcgccactctcgccatcggggacgagggactgggagccaggatacttctgccgcgcggcgacgtagccctcctcctcctcttgctctccccgccaccctctgcttatcgtgtacctcgtattagatctaattttggtatccgtggtaggagaccccaccttgcttggtggtggtgtgtgtgtgtgtgtgtgttggggcggccgcttctccggcgatcccccgagctacctcaccggcgagttccccggcgactaccgctgggacaccgccgggctgtccgccgaccccgagaccttcgccaagaaccgcgagctggaggtgatccactcccgctgggccatgctcggcgcgctcggctgcgtcttccccgagctgctctcccgcaacggcgtcaagttcagcgaggccgtctggttcaaggccggctcccagatcttcaacgagggcgggctggactacctcggcaaccccagcctgatccacgcgcagagcatcctccccatctgggcctgccaggtcgtgctcatggctgccgtcaagggctaccgcattgccggcgggccgctccgggaggtcatcgaaacgctgta

SEQ ID NO: 72560 - protein, 83 aa, Zea mays
  misc_feature: Ceres CLONE 1555891
MLGALGCVFPELLSRNGVKFSEAVWFKAGSQIFNEGGLDYLGNPSLIHAQSILPIWACQVVLMAAVKGYRIAGGPLREVIETL

SEQ ID NO: 72561 - DNA, 684 bp, Zea mays
  misc_feature: Ceres CLONE 1555893
ggagctccccgcggtggcggccgctctagaactagtggatcccccgggctgcaggaattcgtctcacccctagaaaaaaaccaccacactacaactcgacaccgagaaaagcgcagcaaagcaacgcagagcccacgccgctacagtgctacagcgagcgagcctcttgcctgccgctacgagccaacgactcgaacgcatacactccaatggcagcgacggtgatggcctccatgagccccctcgcctccgccacccccggcgcgcgtcgcgctttccctgtacggctgctgctccaggcatctgcgctcgcgccgcgccggcgcgcccttggcatgactgtgagggccagagcgacgacgccgagccgaagcaaggaggcggctgcagcagccaccacccggcgccaaagtccatgcggcggcagcggcaaccccgggctgtgggacccgctggcgtcaacggcccggtcccaaggaaatcaaaggccgttccacatggggggttcctgttgggcctccccgcaaagggtcccggggggggggccccctcttcaagcccgaaaaagggtccgggttccccgggtttcgggccccccgtttaaaggtgttgccaggagccccccggggggcccccctcctggggggcaaacccccccaaacccaagaggggccccccccctaa

SEQ ID NO: 72562 - DNA, 642 bp, Zea mays
  misc_feature: Ceres CLONE 1555899
  misc_feature: Encodes the peptide sequence at SEQ ID NO. 72563
aagctggagctccccgcggtggcggccgctctagaactagtggatcccccgggctgcaggaattcgtctcacccctagaaaaagtgccagcgcccagcaggccattctgctcgccttactccctcacagaacccagtaaaatattgccagtcccgccgtcgagatggccccacgccgcctgctcgtcctcgccgtcctcgccctcgcggccaccgccgccgcggccaactccggcttcgcggactccaacccgatccgccctgtcaccgaccgcgcggcctccgcgctcgagtccacggtcttcgccgcgctcggccgcacccgcgacgcgcttcgcttcgcacgcttcgccgtcaggtacggcaagagctacgagagcgcggcggaggtccataagcggttcaggatcttctccgagagcctccagctggtccgctccaccaaccgcaaaggcctctcctaccgcctcggcatcaaccgcttcgcggacatgagctgggaggagttccgtgcgacccggctcggcgcagcccagaactgctccgccacgcttaccggcaaccaccggatgcgcgccgccggcgttgcgctgccggagacgaaagactggagggaggatgggattgtgagcccagtgaaaaa

SEQ ID NO: 72563 - protein, 159 aa, Zea mays
  misc_feature: Ceres CLONE 1555899
  misc_feature (59)..(115): Pfam Name: Inhibitor_I29 Pfam Description: Cathepsin propeptide inhibitor domain (I29)
  misc_feature: SWISSPROT Homolog: EC 3.4.22.16 Cathepsin H
MAPRRLLVLAVLALAATAAAANSGFADSNPIRPVTDRAASALESTVFAALGRTRDALRFARFAVRYGKSYESAAEVHKRFRIFSESLQLVRSTNRKGLSYRLGINRFADMSWEEFRATRLGAAQNCSATLTGNHRMRAAGVALPETKDWREDGIVSPVK

SEQ ID NO: 72564 - DNA, 672 bp, Zea mays
  misc_feature: Ceres CLONE 1555919
  misc_feature: Encodes the peptide sequence at SEQ ID NO. 72565
aaagctggagctccccgcggtggcggccgctctagaactagtggatcccccgggctgcaggaattcgtctcacccctagaaaaaaccacgcgcctccaagggcctcgcctcgcccgcccgccggtccaggatgggcgcacggatttagctgatcccgtcgctgctcgcgcccgatctcgcggcgccccgccccatcagctccgcgagatgatctgagccccgcgatctggtggagaaatggagccgccgccggatctgaacacccacctgccgccgcggaagcgcctgctcgccgggctcaggacggcagccaccgccgccgagccgctaccgccgccgcccgcccacgccgacctcgccgcccgcctccgcgagatggcgctcgccgccaacgcgtcggcgtcctcgcccgaggagacgatcgaggcggcgagggcggccgcgcaggccgccgcggacgccgccgttgctgcgcgcgccgtggccgccgagaaggccgccgtcgccgcgaaggctagggcggccgcgcgcgccgacatggagttcatcgactccttctctaccagggccggcgcgtccaggaacgggagcggcctccagttcaagatcaagtctaggaggaagcatgtccagctcaagatgctgtacaggcccaatgcaaccctagggcca

SEQ ID NO: 72565 - protein, 99 aa, Zea mays
  misc_feature: Ceres CLONE 1555919
MALAANASASSPEETIEAARAAAQAAADAAVAARAVAAEKAAVAAKARAAARADMEFIDSFSTRAGASRNGSGLQFKIKSRRKHVQLKMLYRPNATLGP

SEQ ID NO: 72566 - DNA, 619 bp, Zea mays
  misc_feature: Ceres CLONE 1555923
  misc_feature: Translation starting site: 254
  misc_feature (1)..(1): n is a, c, t, g, unknown, or other
  misc_feature (386)..(386): n is a, c, t, g, unknown, or other
  misc_feature (454)..(454): n is a, c, t, g, unknown, or other
  misc_feature (482)..(482): n is a, c, t, g, unknown, or other
nagctggagctccccgcggtggcggccgctctagaactagtggatcccccgggctgcaggaattcgtctcacccctagaaaaaataaaaatgctggagatatttttctccgcctcctcattcactttccaagttgtccgaaaagaccagactaccctgttcccccgaagtcagagggggagaggaggctagggatagagcagcgtcatcgcaccgctcgccggcgagccagatcatcagtgaggaaggcagcgatggcggtggtggagctgtgggagacgctgaagcaggcgatcgttgcgtacacgggcctgtctccggcggccttcttcacggcttgtggcggtggcggccgctctgtaccacgtttgtgtcggggctcttcgngggcccgcccccccgcgcgccgcgcccacgggaagagcccgagacagagccgctccctctcccgtggnataggggggaggtctccaaggaggaccntcgccagtacgacgggtccgaccctaggaagcgcttcttctgggcatcaagggcagatcttcgacctcaccaaaagcaaaagttttatggaccggggggaacttacccccgtttcccggggaaaaatgcacccaacc

SEQ ID NO: 72567 - DNA, 687 bp, Zea mays
  misc_feature: Ceres CLONE 1555926
  misc_feature: Encodes the peptide sequence at SEQ ID NO. 72568
ggagctccccgcggtggcggccgctctagaactagtggatcccccgggctgcaggaattcgtctcacccctagaaaaaattttcttgagtagctctaactttatgtgaagcttacttgagctgaattgtagaagtgaaacataaatttatggagttggagttggacctatgtcaaccagggcctgatgatagtactatatatatgtaaacacccacaagctaaacacctcagcaaagaagaagaatggcgttgctcggcgagtacagcagtcaggagctcctccagggtcagctccagctctggcaccagtccctcggcttcttcaagtccctcgcgctcgcggtcgccatggacctccgcatcgccgacgccatccaccgcctcggtggcgccgccacccttccccagatactcgcggaggccgggatcaagatcgacccgcgcaacaacaagctccgcgacctgcgccgcgtcatgcgcgcgctcaccgtgtcgggcatcttcaccgtcgtccatcgaccagcgtcgtcgttagatggaggcggcaggcgtggcgcagaagcggaaggtccggtctacaagctgacggcggcctcccgcctcctcgtcgtcggagagaaggagagctcgacggcgacgatgaggcagctgcctcctcctcctcctccttctctgaccgtttatgt

SEQ ID NO: 72568 - protein, 147 aa, Zea mays
  misc_feature: Ceres CLONE 1555926
MALLGEYSSQELLQGQLQLWHQSLGFFKSLALAVAMDLRIADAIHRLGGAATLPQILAEAGIKIDPRNNKLRDLRRVMRALTVSGIFTVVHRPASSLDGGGRRGAEAEGPVYKLTAASRLLVVGEKESSTATMRQLPPPPPPSLTVY

SEQ ID NO: 72569 - DNA, 695 bp, Zea mays
  misc_feature: Ceres CLONE 1555929
  misc_feature: Encodes the peptide sequence at SEQ ID NO. 72570
  misc_feature (528)..(528): n is a, c, t, g, unknown, or other
ctggagctccccgcggtggcggccgctctagaactagtggatcccccgggctgcaggaattcgtctcacccctagaaaaagacgacgcccccatttcgaagctcctcctcgcgattccaatccacgcacgccatctccgactccgcgtccgcctcgcgcaggacatatattcagtgatggaacacaaggaggccggctgccagcagccggagggcccaatcctatgcatcaataactgtggtttctttggaagcgctgccaccatgaacatgtgctccaagtgccacaaggagatgataatgaagcaggagcaggcccagttggctgcctcctccatcgatagcattgtcaatggcggtgataatgggaaaggaccctgcattgctgcaactgtaggtgtggcagttccctcagtcgaggagaagactatcgccgtgcagcctatgcatgtcgctgaaaacagcgaggctgctgctgttatcgcgaaggccaagaagggccaaaaccggtgcccaacctgtaggagcntgttgggttgaccgggtttaaactgccgatgccgggaaacgtaactggtcaatgcaccggtacctccaaaaaaaacgaatggcagttttcaattttaaactggaattggggaactttttccccagggccaacccatggggaaaagggggaaaccttgaaaaaatcgg

SEQ ID NO: 72570 - protein, 120 aa, Zea mays
  misc_feature: Ceres CLONE 1555929
  misc_feature (14)..(38): Pfam Name: zf-A20 Pfam Description: A20-like zinc finger
  misc_feature (118)..(118): Xaa is any aa, unknown, or other
MEHKEAGCQQPEGPILCINNCGFFGSAATMNMCSKCHKEMIMKQEQAQLAASSIDSIVNGGDNGKGPCIAATVGVAVPSVEEKTIAVQPMHVAENSEAAAVIAKAKKGQNRCPTCRSXLG

SEQ ID NO: 72571 - DNA, 655 bp, Zea mays
  misc_feature: Ceres CLONE 1555944
  misc_feature: Translation starting site: 172
  misc_feature: SWISSPROT Homolog: EC 1.11.1.11 L-ascorbate peroxidase
  misc_feature (222)..(222): n is a, c, t, g, unknown, or other
  misc_feature (225)..(225): n is a, c, t, g, unknown, or other
  misc_feature (226)..(226): n is a, c, t, g, unknown, or other
  misc_feature (232)..(232): n is a, c, t, g, unknown, or other
  misc_feature (238)..(238): n is a, c, t, g, unknown, or other
  misc_feature (239)..(239): n is a, c, t, g, unknown, or other
  misc_feature (348)..(348): n is a, c, t, g, unknown, or other
  misc_feature (360)..(360): n is a, c, t, g, unknown, or other
  misc_feature (511)..(511): n is a, c, t, g, unknown, or other
aagctggagctccccgcggtggcggccgctctagaactagtggatcccccgggctgcaggaattcgtctcacccctagaaaaaggctggctcccaccgaattcattccacccccgtctcctccgatcggaccaccgggccagcagcggggcggatcgtgacgtcagcaggcatggtgaaggcctaccccacggtgaacgaggactacctcaaggcggttcgnacnnaaggtnccaagnncgcaagctccgcggcctcatcgccgagaagaattgcgccccgctcatgctccgcctcgcatggcactccgcgggcaccttcgatgtggccaccaaaaccgggggccccnttcggcaccatngaagaacccccgccgaagcagggcgcacggagccaacgccggactggaaattgcatcaggctgctagagcccatcaaggagcagttcccccatctatcctacgctgacttctaccagcttgctggagtcgtggcagtcgaggtaaccggcnggactgatgtccccttccaccccggggagcaggacaagcttgagggtccacgggaaggccgccttcctgatccccccccaaggttctgatccccctcagggggggttttttctcccacacaaaagggggttttgaacgacccag

SEQ ID NO: 72572 - DNA, 670 bp, Zea mays
  misc_feature: Ceres CLONE 1555948
  misc_feature: Encodes the peptide sequence at SEQ ID NO. 72573
  misc_feature (500)..(500): n is a, c, t, g, unknown, or other
ctggagctccccgcggtggcggccgctctagaactagtggatcccccgggctgcaggaattcgtctcacccctagaaaaaatccactctcatcaccagctaagaacagggcttcgtctcaatggaaggcaaaacagggcagctcaggtgctgtttcgtcgccatcgtgctcgtcctgggtcttgtccttgagtcccaccaggctgaagctggaggcaaatggtgctgcgaaaccgccaccggaaaataccattttaatcgctgcgttgactcgggtttggtcgacaatattgggttctgtgcgggtaatgccggttgcatcattatggaagacagatgtggaggccgttggccggtgcctgctcgtgatgcgctttccctggatgtcatttgattaattataagcaagtacgtgaagaaacgagggccagacgactgtcgtccagcgattggttatttgtgaacttgtcgtttgtcttcttatttcaactttccaataangccccttcgtgaagtgtcatccccttcaaagtctgtcgactgttacgtatacaaatctatatatcaaataaagacgggcgccgtacgtgtgtatatgtctctatttctgatcttgcagtcgtttgcttaatcaattgttctgtcactattttatctaataaaattgcacg

SEQ ID NO: 72573 - protein, 90 aa, Zea mays; identical to SEQ ID NO: 53771
  misc_feature: Ceres CLONE 1555948

SEQ ID NO: 72574 - DNA, 679 bp, Zea mays
  misc_feature: Ceres CLONE 1555957
  misc_feature: Encodes the peptide sequence at SEQ ID NO. 72575
  misc_feature (464)..(464): n is a, c, t, g, unknown, or other
aaagctggagctccccgcggtggcggccgctctagaactagtggatcccccgggctgcaggaattcgtctcacccctagaaaaacttcccttttacgcggttccccctaactcccagctctctcgttcaggcgcgctctctctagccggcgacgattgggcgaccggcgccactcaacgccaggtcttcgtgaaaaccatcgccggcgatgagtttcaaccagtctactgtcaaggggcaggccaggagggagaggcctagggctcgccctcatggcctgacgcagcagaggaggcaggaaataaaggaagcctttgatctgtttgatacagataactctggaaccattgatgcaaaagagctcaatgttgccatgagagccgggggatttgagatgactgaagagcaaattaggcaaatgattgctgatgttgacaaagatggcagtggagcgatcgactacnaggagtttgagcacatgatgactgccaaaatcggagagagggatagtaaagaggagctttcaaaagcattccgcattattgatcaagatggaaatggaaagatttctaacattgatatcccaaggattgccaaagagctgggtgtaaatctcaccctccatgaaatccaaacctggtgcaaaaggctgataaaaaggtgacggggaaaaaaactt

SEQ ID NO: 72575 - protein, 151 aa, Zea mays
  misc_feature: Ceres CLONE 1555957
  misc_feature (31)..(59): Pfam Name: efhand Pfam Description: EF hand
  misc_feature (67)..(95): Pfam Name: efhand Pfam Description: EF hand
  misc_feature: SWISSPROT Homolog: EC 2.7.11.1 Non-specific serine/threonine protein kinase
  misc_feature (86)..(86): Xaa is any aa, unknown, or other
MSFNQSTVKGQARRERPRARPHGLTQQRRQEIKEAFDLFDTDNSGTIDAKELNVAMRAGGFEMTEEQIRQMIADVDKDGSGAIDYXEFEHMMTAKIGERDSKEELSKAFRIIDQDGNGKISNIDIPRIAKELGVNLTLHEIQTWCKRLIKR

SEQ ID NO: 72576 - DNA, 654 bp, Zea mays
  misc_feature: Ceres CLONE 1555965
  misc_feature: Encodes the peptide sequence at SEQ ID NO. 72577
ctctagaactagtggatcccccgggctgcaggaattcgtctcacccctagaaaaagtcgccgccaccactctcccagcctctcttactctccgccgtcgccctgctcgaccgaagcagctgccggcaaaatggcccctaagagaggcggtagggcgccggtcacccgccaagaagaacgcggtggtgacgaacccgctcttcgagaagaggccgaagcactttgggatcagcggcgcccttccaccctagaaggacctccaccgcttcttctagtggcccaaggtcgtgcgcatccagcgccagcgccgcatcctcaagcagcgcctcaaggtgcccccggcgctcaaccagttcacacgtaccctccacaagaaccttgcaacaaacttgttcaagatgcttcttaagtaccgccccgaggacaaagctgccaagaaggagaggctcttgaagagggcccaggctgaaaacgaggggaaaactgttgagtcaaagaaaccaattgttgtgaagtacggccttaaccatgtgacttacctcatcgagcagagcaaggcccagctggttgtcatagctcatgatgttgatccgatcgagctggtcgtgtggctcccggccctttgcaggacaatggaggttccatactgcattgt

SEQ ID NO: 72577 - protein, 85 aa, Zea mays
  misc_feature: Ceres CLONE 1555965
MLLKYRPEDKAAKKERLLKRAQAENEGKTVESKKPIVVKYGLNHVTYLIEQSKAQLVVIAHDVDPIELVVWLPALCRTMEVPYCI

SEQ ID NO: 72578 - DNA, 672 bp, Zea mays
  misc_feature: Ceres CLONE 1555975
  misc_feature: Encodes the peptide sequence at SEQ ID NO. 72579
agctccccgcggtggcggccgctctagaactagtggatcccccgggctgcaggaattcgtctcacccctagaaaaaccccacgccacgctctccaacgccacagcttgcgcccgcaatggcactcgtctccgcctcctcgtcctccaccaccgccgtcacggcgctccccaggaatgggcagcgggcgtcgtcctccttcctcggcggcaagacgctgctgagacaggccgaggcggcccggccgtcgttcgccgtgcgcgccgcggcggaccccaacaggccgatctggttccccggcagcacccctccgccgtggctcgacggcagccttcccggcgacttcggctttgatccctggggcctcggatctgacccggagagcctgcggtggaacgtgcaggcggagctggtgcactgccggtgggcgatgctcggcgcggcgggcatcttcatcccggagttcctgaccaagatcggcgtcctcaacacgcccttctggtacaccgccggcgagcagcagtacttcaccgacaccaccaccctcttcatcatcgagctcatcctcatcggctggggccgagggcccgccctgggcctgacatcatccaagcccgggaaggcgtaaaacacggacccccatctttcccaagaaaaaaagtttaccggggacc

SEQ ID NO: 72579 - protein, 169 aa, Zea mays
  misc_feature: Ceres CLONE 1555975
  misc_feature (63)..(170): Pfam Name: Chloroa_b-bind Pfam Description: Chlorophyll A-B binding protein
MALVSASSSSTTAVTALPRNGQRASSSFLGGKTLLRQAEAARPSFAVRAAADPNRPIWFPGSTPPPWLDGSLPGDFGFDPWGLGSDPESLRWNVQAELVHCRWAMLGAAGIFIPEFLTKIGVLNTPFWYTAGEQQYFTDTTTLFIIELILIGWGRGPALGLTSSKPGKA

SEQ ID NO: 72580 - DNA, 681 bp, Zea mays
  misc_feature: Ceres CLONE 1555977
ctccccgcggtggcggccgctctagaactagtggatcccccgggctgcaggaattcgtctcacccctagaaaaagagctcccaagtcccaaactgcccgtctgccctccagccgtgcagggcttcaggccatccgggctccggcttccggcatccatcaggcgtcctcataagatagtgtagggcagcgagcgccgagcagagcagcaaggcagagcagcgagcagccgagcagcgaggcagcgggcgtcctcagaatccgggctgccgagccgccgagcagagcagccgagagcagcgaggcagcgagaacggcccacgagaaggcccgtgcgggtgcggtcgccctgggccgaacaaccccggaccgccgtccgctgcttcctactcttcaccgcttcaccccgcgtgcgcgctttctctgttgctctgctacaactgcgggcgccgccgccgccgccgccctacgccagttgccgagcccttcatcgctcttctcgccggcgacgagcacccaccacaacaagtctttcaccccacagaaggcaaaagatgatcaagaagccgctacctttaggcagggacccatggtgaatacagcggctcctcatcttcctcctaatcggaattgggacccgggacaacgatttggcaaaaagagccattccacattggggaaata

SEQ ID NO: 72581 - DNA, 683 bp, Zea mays
  misc_feature: Ceres CLONE 1556002
  misc_feature: Encodes the peptide sequence at SEQ ID NO. 72582
ctccccgcggtggcggccgctctagaactagtggatcccccgggctgcaggaattcgtctcacccctagaaaaatagaaaaaatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcaccacggactacatgacctacatgttcaagtacgacaccgtccacggccactggaagcacagcgacatcacactcaaggactccaagacccttctcttcggtgacaagccggtcaccgtctttggcatcaggaaccctgaggaaatcccgtggggtgaggctggcgctgagtatgtcgtggagtccaccggcgtcttcactgacaaggacaaggctgctgcacatctcaagggtggtgccaagaaggttgttatctctgccccaagcaaagatgcacccatgtttgttgttggtgtcaatgaggacaagtacacctcggatgttaacattgtttccaatgctagctgcaccacaaactgccttgctccccttgctaaggtcattcatgacaacttcggcattgttgagggtt

SEQ ID NO: 72582 - protein, 175 aa, Zea mays
  misc_feature: Ceres CLONE 1556002
  misc_feature (4)..(154): Pfam Name: Gp_dh_N Pfam Description: Glyceraldehyde 3-phosphate dehydrogenase, NAD binding domain
  misc_feature: SWISSPROT Homolog: EC 1.2.1.12 Glyceraldehyde-3-phosphate dehydrogenase (phosphorylating)
MGKIKIGINGFGRIGRLVARVALQSEDVELVAVNDPFITTDYMTYMFKYDTVHGHWKHSDITLKDSKTLLFGDKPVTVFGIRNPEEIPWGEAGAEYVVESTGVFTDKDKAAAHLKGGAKKVVISAPSKDAPMFVVGVNEDKYTSDVNIVSNASCTTNCLAPLAKVIHDNFGIVEG

SEQ ID NO: 72583 - DNA, 410 bp, Zea mays
  misc_feature: Ceres CLONE 1556008
  misc_feature (241)..(241): n is a, c, t, g, unknown, or other
  misc_feature (255)..(255): n is a, c, t, g, unknown, or other
  misc_feature (363)..(363): n is a, c, t, g, unknown, or other
  misc_feature (376)..(376): n is a, c, t, g, unknown, or other
  misc_feature (377)..(377): n is a, c, t, g, unknown, or other
  misc_feature (378)..(378): n is a, c, t, g, unknown, or other
ctggagctccccgcggtggcggccgctctagaactagtggatcccccgggctgcaggaattcgtctcacccctagaaaaaaagcctgagcactccatccactactttactcaaagtctagagctagctttttgctttgctcaccagacaaaccgcagcagatggcgtcgacgatcatgggccgcccaccctcccgcatcgtcgcgcctagaacgcgtttccttggccaaggtcggggccgnccgccgccggccgnccaatttggccacccccctccggaaattcccccccccccccttttttgggggcccggaatcccccggggggggaaacacaccccttggggggttccccccccccccancaccccccccccnnntaaaaaagaatgggggggcccccctccccccc

SEQ ID NO: 72584 - DNA, 586 bp, Zea mays
  misc_feature: Ceres CLONE 1556012
  misc_feature: Encodes the peptide sequence at SEQ ID NO. 72585
  misc_feature (350)..(350): n is a, c, t, g, unknown, or other
  misc_feature (352)..(352): n is a, c, t, g, unknown, or other
  misc_feature (353)..(353): n is a, c, t, g, unknown, or other
  misc_feature (417)..(417): n is a, c, t, g, unknown, or other
tggagctccccgcggtggcggccgctctagaactagtggacccccgggctgcaggaattcgtctcacccctagaaaaaaaagctcccgcacaccctggcctggatccctcccaataagctccccagctccacgccggacgcagcagcagcagcagtagagatggccgccctcgccgcctcctccacggccgccttcgccgccaagccgcgcctcccacgcgcgcgcctcaccgtggcctgctccgccaccggcggcgacggcaacggcagcagcagcagtgtgtcgctcgcatcctccgtgaagacgtctcggccgcgctggctctgtcgtcggtgcttctctcctcggncnngcactcccctccccccgcggccgctgacatcgcggggctgaccccgtgcaaggagtccaggcgntcgccagcgcgagaagactcgatcagaaactcacgcgtcgctcaggaagtacgcgccggaaagcgccccggccctcgccatcaacggccacacgaagagaaccaagcggcgggttcgagaacctacggaaagttccggcctggttcttgggggccccaaggggcttgct

SEQ ID NO: 72585 - protein, 77 aa, Zea mays
  misc_feature: Ceres CLONE 1556012
  misc_feature (64)..(64): Xaa is any aa, unknown, or other
  misc_feature (65)..(65): Xaa is any aa, unknown, or other
MAALAASSTAAFAAKPRLPRARLTVACSATGGDGNGSSSSVSLASSVKTSRPRWLCRRCFSPRXXTPLPPRPLTSRG

SEQ ID NO: 72586 - DNA, 638 bp, Zea mays
  misc_feature: Ceres CLONE 1556016
  misc_feature: Translation starting site: 374
  misc_feature: SWISSPROT Homolog: EC 3.5.1.16 Acetylornithine deacetylase
ctggagctccccgcggtggcggccgctctagaactagtggatcccccgggctgcaggaattcgtctcacccctagaaaaacagttcgccactccgttgccctctcctccgccgcccgatcctttcgccgtctgagatggcatctccggcatcggcgtcgcttaaggaagccgtgggcagcctcgaccgcgacggtctttgttggtctcctctccaacctcatcggcgagaccgcacacctgcagaacgacccgccgacctacaggcctcatgaggagcgcgtggcgcagcacgtagtcgacgtgctccgctcggtgtccgcggacaccgggggcggccccctccttgtgcggaagataagctacgccgagggcatgagcaacgtcatcgttgaatacccctgcgccgtcccaggtgctcgttgtctccttcgtcggcctgcacatggacgtcgtcactgccaacggcagcgagtgagactttgatcctttggcactagcctttgatagcgaggatcacgactaacttctgggacgtggtacaaccgactgtcttggacatgtcgcactggtggctcaactcatgcagctgcatggtgaggtcaagccaccgccaacacattctgtcattgctgtgtta

SEQ ID NO: 72587 - DNA, 664 bp, Zea mays
  misc_feature: Ceres CLONE 1556017
  misc_feature: Encodes the peptide sequence at SEQ ID NO. 72588
ggagctccccgcggtggcggccgctctagaactagtggatcccccgggctgcaggaattcgtctcacccctagaaaaagctaaattcattcgcagccacaaacaaaccctaaacccctaaaccgccgccgccgccgccgccgccgccatggccaaaaagaaatctgccaccgtcaatggcaacggtaaccacgccgccgcagaggaagtgccgccggcgaaggccgcggaggaccggaaggcagagcagctgaaggcgctgaacaccatgctcctcaaggaggcgacggagcggcgcggtcaggtggcggcgctcacagcgcgccttgacgagctctccgccgacgacgtcgcgctgtccgccgccgagcgcgtggtggcgcaggccgccctcgccgcgccactccgcgcggccgccgacgaggtcgccgcgctccgtgcctgcctcgccgccgtccagggttcgctccgggacgcagaggcgcgggcggctctggaggagagcgccaggggcgaggccgacgcgcggctcgaggaggctgccgcggagagcacgcggtcgatgaagctgctccgggagaaggaagcggaggtggcggccgtgtccagcaaggttgcccgattggaggcccttgtggcggagctagagggcaagactctgaatt

SEQ ID NO: 72588 - protein, 172 aa, Zea mays
  misc_feature: Ceres CLONE 1556017
MAKKKSATVNGNGNHAAAEEVPPAKAAEDRKAEQLKALNTMLLKEATERRGQVAALTARLDELSADDVALSAAERVVAQAALAAPLRAAADEVAALRACLAAVQGSLRDAEARAALEESARGEADARLEEAAAESTRSMKLLREKEAEVAAVSSKVARLEALVAELEGKTLN

SEQ ID NO: 72589 - DNA, 676 bp, Zea mays
  misc_feature: Ceres CLONE 1556031
  misc_feature: Encodes the peptide sequence at SEQ ID NO. 72590
  misc_feature (489)..(489): n is a, c, t, g, unknown, or other
ggagctccccgcggtggcggccgctctagaactagtggatcccccgggctgcaggaattcgtctcacccctagaaaaagcacacattccgcgcacaccccggcagccgcaaacgccttcgccgtcgcgtcccgctcctccgcccgcccgacgcgacccctaggacctggagagagaggtcggcatggctgccgcagtggtcgacgacgctggtatggacgccgtccagaagcgcctcatgttcgaagacgaatgcattttggtggacgagcaggacaatgttgttggccatgagtcaaagtacaactgccatttgatggaaaagattgattctgagaatctgctacatagggcattcagtgtgttccttttcaactcaaaatatgagctgctacttcagcaaaggtccgcgacaaaggttacctttcctttagtttggaccaatacctgctgcagtcaccctctgtaccgtgagtctgagctatccagnagaactaccttggtgtggagaatgcgcacagaggaagctactgaatgagctgggcatccagcagaagatgccccagttgaccattcccccctttggggccgatggcttacaaggccccatcgatggaaaagggggggacatgaccccaataccggttgtctcccccgggaattgagggccccaaccc

SEQ ID NO: 72590 - protein, 117 aa, Zea mays
  misc_feature: Ceres CLONE 1556031
  misc_feature: SWISSPROT Homolog: EC 5.3.3.2 Isopentenyl-diphosphate Delta-isomerase
  misc_feature (102)..(102): Xaa is any aa, unknown, or other
MAAAVVDDAGMDAVQKRLMFEDECILVDEQDNVVGHESKYNCHLMEKIDSENLLHRAFSVFLFNSKYELLLQQRSATKVTFPLVWTNTCCSHPLYRESELSXRTTLVWRMRTEEATE

SEQ ID NO: 72591 - DNA, 677 bp, Zea mays
  misc_feature: Ceres CLONE 1556033
  misc_feature: Encodes the peptide sequence at SEQ ID NO. 72592
  misc_feature (359)..(359): n is a, c, t, g, unknown, or other
ctggagctccccgcggtggcggccgctctagaactagtggatcccccgggctgcaggaattcgtctcacccctagaaaaagtcacaccttccctcggtcccttccatctcctagccgccgccgccgccgcccaaaaccctacctaccctcttctccccctcactctcctttcatctccattctaatggcggcccaacccgtccggcgaagctgctagtgcttgtatctactatcttcatcaggtacttcgcgatcctactgaagtattccccgccgccgctgacatggccaccctcaaccctttcgaactcctcggcgccgacgacaacgacgacacgtcgctgttgattgcggcagcngccgctgctgctcaaaaagcggaggcgaataatccgccgtggcccctgctgggaaagtttgccaggcctgcgcgaacccccaagttcccgaacaaaaccccctcccttcccttcaaaaaagggttcgggaagccacccccaaggggggccaacaaccccccgggagggttttggccccgggtaaaaaggggcccctggtaaaaggggggaagggggaattgggaaaaaacccctgggtcttatggggggaaaaaagggaaataatttttcccccggagggttttgggggggggaaaatctttgggggaagggtccctt

SEQ ID NO: 72592 - protein, 91 aa, Zea mays
  misc_feature: Ceres CLONE 1556033
MATLNPFELLGADDNDDTSLLIAAAAAAAQKAEANNPPWPLLGKFARPARTPKFPNKTPSLPFKKGFGKPPPRGANNPPGGFWPRVKRGPW

SEQ ID NO: 72593 - DNA, 677 bp, Zea mays
  misc_feature: Ceres CLONE 1556034
ctggagctccccgcggtggcggccgctctagaactagtggatcccccgggctgcaggaattcgtctcacccctagaaaaagcacacacacactcctgcggttgccactcgcgtagcagtagcaccagacagcagcgcgcacgcgacgtccgcaatggcggcgcgggcaaccgtcgtcctctgcgccgcgctcctcgtcctgctctccgccaccagctccctcgcgcagtcccccgcggccgcgccggctaaggcgccgcccaagtcctcctccaaggccacgccggccgccgcccccgcgcccaagtcctcctccaaggccagcccatcggcgccggccgccgcgccaaccaccccggcacccgcggcggcgccggccacgacaaagcccaaggcccccgcgcccgcgcccgccaccaaggccgccgccccggccccagccccggccacccctgcacccgtcgccactccccccgcggcgacgcctcccgccgacgatgcgcccgtgcccgccgcggcaccggcccccgagaccaagcccgtggaggcccccgcccccgcgcgggccaataagaagaagccgtcgtccccctcttccagggacaagacgaggaagaagaagggcgcgtcagcgcctgacccgggcggcgacgcccccgttggccataagcccaggac

SEQ ID NO: 72594 - DNA, 684 bp, Zea mays
  misc_feature: Ceres CLONE 1556035
  misc_feature: Encodes the peptide sequence at SEQ ID NO. 72595
  misc_feature (553)..(553): n is a, c, t, g, unknown, or other
  misc_feature (562)..(562): n is a, c, t, g, unknown, or other
  misc_feature (575)..(575): n is a, c, t, g, unknown, or other
  misc_feature (585)..(585): n is a, c, t, g, unknown, or other
aagctggagctccccgcggtggcggccgctctagaactagtggatcccccgggctgcaggaattcgtctcacccctagaaaaagcccgcgcccgatcgggcgcactgccctgtggtgtactggtgtgtcacgcccctcgtcactcaccccgtcacccgcaaccccatcttctattcttcccgacggcgctcctggcagcaggaacaagatgtccaatagggccacacattggtgttatgcctgtcggcggccaattcgtctccgtgggcaggatatcgcatgccccaactgcaatgatggttttatccaggaaattagtgagatgggtggcatattgaacacttatgggctaattgaaccagactttgaagagcgtcgagctagaagattcggaatgatggatgccatgtcttcccttatgcggcaacggatggaagaaatgggaagagatggtttgtttgatattcgtggtagacaaggaacaggtactgaatatgggagggagccaactgctgttcctacattgggtattggcggcatcccttctcctggnagtgatagncgtgatgttaatngtgtcctcangggaggccgcaaaagttgcgctgcccaaccaatttcagtagtttagttgtgggcccagtctgggaagcctttttgacagctacttctccagaaaacggt

SEQ ID NO: 72595 - protein, 140 aa, Zea mays
  misc_feature: Ceres CLONE 1556035
  misc_feature (118)..(118): Xaa is any aa, unknown, or other
  misc_feature (123)..(123): Xaa is any aa, unknown, or other
  misc_feature (126)..(126): Xaa is any aa, unknown, or other
MSNRATHWCYACRRPIRLRGQDIACPNCNDGFIQEISEMGGILNTYGLIEPDFEERRARRFGMMDAMSSLMRQRMEEMGRDGLFDIRGRQGTGTEYGREPTAVPTLGIGGIPSPGSDXRDVNXVLXGGRKSCAAQPISVV

SEQ ID NO: 72596 - DNA, 677 bp, Zea mays
  misc_feature: Ceres CLONE 1556036
  misc_feature: Encodes the peptide sequence at SEQ ID NO. 72597
  misc_feature (390)..(390): n is a, c, t, g, unknown, or other
  misc_feature (403)..(403): n is a, c, t, g, unknown, or other
  misc_feature (677)..(677): n is a, c, t, g, unknown, or other
ggagctccccgcggtggcggccgctctagaactagtggatcccccgggctgcaggaattcgtctcacccctagaaaaagatcccattcacatccccttccgattctccgtcgcctgagcggctgagccaacttgccaagccaagcaagccaagtcgtcgcctccccgacccaacgccgcgacccccttgcccgtccgcgaccgctgcagcacctcggatcccgccccaatggcaacagcgtgtccgccgctctcgctgccgtccacctccctcttccgcggcaggtccgcccgcgccgggcccagacgcaggcagctcacggccgtccgctgcagcgccgtcggagaggcggtagtggaggaggcctcgcccaggacggcggaagaaccnctgctggtgagcncaatcagagggaggaaggtcgagaggccacccgtctggctcatgaggcaggccgggaggtacatgaagagctaccaattgctctgccagcggtatccttcgttccgtgaaagatcagaaaatgtcgacctagtggttgagatctctttgcaaccatggaaggttttcaagcctgatggagtcatcctgttcctcgaatcccttaatcccttcctgggatgaaataccttttgacattgtgaaaggaaaaaggccagtgatctttggatccatgn

SEQ ID NO: 72597 - protein, 131 aa, Zea mays
  misc_feature: Ceres CLONE 1556036
  misc_feature: SWISSPROT Homolog: EC 4.1.1.37 Uroporphyrinogen decarboxylase
  misc_feature (59)..(59): Xaa is any aa, unknown, or other
MATACPPLSLPSTSLFRGRSARAGPRRRQLTAVRCSAVGEAVVEEASPRTAEEPLLVSXIRGRKVERPPVWLMRQAGRYMKSYQLLCQRYPSFRERSENVDLVVEISLQPWKVFKPDGVILFLESLNPFLG

SEQ ID NO: 72598 - DNA, 657 bp, Zea mays
  misc_feature: Ceres CLONE 1556047
  misc_feature (267)..(267): n is a, c, t, g, unknown, or other
ctccccgcggtggcggccgctctagaactagtggatcccccgggctgcaggaattcgtctcacccctagaaaaagtcgtagctccttctcctacacagaaaagccgtcgcctactcgcctccggccaaaaaactgactccacacacgacccaaatcttttcctctccacaggcgactcccaacgcaacagcagctcgtcgagcgagtcgtcgccggccggccggtatatacgcaagaaagccaagaaaaacacttctgcctcttccntcatatccaagaaccaaaggtagctagctagccgcgactcgttggctagacgattcaagcagcagcgcaggatggtggcgccggtggtgattgctttcggccggctgggcatgctgggccggcttgccatggccaaaccggtccctcgggaaggggcttccggggggctccagtggggaacggcccccccgcttgcccccgtggggggggcccccggcccctgggaagcaatttgaacccgtgggggcaaaagggaaccccggggggcggaaaatttctttgggggggggggaaaaaccccccgccccaaaggggggggggcccccgaggggggggcaacccccccccctgggggggggtctccccccacaaaaaaaaaaaagcccccgg

SEQ ID NO: 72599 - DNA, 629 bp, Zea mays
  misc_feature: Ceres CLONE 1556048
  misc_feature: Pfam Name: aPHC Pfam Description: Alkaline phytoceramidase (aPHC)
  misc_feature: SWISSPROT Homolog: EC 3.5.1.23 Ceramidase
atagctggagctccccgcggtggcggccgctctagaactagtggatcccccgggctgcaggaattcgtctcacccctagaaaaaggtctccgttcccctgccgacgagtgggcggccgctgccgccggcttacggaaggtgtgatctccatcttcgggacgttcgccaccggagcacccactccttttcttccgttcacgctgtgcgaaacggatcatccaaaaaccagctatttgtatctggatctgatccaatttcaatttgtggttatttctttggcgcactcatgatttagcaccagccaaattgacctttaactctggtgacataagctgttgctagggtagcaaatcaagagctaagaatggcagattcaatggtagcaagcttctgggggcctgtgacatcaacgactgagttgtgcgaggagaattatgcacactcgtcatatatcgcagaattctacaataccatctctaatgtcccatgcgttctttttgcacttattggattagtgaatgctttctgccaaagttttgagaaacgatttagtgtcctgcacatatccaatatgatacttgctattgggagtatgattttccatgccaccttggaacttcttctacaaa

SEQ ID NO: 72600 - DNA, 690 bp, Zea mays
  misc_feature: Ceres CLONE 1556052
  misc_feature: Encodes the peptide sequence at SEQ ID NO. 72601
  misc_feature (624)..(624): n is a, c, t, g, unknown, or other
  misc_feature (627)..(627): n is a, c, t, g, unknown, or other
  misc_feature (664)..(664): n is a, c, t, g, unknown, or other
ctccccgcggtggcggccgctctagaactagtggatcccccgggctgcaggaattcgtctcacccctagaaaaaacagagtcacttcgccacgaacaaaagcgcatcgatctcgctgtcgtcactcctcgtcacccagccacgaacagaggcaccacccagcatggccctgcaggcggcgctcctcccatccaccctctcatccgtccccaagaagtgcagcctcgccgtcgcggcgaaggacacggcattccttagcgtatcccagaagaaggtgcaggcggcgtcgctgtcggtgagaacgcgggtggcgacgacagcgcctgtggccacgccggggtccagcacggcttccaatgatggaaagaagaccgtgcggcagggcatagatggcgatcacctggaacatcgaacgagctgggccctgacagccagccaatgcgctggacagacaccgacaagcggccaattagtgattggccggcccgcgactcccgcaaggcggccaaggacaatgcgagagaaacagggatgagaatagagacgggcctccagggtcatgaacatcgaggaactgagagcgacaatatatataactaggcgtctccactgttttcaaaccacnccnccaagaataaggaaggggaggggggggaattctctcncctaccgagtggaggggaagggggga

SEQ ID NO: 72601 - protein, 123 aa, Zea mays
  misc_feature: Ceres CLONE 1556052
  misc_feature: SWISSPROT Homolog: EC 1.3.1.33 Protochlorophyllide reductase
MALQAALLPSTLSSVPKKCSLAVAAKDTAFLSVSQKKVQAASLSVRTRVATTAPVATPGSSTASNDGKKTVRQGIDGDHLEHRTSWALTASQCAGQTPTSGQLVIGRPATPARRPRTMREKQG

SEQ ID NO: 72602 - DNA, 639 bp, Zea mays
  misc_feature: Ceres CLONE 1556058
  misc_feature: Encodes the peptide sequence at SEQ ID NO. 72603
  misc_feature (520)..(520): n is a, c, t, g, unknown, or other
  misc_feature (521)..(521): n is a, c, t, g, unknown, or other
  misc_feature (592)..(592): n is a, c, t, g, unknown, or other
  misc_feature (611)..(611): n is a, c, t, g, unknown, or other
aaagctggagctccccgcggtggcggccgctctagaactagtggatcccccgggctgcaggaattcgtctcacccctagaaaactcccccattcgtcgcgatccaattccggcgccggagaagacgcgcgcaggccccacccagccgcctacaggcgctccgctcccacagacggacagtttgagctcgacggatgagcatgtgtgagaaagatcagaatttgccatggggatacgacctgttccgcgacccttttgctcctcccaacgggtactacgggcctcctcccggttactgtgatggccactgttgtgacctccatcattacggtagagcatcacatccagatgagactcagttgcattcttctcaactcgcatatgatatgtacaacccatcagtaggcatctaccatcctggaagcacccatgagcacgagcacgagacagtatatgtagaaccgtctagttcctctccagacacaggtggtgacggttgttttgagatggaggagaagtanngggagaaaaaagtttttacccccatggtccccagttccccatgtccccaaaaattaatgggagaaatcccnatcaattgatgaaagccanctatggacccatgaaaggctgaacagaa

SEQ ID NO: 72603 - protein, 135 aa, Zea mays
  misc_feature: Ceres CLONE 1556058
  misc_feature (109)..(109): Xaa is any aa, unknown, or other
  misc_feature (110)..(110): Xaa is any aa, unknown, or other
MSMCEKDQNLPWGYDLFRDPFAPPNGYYGPPPGYCDGHCCDLHHYGRASHPDETQLHSSQLAYDMYNPSVGIYHPGSTHEHEHETVYVEPSSSSPDTGGDGCFEMEEKXXEKKVFTPMVPSSPCPQKLMGEIPIN

SEQ ID NO: 72604 - DNA, 622 bp, Zea mays
  misc_feature: Ceres CLONE 1556063
  misc_feature: Encodes the peptide sequence at SEQ ID NO. 72605
  misc_feature (237)..(237): n is a, c, t, g, unknown, or other
  misc_feature (238)..(238): n is a, c, t, g, unknown, or other
  misc_feature (323)..(323): n is a, c, t, g, unknown, or other
  misc_feature (325)..(325): n is a, c, t, g, unknown, or other
aaagctggagctccccgcggtggcggccgctctagaactagtggatcccccgggctgcaggaattcgtctcacccctagaaaaatcccggctccgtcgtcgcgtgccatcctagggtttctttccccgtcggcgcctccccagatttggccgccgccgccgctgacccaggttgtcttgatggcgcccgctgtagaagccgtgaaggagacaggcaccttccagaaggtgcctgccnntgacgaaaggatactgtcatccatgtcccagaggtctgttgctgcacaccttggcatgatctggagataaggtcctggtgctccnancatattcaactgcctcattgagataccaaggggcagcaaggttaaattatgaacttgaccaagaaaactggactgatcaaaggggaaccggtgccggtattctccaattgggtaccctcacaaacattggatcctttccccgcacgccttttgaagacaagggatcctcttggaagtgcccgggtattaaggcaggagccccggtattccccaggtgtgttccaacaggggaaaaggcatctggcctttttccccttattggttctggggggaaggcgaatgaccaaatcatttgct

SEQ ID NO: 72605 - protein, 42 aa, Zea mays
  misc_feature: Ceres CLONE 1556063
  misc_feature (20)..(20): Xaa is any aa, unknown, or other
MAPAVEAVKETGTFQKVPAXDERILSSMSQRSVAAHLGMIWR

SEQ ID NO: 72606 - DNA, 605 bp, Zea mays
  misc_feature: Ceres CLONE 1556070
  misc_feature (185)..(185): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (367)..(367): n is a, c, t, g, unknown, or other
  misc_feature (368)..(368): n is a, c, t, g, unknown, or other
  misc_feature (438)..(438): n is a, c, t, g, unknown, or other
  misc_feature (439)..(439): n is a, c, t, g, unknown, or other
  misc_feature (470)..(470): n is a, c, t, g, unknown, or other
  misc_feature (485)..(485): n is a, c, t, g, unknown, or other
  misc_feature (504)..(504): n is a, c, t, g, unknown, or other
  misc_feature (505)..(505): n is a, c, t, g, unknown, or other
  misc_feature (506)..(506): n is a, c, t, g, unknown, or other
  misc_feature (584)..(584): n is a, c, t, g, unknown, or other
  misc_feature (585)..(585): n is a, c, t, g, unknown, or other
  misc_feature (586)..(586): n is a, c, t, g, unknown, or other
gtggatcttcccggggtggcgcgcctctctactagtgggtaccccgggctgcaggagttcgtctcacccctagaaaaacccgaatcgctccctctctgtccctccgctccagccgccgccgccgcctccgccctccgaatcccaatggcgtccgcgggccgctcctccaacctccctctccctcncnnnnnnnnnnnnnnnnnnnnnnnnnnnnnnnnnnnnacccaaaaaaaaaaaannnnggggggattcccccccccggtggccggcccccgttttctaaaaaaaaaaaaaaaaaaggggtgagagaaaaccccccccccgggggggccctgtttagggaaaaaaaaaattttttgggggtttnncccccccccccccccctaaaaaaaaaaaaaaaaaacccccccgggggggtttttcccccccccgccgccnnaaaaaaaaaaaaaaccccccccccaaggggnggggggggggggggntttttttttttttattttnnngaaaaaaaaaaaaaaaccccccggcccccccccgggggggcggaaaaaaaaaaaaaaaaaatggggatgggttttttnnnccccccccccccccccccc

SEQ ID NO: 72607 - DNA, 582 bp, Zea mays
  misc_feature: Ceres CLONE 1556077
  misc_feature: Encodes the peptide sequence at SEQ ID NO. 72608
  misc_feature (413)..(413): n is a, c, t, g, unknown, or other
  misc_feature (458)..(458): n is a, c, t, g, unknown, or other
aaagctggagctccccgcggtggcggccgctctagaactagtggatcccccgggctgcaggaattcgtctcacccctagaaaaaatcttcgccaaccgctgcgtcgcgagctcgccgccatggcattggctctccccctcgcccgcctcgtccccgcctgccagtgccaggcttggccccacctgcgctttcggaagcgccacgtctccttcgccgctcacgccagttctcgcgccgccttcgctgcctgcgcggcggcccctgccctccaggtccaggcgccggaggcggaggcggaggcggagacggtcgagcaagtgggcccgaagacacgcctcgtcgcgcagaacatcccgtgggactgcacggccgacgaaatgcgcgcgctcttcgagagcacggctccgtcgtcngcgtcgagctttcaatgtacagcgccaataaaaacagaggaattnggcgtttgtaaccatgggtttcagaagaaggaggctccttgcagctctcaccccatcctcaattcaacttatttttaaaatgattgggaaaaataaaggtgggacttcccaagggcctaaaaaa

SEQ ID NO: 72608 - protein, 138 aa, Zea mays
  misc_feature: Ceres CLONE 1556077
  misc_feature (113)..(113): Xaa is any aa, unknown, or other
MALALPLARLVPACQCQAWPHLRFRKRHVSFAAHASSRAAFAACAAAPALQVQAPEAEAEAETVEQVGPKTRLVAQNIPWDCTADEMRALFESTAPSSASSFQCTAPIKTEEXGVCNHGFQKKEAPCSSHPILNSTYF

SEQ ID NO: 72609 - DNA, 604 bp, Zea mays
  misc_feature: Ceres CLONE 1556095
  misc_feature: Translation starting site: 137
aaagctggagctcaccgcggtggcggccgctctagaactagtggatcccccgggctgcaggaattcgtctcacccctagaaaaaaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaagcccaaggtggcggcgtccggcagcccctggtacggccccgaccgcgtcaagtacctcggcccctttctcggcgaagccccgagctacctcaccggcgaagtcccccggcgactaccgctgggacaccggccgggctgtccggcgaaccccgagaacttcgccaagaaccgcgaggctggaagggatccacttccgcttggccatgctccgcgcgctcggctgcctcttccccgaactgctcttccccaaccgcgtcaagttccgccaaggcctccggttcaaaggccgcttccagatcttcaacgaaggccggcttgaataacctcggaaccccagcctgatcaccgcgcaaagcatccc

SEQ ID NO: 72610 - DNA, 588 bp, Zea mays
  misc_feature: Ceres CLONE 1556100
  misc_feature: Translation starting site: 124
  misc_feature: Pfam Name: PSI_PsaF Pfam Description: Photosystem I reaction centre subunit III
  misc_feature (290)..(290): n is a, c, t, g, unknown, or other
  misc_feature (293)..(293): n is a, c, t, g, unknown, or other
  misc_feature (294)..(294): n is a, c, t, g, unknown, or other
tggagctcaccgcggtggcggccgctctagaactagtggatcccccgggctgcaggaattcgtctcacccctagaaaaaaagccggacgacgcagcgtagcagcagagagccagagaccagagatggccgccctcgccgccgcctccacggccgccttcgccgcgaagccgcgcgcgcgcctctccgtggcctgctccgcccgcaccggcgacagcagcagcgtgtcgctcgcgtcctccgtgaagacgttctccgccgcgctggcgctgtcgtcggtgctgctggtctnggnncgcaacttccctcgggccggggccgcggaattggggggctgaccccgtggcaagagtcccagggggtcccccaaccccagaagaactcgattcaaaaactcccccccgtcccttaaaaaattacccgcccgaaaagggcccccccgctttgcctttaaagcccccctttgggaaaacacaaggcccggttccaaaactacagcaaaattcggggtggtgttgggggggcccaaaaggcttgcccaaccctttttgtttaggggggaaccaaggggattgggggggaagtttccc

SEQ ID NO: 72611 - DNA, 639 bp, Zea mays
  misc_feature: Ceres CLONE 1556101
  misc_feature (332)..(332): n is a, c, t, g, unknown, or other
tggagctcaccgcggtggcggccgctctagaactagtggatcccccgggctgcaggaattcgtctcacccctagaaaaaagcggcgtgttaacttatccactccctcggcactgcagctcagtgcccttcccagcctctcgctctcccgccgacgcgcacgtcctccgcgccgagcccagaggcagacagaggacgcggccatggcgtccatcccgtgcaccttccagctgagcacggcggcgtcgagggagggtgtcgccgcgggtggcggccagggaaaaagggccaaggaagaaggggaacccgttgcttaagaccccgctgctgggcnccggggaggccgggccctgggggtggcctgccgcccctccccgtttgaacccccctggtgggcgggccaaccaaaaaccggccgggccggttcccaactggccgggtcccaggtccgggcaccaaggaaccccaaaggtgcccggcattctacggaagccagggcaaggggacgacttcgaaccgggaccaacactcgaagaattacttccaactacctgggggatgcctggccggggaaagggcacctaccaaccagatgggaggcgcctgctgaacccaggaaactcccacccccgtggaactcc

SEQ ID NO: 72612 - DNA, 688 bp, Zea mays
  misc_feature: Ceres CLONE 1556106
  misc_feature: Encodes the peptide sequence at SEQ ID NO. 72613
  misc_feature (204)..(204): n is a, c, t, g, unknown, or other
  misc_feature (456)..(456): n is a, c, t, g, unknown, or other
  misc_feature (457)..(457): n is a, c, t, g, unknown, or other
  misc_feature (458)..(458): n is a, c, t, g, unknown, or other
  misc_feature (459)..(459): n is a, c, t, g, unknown, or other
  misc_feature (460)..(460): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (526)..(526): n is a, c, t, g, unknown, or other
  misc_feature (528)..(528): n is a, c, t, g, unknown, or other
  misc_feature (603)..(603): n is a, c, t, g, unknown, or other
ctggagctccccgcggtggcggccgctctagaactagtggatcccccgggctgcaggaattcgtctcacccctagaaaaggagtccgtatcgctcgctagtcacctaccgcaccgccaccgccaccgccgccgccgccagcgcgcccgtctcgcacgcgcagcacaggacgcgcgcgatcccctcgcgtccggatcgccatggncctcacgggcgttcgccgcccgcaagtatttcccggggcaccttgactcctccccgggaatggggccccgccggggccgggccacggggaggcttttctttttccccgtttccgcaaacccgtgttccttgtcccccttcgggtccccttggcctttgggccgggggggaagggttccccccccccccccccccaaatttttaggggggggggggaaatttggggccacccaaaaaatcccggggggggggnnnnnnnngggggggaccccccggggtcctccccccgggggggggcccccgggggtcccccaccccccaancntctttttttggcgccgaaagaaaaaattcttcgccccccccccccggggggggaggaaaaaaccccccccccccnccctcgagagaagagaagagatttttttttcctcccccgcccgggggcgggccgcgactaaatttcgttttattgtcctcaccct

SEQ ID NO: 72613 - protein, 141 aa, Zea mays
  misc_feature: Ceres CLONE 1556106
  misc_feature (65)..(65): Xaa is any aa, unknown, or other
  misc_feature (66)..(66): Xaa is any aa, unknown, or other
  misc_feature (67)..(67): Xaa is any aa, unknown, or other
  misc_feature (88)..(88): Xaa is any aa, unknown, or other
  misc_feature (89)..(89): Xaa is any aa, unknown, or other
  misc_feature (114)..(114): Xaa is any aa, unknown, or other
MGPRRGRATGRLFFFPVSANPCSLSPFGSPWPLGRGGRVPPPPPPKFLGGGGKFGATQKIPGGGXXXGGTPRGPPPGGGPPGVPHPPXXFFWRRKKKFFAPPPRGGRKKPPPPXLERREEIFFSSPARGRAATKFRFIVLT

SEQ ID NO: 72614 - DNA, 619 bp, Zea mays
  misc_feature: Ceres CLONE 1556131
  misc_feature: Encodes the peptide sequence at SEQ ID NO. 72615
ctggagctccccgcggtggcggccgctctagaactagtggatcccccgggctgcaggaattcgtctcacccctagaaaaagtcgatcaccaagacccaaccattgttggacgcgttcccctcctgcacgcaaccgtctcgcgtcctccagatcctggatggacgtcctccttgataccttgcctcccgagtgctctctgtgagctactttgttttcatttatcacgaaatccgtatgcttcatgttatgcaagctcagatctgattgctggattcggcatcttaccggcttggatagagctatggactgggagataactacctcccacgttggatccttgtatggcttagtccttgccttcaacgttcatgttgctttgttctcgtggtcgaccatccaatgttctgcttctggttccacatctggacaaatttctaactcgtcgacctcctctgcgtccggttcgcagcggatctgaggctacaatgatctgcaggctgccggatctcttggtctgcagtactgcttccctagatggatgatgtctctgcgctgacactattggatcattgacataactctgagacatctatacatgtgcccctgcaacagcaacgta

SEQ ID NO: 72615 - protein, 57 aa, Zea mays
  misc_feature: Ceres CLONE 1556131
MLLCSRGRPSNVLLLVPHLDKFLTRRPPLRPVRSGSEATMICRLPDLLVCSTASLDG

SEQ ID NO: 72616 - DNA, 639 bp, Zea mays
  misc_feature: Ceres CLONE 1556137
  misc_feature: Encodes the peptide sequence at SEQ ID NO. 72617
  misc_feature (42)..(42): n is a, c, t, g, unknown, or other
  misc_feature (49)..(49): n is a, c, t, g, unknown, or other
ctggagctccccgcggtggcggccgctctagactagtggatncccgggnctgcagggattcgtctcacccctaggaaattcatccagtgctctctcctcttgcgattcgctcgctcgatcctagcttcccttccaagaagcgcagcgcccatggccatggccacgcaagcctccgccgccacgcgccacctgctggccccgcagctggaccccagcacgccgtccccgatcttcggcggcagcacgggcgggctgctccgcaaggcgcaggtggaggagttctacgtcatcacgtggacgtcccccaaggagcaggtgttcgagatgcccaccggcggcgccgccatcatgcgggagggccccaacctcttgaagctggcgcgcaaggagcagtgcctggcgctcggcaccaggttgcgctccaagtacaagatcacctaccagttctaccgcgtcttccccaacggcgaggtgcagcacctccaccccaaggacggcgtctacccggagaaggccaaccccggcagggagggcggcggccagaacttccgcagcatcggcaagaacgtcaaccccatcgaacgacaagtcaccggcaagggcaccctcgacaaagcacacttcacgtacgccgcacgt

SEQ ID NO: 72617 - protein, 163 aa, Zea mays
  misc_feature: Ceres CLONE 1556137
  misc_feature (17)..(154): Pfam Name: PsaD Pfam Description: PsaD
MAMATQASAATRHLLAPQLDPSTPSPIFGGSTGGLLRKAQVEEFYVITWTSPKEQVFEMPTGGAAIMREGPNLLKLARKEQCLALGTRLRSKYKITYQFYRVFPNGEVQHLHPKDGVYPEKANPGREGGGQNFRSIGKNVNPIERQVTGKGTLDKAHFTYAAR

SEQ ID NO: 72618 - DNA, 653 bp, Zea mays
  misc_feature: Ceres CLONE 1556141
  misc_feature: Encodes the peptide sequence at SEQ ID NO. 72619
catagctggagctccccgcggtggcggccgctctagaactagtggatcccccgggctgcaggaattcgtctcacccctagaaaaaaagcactcaagccctgcccatcagcacaaccaccaccaccgcctggccgtcgtcacacgctcgcctccttccatggcgcccaggaacgctctccccgccgccagcgccgtggccaacggcatggtgatggagccgaggttccgcggcgtccggaagcgcccgtggggcaggttcgcggcggagatccgggacccggccaggaaggcgcgcgtgtggctcggcaccttcgacaccgccgaggccgcggcgcgcgcctacgacgccgccgcgctccacttccgcgggcccaaggccaagaccaacttccccgtcgcgttcgccgcgcttccgccgccgccgcccaagaagccggccgccgtgaccgtgagccccagcagcagcagcaccgtggagtcctcctcctcctcctcccgggactcgcccgccacgccgcccagggccgcgtctccgtcccaggccccgtcgctcgacctcagcctcggcggcacgccggccatggtggccgcccagccgttcctcttcctggacccgaggctcgcggtgaccgtggccgtgccggcgcccgtgc

SEQ ID NO: 72619 - protein, 165 aa, Zea mays
  misc_feature: Ceres CLONE 1556141
  misc_feature (21)..(72): Pfam Name: AP2 Pfam Description: AP2 domain
MAPRNALPAASAVANGMVMEPRFRGVRKRPWGRFAAEIRDPARKARVWLGTFDTAEAAARAYDAAALHFRGPKAKTNFPVAFAALPPPPPKKPAAVTVSPSSSSTVESSSSSSRDSPATPPRAASPSQAPSLDLSLGGTPAMVAAQPFLFLDPRLAVTVAVPAPV

SEQ ID NO: 72620 - DNA, 627 bp, Zea mays
  misc_feature: Ceres CLONE 1556151
  misc_feature: Pfam Name: YEATS Pfam Description: YEATS family
ctggagctccccgcggtggcggccgctctagaactagtggatcccccgggctgcaggaattcgtctcacccctagaaaaaagactcactcccgtcccccctgcctgcctgcgcgcgctctctgcctcgtggcggcgacgacgccctcctccaggtggccaggccatcctcagatcatattcctcggccccttctccggtgatgagcacccagaataaaaggctcaaggatgatgaaggtcagtttcccaatcgtctacggaaccatttccttctggctctgcaaataggccagcgagtataactctcacaagtggactgtatatgtccgctcggcaaacaatgaagatctgagtgtcataatcaagcgcgcggtgtttcagcttcacccgagtttccagaacccgacgagagtcgtgtagcagccgcctttccagctgtccgagtcggggtgcgggagagttctagatagccataaccctttatttccacagcgatgtctgtgacaagcgctgggatctgttccatcagcttaagctgtatccataagacgaagctggacctcaatcgacctaagagactgctgtcgtgaagacggacgatgatactgtcttccccgagcgtactat

SEQ ID NO: 72621 - DNA, 622 bp, Zea mays
  misc_feature: Ceres CLONE 1556159
  misc_feature: Encodes the peptide sequence at SEQ ID NO. 72622
  misc_feature (415)..(415): n is a, c, t, g, unknown, or other
  misc_feature (461)..(461): n is a, c, t, g, unknown, or other
  misc_feature (462)..(462): n is a, c, t, g, unknown, or other
  misc_feature (463)..(463): n is a, c, t, g, unknown, or other
  misc_feature (472)..(472): n is a, c, t, g, unknown, or other
catagctggagctccccgcggtggcggccgctctagaactagtggatcccccgggctgcaggaattcgtctcacccctagaaaaactcgccatcctacgcctcgcgccgccgccacagcaacccttgcagccccaatcccccacggcgaccatggccggcgcgcaggagtccctctccctggtgggcacgatgcgcggccataacggcgaggtgacggcgatcgcgaccccgatcgacaactcgcctttcatcgtctcctcctcccgggacaagtccgtgctggtgtgggacctgaccaacccggtccactccaccccggaatccggcgtcaccgccgactacagcgtccccttccgccgcctcaccggccactcccacttcgtccaggacgtcgtccttagttccgacagccangtcgcactctctggctcctgggacggcgagctccgcctttgagacnnntctcacggnctctacacccgccgcttcgtcagccacgagtaagacgtcatctccgtcgccttctccgtcgacacccggcagatcgtcctccgcgtcccgcgacaagaccatcaagctctgggacactctcggcgagtgcaagtacaccatcggcggcga

SEQ ID NO: 72622 - protein, 101 aa, Zea mays
  misc_feature: Ceres CLONE 1556159
  misc_feature (8)..(47): Pfam Name: WD40 Pfam Description: WD domain, G-beta repeat
  misc_feature: SWISSPROT Homolog: EC 2.3.1.48 Histone acetyltransferase
  misc_feature (88)..(88): Xaa is any aa, unknown, or other
MAGAQESLSLVGTMRGHNGEVTAIATPIDNSPFIVSSSRDKSVLVWDLTNPVHSTPESGVTADYSVPFRRLTGHSHFVQDVVLSSDSXVALSGSWDGELRL

SEQ ID NO: 72623 - DNA, 462 bp, Zea mays
  misc_feature: Ceres CLONE 1556172
  misc_feature (258)..(258): n is a, c, t, g, unknown, or other
tggagctcaccgcggtggcggccgctctagaactagtggatcccccgggctgcaggaattcgtctcacccctagaaaaaaggggaaaaccaagcctgcgtttcagagacaactcaggcggcgcgatggcgatggcggcgctgcgacgcgaggggaggcgcctcctcctctcccccaccggtccccaaccccgtctttcggcgggccgctttccgccttgcggtggacccccaatcccttccccccctttgtccccccnaccccggaaaaaaaggggctcccccccctttggggtgggcccggtttcttttttttttcccaacccccaaagtttttgggggggggaaaaccccccggattttaaaaaaaaattttttccaaaaaaaaccctcccccccaaaaaaatatcccccccaaggggggctttttttataaaaaaaaaggggtgtgtttctcccccccc

SEQ ID NO: 72624 - DNA, 626 bp, Zea mays
  misc_feature: Ceres CLONE 1556179
  misc_feature: Encodes the peptide sequence at SEQ ID NO. 72625
  misc_feature (437)..(437): n is a, c, t, g, unknown, or other
  misc_feature (509)..(509): n is a, c, t, g, unknown, or other
ttagctggagctccccgcggtggcggccgctctagaactagtggatcccccgggctgcaggaattcgtctcacccctagaaaaaagacagacacacacacacactcaacagcaacagctaagcctctcccaccagacagcaacatggctgaggaggaggccaagaaggtggaggtggaggtcaccaaggagcccgaggcggcacccgcggccgccgcggaggcggcggcgaaggaggacgtcgccgacgacaaggccgtcatccccgcgaccgacccgccgccgccgccggccgacgactccaaggccctggccatcgtcgagaaagttgcagatgaacctgctcccgagaagcctgcccctgcgaagcaagggggctccaatgacagggatctcgctcttgcaagggtggaaacagagaagaggaactctttgatncaagcttgggaagagaatgagaagacaaaagctgagaaacaggctgctaagaaagtatccgctattctttcntggggaaacccaagaaagcaaacttgaagcctgactgaaaaagatggaggacaacgggaaaaaaaaaggcctgatttgccaaaaaatgaaaaacaagttgctttgatccccagggaa

SEQ ID NO: 72625 - protein, 130 aa, Zea mays
  misc_feature: Ceres CLONE 1556179
  misc_feature (31)..(89): Pfam Name: Remorin_N Pfam Description: Remorin, N-terminal region
  misc_feature (98)..(98): Xaa is any aa, unknown, or other
MAEEEAKKVEVEVTKEPEAAPAAAAEAAAKEDVADDKAVIPATDPPPPPADDSKALAIVEKVADEPAPEKPAPAKQGGSNDRDLALARVETEKRNSLXQAWEENEKTKAEKQAAKKVSAILSWGNPRKQT

SEQ ID NO: 72626 - DNA, 655 bp, Zea mays
  misc_feature: Ceres CLONE 1556198
  misc_feature: Encodes the peptide sequence at SEQ ID NO. 72627
aaagctggagctcaccgcggtggcggccgctctagaactagtggatcccccgggctgcaggaattcgtctcacccctagaaaaagcagcgtgcatcgcggctcccgctcccacactcgcctccctcatcagtggcagctagtagcggcagcacccgcagctcgcaggagagagagagagagagagagagagagagagagcagccatgaaccacggaggcggagccgacaacggtgtgagccccggcaacgtcccggtgtgctactacggcgcggcggggcgcgtgccggcggcgctggagcggcgggtgcgcgccgcggagctgttcatgcggtgcgcggcgtgcgggctcgcggtgctcgccgcggcgctgctgggcgccgaccgccagacccgcaccttcttctccgtggagaaggcggcccggttcaccgacatgcagtcgctcgtattcctggtgatagcaaacgggatggcagcgtgctacagcctgctgcagggcgggaggtgcctggtgagcatcctcacaggtgggtggcgtactaatcaacaggccccagggcatggggcccatctttctcctgggaatcagggcatgggcgtactttcacgaatctcgggcggggggcccttggccaatgggaggccggccaatt

SEQ ID NO: 72627 - protein, 150 aa, Zea mays
  misc_feature: Ceres CLONE 1556198
  misc_feature (32)..(138): Pfam Name: DUF588 Pfam Description: Domain of unknown function (DUF588)
MNHGGGADNGVSPGNVPVCYYGAAGRVPAALERRVRAAELFMRCAACGLAVLAAALLGADRQTRTFFSVEKAARFTDMQSLVFLVIANGMAACYSLLQGGRCLVSILTGGWRTNQQAPGHGAHLSPGNQGMGVLSRISGGGPLANGRPAN

SEQ ID NO: 72628 - DNA, 564 bp, Zea mays
  misc_feature: Ceres CLONE 1556210
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (481)..(481): n is a, c, t, g, unknown, or other
  misc_feature (482)..(482): n is a, c, t, g, unknown, or other
  misc_feature (483)..(483): n is a, c, t, g, unknown, or other
  misc_feature (484)..(484): n is a, c, t, g, unknown, or other
  misc_feature (485)..(485): n is a, c, t, g, unknown, or other
  misc_feature (486)..(486): n is a, c, t, g, unknown, or other
  misc_feature (487)..(487): n is a, c, t, g, unknown, or other
  misc_feature (491)..(491): n is a, c, t, g, unknown, or other
  misc_feature (492)..(492): n is a, c, t, g, unknown, or other
  misc_feature (493)..(493): n is a, c, t, g, unknown, or other
  misc_feature (494)..(494): n is a, c, t, g, unknown, or other
  misc_feature (496)..(496): n is a, c, t, g, unknown, or other
  misc_feature (502)..(502): n is a, c, t, g, unknown, or other
  misc_feature (503)..(503): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaaaaagggtaactccacagagtgagagagcacctctagaaatagtaggaaccccagggcctgcaagaattagtctcacccctagaaaaattcaagttctatggtggtagcagcagagaatagcaatgacatatctaaagcgtcgtaattttctctatgctcaatccatatcccgagttgaaacaaattcgacctggattcttatattcaataaatagtgaaagctgaagcgcaaaacattgtttggaaatgaagggctggaaaaaaatttaataaggctcacttaaattggaaaaactttccaataaaaggggtttgaaaaaccaaagggggaaaaaaactttaaaactttnnnnnnngagnnnnanaaaaannaaaaaattcccttggacaaaaaaatccaaaaaactgaaaaggaaaaaaaattgaaacacca

SEQ ID NO: 72629 - DNA, 645 bp, Zea mays
  misc_feature: Ceres CLONE 1556218
  misc_feature: Translation starting site: 167
  misc_feature: SWISSPROT Homolog: EC 3.4.21.97 Assemblin
aaagctggagctccccgcggtggcggccgctctagaactagtggatcccccgggctgcaggaattcgtctcacccctagaaaaaaagacgccgtcgccgctcttggtgtttccgatcccaaaccccaaagacgctccaccggcacctccgctcccacaccacaccgatggcccgcacgaagcagacggcgcgcaagtccaccggaggcaaggcgccgcggaagcagctggagaccaaggcagcgcgcaagtcggccccggcaaccggcggcgtgaagaagccgcaccgcttccgcccgggcaccgtggcgctccgcgagatccgcaagtaccagaagagcacggagctgctcatccgcaagctccccttccagcgcctggtccgcgagatcgcgcaagacttcaagaccgacctccgcttccagtcctccgccgtcaccgcgctgcaggaggccgcggaggcctacctcgtcggcctcttcgaggacaccaagctctgcgccatccacgccaagcgcgtcaccatcatgcccaaggacattcagatcgcccgccgcatccgcggggagagcgcttaggcgtttacggatgattgacacgactgtagatgtctaggctatgttctcaccatgtcctaggtctgctt

SEQ ID NO: 72630 - DNA, 691 bp, Zea mays
  misc_feature: Ceres CLONE 1556220
  misc_feature (345)..(345): n is a, c, t, g, unknown, or other
  misc_feature (348)..(348): n is a, c, t, g, unknown, or other
  misc_feature (353)..(353): n is a, c, t, g, unknown, or other
  misc_feature (359)..(359): n is a, c, t, g, unknown, or other
  misc_feature (360)..(360): n is a, c, t, g, unknown, or other
  misc_feature (361)..(361): n is a, c, t, g, unknown, or other
acccgcggtggcggccgctctagaactagtggatcccccgggctgcaggaattcgtctcacccctagaaaaaacctcgctttgctgcttcactgcttgcttctgttgggcggagtgctaagaggacggcacgggagtcaagattcctcctccttaacctgccctttcgtgttgccgttgttggtggtttggtttgtgattgcggtggcgctggagttgcggtgtgtgtgaagcgagggatccgagattcttgtggattctgttctacttttcgattgctgctgatcctctctcccgtgcgacggcacaagcggcggttgtggggagagcatcccgcgttgccggnccntgganggcccnnngtccgtctatggaaacttgccgccccggtgccacgccccggccccggacctgaagtgctcaccaaggggcttttttgctggcaatctttagctggttggggctactgggggagtcccctggtttggtcccggcccctcatggacgggttagggggttgcaaaatggggcccccaaaggggctggcccctttggggggggcctttggggtttcccgccacagggccctttatttccttaaaggtttttgaggggggtttggggtaaaccttggggaaaaaaaaaaaaaaatcccctttccccggaaaaagggggggaagccctcgagggag

SEQ ID NO: 72631 - DNA, 679 bp, Zea mays
  misc_feature: Ceres CLONE 1556223
  misc_feature: Encodes the peptide sequence at SEQ ID NO. 72632
  misc_feature (235)..(235): n is a, c, t, g, unknown, or other
  misc_feature (294)..(294): n is a, c, t, g, unknown, or other
ctccccgcggtggcggccgctctagactagtggatcccccgggctgcaggaattcgtctcacccctagaaaaaagcaagcagcaaaggaaggggcactggttctctacacccttgccgatccttcaatggccgaggcgactaagaaggcctgcgatttctggggtgttccatgcaccgatgttcttcggcctactgtcgaagccattgcctctcacatcggtgttgctccatctnggaattccacgaagctctccgagtcgaaatggtcggctatcagaagattacttccaacngatcgatgctatcgatttcacccatcaacagacgacggggctctgccacagacctctaccgcgcagacatcgtgctttgccggcgttcgcgtacgggaaaacccccctgtccattttcctacctcaaaaaggaatcaggtggcaattgcccatccgggatggagtgacccttccaagtcccttttgaaatcaacccgaacaagttttttgactgaaattaaccccccgatcttttaggggattaaaaaacccggcgccaaaccttggtgttttatggggcgtcaaacatttccccttaaatggcccctgtgagggagagaacgggcccttgcaaaaaaaaattttttccaaaaacccccctgggcccctctttttggggtccctg

SEQ ID NO: 72632 - protein, 134 aa, Zea mays
  misc_feature: Ceres CLONE 1556223
  misc_feature (37)..(37): Xaa is any aa, unknown, or other
MAEATKKACDFWGVPCTDVLRPTVEAIASHIGVAPSXNSTKLSESKWSAIRRLLPTDRCYRFHPSTDDGALPQTSTAQTSCFAGVRVRENPPVHFPTSKRNQVAIAHPGWSDPSKSLLKSTRTSFLTEINPPIF

SEQ ID NO: 72633 - DNA, 616 bp, Zea mays
  misc_feature: Ceres CLONE 1556232
  misc_feature: Encodes the peptide sequence at SEQ ID NO. 72634
  misc_feature (400)..(400): n is a, c, t, g, unknown, or other
  misc_feature (458)..(458): n is a, c, t, g, unknown, or other
  misc_feature (459)..(459): n is a, c, t, g, unknown, or other
aagctggagctccccgcggtggcggccgctctagaactagtggatcccccgggctgcaggaattcgtctcacccctagaaaaaaaaaccatccgccggaggccggagggcagattctccaccatcgcctccactccaccctcactacgcgaatccgcggcgaacccccctctcggattccttctctcctccccgccccgatcgcgtcgtccagagaccgccaggctccggcgcccccgcccgcccgggctcgccgggggtcgggatgccctgctgctcgccgtcgctgctcggagtcgggccgcgggtgcgctcctttctccgcgactacgacgccctcccagtcctcgccctcgcactcatctacctccagattggttgtgcgctgattgggtcacttngggcattgttcaatgggggttcttgtgatcaacctagtgattgggtctattgctggtnngtgcatcgagagcagcagccagagacttggccgggcatatgctggtcttctcttctttgctgtcgtccttgacgttgcttggtttaaactcttcccccatgctatctggaactattaatctgatgagaagtttgggggaactttttggtttctcccc

SEQ ID NO: 72634 - protein, 88 aa, Zea mays
  misc_feature: Ceres CLONE 1556232
  misc_feature (46)..(46): Xaa is any aa, unknown, or other
  misc_feature (65)..(65): Xaa is any aa, unknown, or other
MPCCSPSLLGVGPRVRSFLRDYDALPVLALALIYLQIGCALIGSLXALFNGGSCDQPSDWVYCWXVHREQQPETWPGICWSSLLCCRP

SEQ ID NO: 72635 - DNA, 725 bp, Zea mays
  misc_feature: Ceres CLONE 1556239
  misc_feature: Encodes the peptide sequence at SEQ ID NO. 72636
  misc_feature (360)..(360): n is a, c, t, g, unknown, or other
ctggagctccccgcggtggcggccgctctagaactagtggatcccccgggctgcaggaattcgtctcacccctagaaaaataaaccgctcttcccatttccctcgccctgcgccgcctgcgtccacctccgctcgccgctctccccgcgtatccctctcatacgcagctcgcccaggtaagatgtcgtccgtggcgtcgaaggtggcggtgccggagtctgtgctccgcaagcggaagcgcgaggaacagtgggccaccgagaagaaggagaaggccctagtcgagaagaagaagtccatcgagagcccgcagctcatcttcacccgcgcaaagcagtacgccgagggatacgatgcccnaggagaggaactggtgcagcttaagcgtgaggccccgttgaaggggtgtttctatgtcagtcctgaagcaaagctgctctttgtggtccgattccggggattaacgcctgccccctaaacccggaagaactttccccttccggcaatggaggcaaatcttcaagggtgggttccccaagccaacaaaggggacttttaaaatggctccccagggtggaacccatttgtgggcatgggggccccaaaccttgaaaaggggcgggggggtttttttccaaaaggggggtttgggaaccttaaaacaccaaaggttcccctttttttcaaacccaattatttttgggggaggggggtgggggaaacaa

SEQ ID NO: 72636 - protein, 98 aa, Zea mays
  misc_feature: Ceres CLONE 1556239
  misc_feature (13)..(83): Pfam Name: Ribosomal_L30_N Pfam Description: Ribosomal L30 N-terminal domain
  misc_feature (60)..(60): Xaa is any aa, unknown, or other
MSSVASKVAVPESVLRKRKREEQWATEKKEKALVEKKKSIESPQLIFTRAKQYAEGYDAXGEELVQLKREAPLKGCFYVSPEAKLLFVVRFRGLTPAP

SEQ ID NO: 72637 - DNA, 660 bp, Zea mays
  misc_feature: Ceres CLONE 1556241
  misc_feature: Encodes the peptide sequence at SEQ ID NO. 72638
ctggagctccccgcggtggcggccgctctagaactagtggatcccccgggctgcaggaattcgtctcacccctagaaaaaaccacagcatccgcagttccccgaccacaccgttcctccgaggtccgagcccaggagcagccccgcgccaggaggaagtttgttcttttaacaatatgtcgagggaggagaatgtttacatggccaagttggctgagcaggctgaaaggtatgaggagatggttgagtatatggagaaggtggctaagactgtagatgtggaagagctcactgttgaggagcgtaatcttctgtctgttgcatacaagaatgtgattggggctcgccgcgcttcatggcgcattgtttcttccattgaacaaaaggaggagtcccgtaagaacgaagagcatgtgaaccttatcaaggaatatcgtggcaagatcgaggctgaactgagcaatatctgtgatggcatcttgaagctgcttgactcccacctagtgccttcttctactgctgctgaatcaaaggtcttctaccttcagatgaggggtgactatcacaggtatcttgcggaaatttagactggtgctgaaaggaggaatctgctgagagccacatggtggcctataaggctgctcaagacatgcttctgctg

SEQ ID NO: 72638 - protein, 136 aa, Zea mays
  misc_feature: Ceres CLONE 1556241
  misc_feature (3)..(137): Pfam Name: 14-3-3 Pfam Description: 14-3-3 protein
MSREENVYMAKLAEQAERYEEMVEYMEKVAKTVDVEELTVEERNLLSVAYKNVIGARRASWRIVSSIEQKEESRKNEEHVNLIKEYRGKIEAELSNICDGILKLLDSHLVPSSTAAESKVFYLQMRGDYHRYLAEI

SEQ ID NO: 72639 - DNA, 709 bp, Zea mays
  misc_feature: Ceres CLONE 1556242
  misc_feature: Encodes the peptide sequence at SEQ ID NO. 72640
  misc_feature (295)..(295): n is a, c, t, g, unknown, or other
  misc_feature (324)..(324): n is a, c, t, g, unknown, or other
  misc_feature (331)..(331): n is a, c, t, g, unknown, or other
  misc_feature (354)..(354): n is a, c, t, g, unknown, or other
  misc_feature (391)..(391): n is a, c, t, g, unknown, or other
  misc_feature (421)..(421): n is a, c, t, g, unknown, or other
ctccccgcggtggcggccgctctagaactagtggatcccccgggctgcaggaattcgtctcacccctagaaaaacccaccacacctccagtcctccactgacaagccgccgccgctcttccacctacctctccccggcctcgcacccatggccacggctttgatggttgcagccaccacctcctgctccccgggccgcgccgcgccgcgcctgaagccggtggcctcctcctcctccagcagcagcagcagcagctcggcgcggccgcggcggcccttggcgcagcagctcccgncgctgctggcgacggcggcggcggcggcngtagcanccgcgccgctccgggcgctggcngagcagatggagaaggccgcactgtttgacttcaccntgacgctcccggcgatcgcgaccgagtccntgctgctcatggtggcgctggacaagctctacttcaacccccttgggcagtccatggatgaccggaaaccaaaaatccccgtgaactcgcgaatttaaaggccccccccaagaagtgaaacccttgggggacaagggccggcccttatataaggggggcccccccaaaaaccggggggcctttaaaaagaaaaaaaagggaacacccccggaattggggggccaacttgggaaaaggagaccccccctggggggggcgcccctttttaaaggcgcccccccacccccg

SEQ ID NO: 72640 - protein, 123 aa, Zea mays
  misc_feature: Ceres CLONE 1556242
  misc_feature: SWISSPROT Homolog: EC 3.6.3.14 H(+)-transporting two-sector ATPase
  misc_feature (50)..(50): Xaa is any aa, unknown, or other
  misc_feature (62)..(62): Xaa is any aa, unknown, or other
  misc_feature (82)..(82): Xaa is any aa, unknown, or other
  misc_feature (92)..(92): Xaa is any aa, unknown, or other
MATALMVAATTSCSPGRAAPRLKPVASSSSSSSSSSSARPRRPLAQQLPXLLATAAAAAVAXAPLRALAEQMEKAALFDFTXTLPAIATESXLLMVALDKLYFNPLGQSMDDRKPKIPVNSRI

SEQ ID NO: 72641 - DNA, 692 bp, Zea mays
  misc_feature: Ceres CLONE 1556249
  misc_feature: Encodes the peptide sequence at SEQ ID NO. 72642
  misc_feature (647)..(647): n is a, c, t, g, unknown, or other
ctggagctccccgcggtggcggccgctctagaactagtggatcccccggggctgcaggaattcgtctcacccctagaaaaaaaaaaaaaaaaaaaaaaaaaaaaaaaaaaaactttcctagggtttcgtcgcttccagccgccgccgcgtccgcctcgccaagcgcagcagccgccgcagcacatcgctctctcgatctcagccatggcggaggtggagcagcaacaggacacgccgaagctcttcaaccgctggaccttcgatgatgtccaggtgaacgacatctcgctgaacgactacctcgctgtgaacgcgacgaagcacgcgatgtacctgccgcacaccgcgggacgttactccaagaagcggttcccgcaggcgcagtgcccgatcgtcgagcgccctacaaactcgctcatgatgcacgggcgcaaacacggcaagaaggtcatggctgtccccatcatcaagcataccctggaaaatcatcacttggttaccgatgcaaaccccttccgggtgggcgttaacccgattcttaaaagggggcccccgggggggaagccccccctatgggtctccccggggggtgttgaaaagaggggggccccgggaaaatcccccccccgcgagggggggggaaaaangggctttttcccccccccccccatgggggcccaggggaaaagttt

SEQ ID NO: 72642 - protein, 162 aa, Zea mays
  misc_feature: Ceres CLONE 1556249
  misc_feature (44)..(147): Pfam Name: Ribosomal_S7 Pfam Description: Ribosomal protein S7p/S5e
  misc_feature (148)..(148): Xaa is any aa, unknown, or other
MAEVEQQQDTPKLFNRWTFDDVQVNDISLNDYLAVNATKHAMYLPHTAGRYSKKRFPQAQCPIVERPTNSLMMHGRKHGKKVMAVPIIKHTLENHHLVTDANPFRVGVNPILKRGPPGGKPPLWVSPGGVEKRGAPGKSPPREGGGKXGFFPPPPMGAQGKS

SEQ ID NO: 72643 - DNA, 1072 bp, Zea mays
  misc_feature: Ceres CLONE 1556253
  misc_feature: Encodes the peptide sequence at SEQ ID NO. 72644
aaaaaaaaaacgccggcactcggcaataatcccacctgtctgtctccctccgcactgcttctcctctcctcgcggcgcgcatccatggcggcctcgtccgcctccctcctcgcccgtcgcctcatcatgtcccgccgcttcctgtcatccccactcggctccctctctaccacaaccgcgacgcgcagtttctcgatctcttctcccgggtttaaaagcttcgttgtggagtccgaccttgagaacgagcacgaccagccccccgcggaccagaaccgccagcagacgtcgaacagcccgcgcccgcccgacaccacccgccctctcgagaacggcctcgaccccggcatctacaaggcgatactggtggggaaggtcgggcaggagccgatgcagaagcggctgcggagcgggaagaccgtcgtgcttttctcgctcggcaccggtggcatccgcaacaaccgccgcccgctggatcgcgaggagccgcaccagtacgccgacaggtgctccgtgcagtggcaccgcgtctgcgtctatccagatcgcctcggcaccgtcgcgctcaacaacgtcaagactggcactattctctatttggaaggaaatcttgagaccaaagtgttctgtgatccaattactgggctagttagacgcataagagaaatagctgtgcgttcaagtggtcgtctcttgtttctgggcaatgacgccaatgctccaaagttaggcgaagtcaagggcgtcggctacttctgatattggtttatgtttaactgagcataccagttgcagggacagagtcatcataacggtgttactttactggaatctgagtggaccaacaaatcctggcggcgattcgagtcttttgccgtgttgaattttaccagattcctgttttgtcaagctctcagcaccactgtagataccttgtaatcgttgtaacagcaacatgtaggatgtgtgatcagtaatctgtactatccttaaagtactagtttcaacggtcgttctgcgtcatatttttcaaaaaaaaaaaaaaaaaaaaaaagaaaaaaaaaaaaaaaaa

SEQ ID NO: 72644 - protein, 224 aa, Zea mays
  misc_feature: Ceres CLONE 1556253
  misc_feature (89)..(206): Pfam Name: SSB Pfam Description: Single-strand binding protein family
MAASSASLLARRLIMSRRFLSSPLGSLSTTTATRSFSISSPGFKSFVVESDLENEHDQPPADQNRQQTSNSPRPPDTTRPLENGLDPGIYKAILVGKVGQEPMQKRLRSGKTVVLFSLGTGGIRNNRRPLDREEPHQYADRCSVQWHRVCVYPDRLGTVALNNVKTGTILYLEGNLETKVFCDPITGLVRRIREIAVRSSGRLLFLGNDANAPKLGEVKGVGYF

SEQ ID NO: 72645 - DNA, 573 bp, Zea mays
  misc_feature: Ceres CLONE 1556257
  misc_feature: Pfam Name: Ribosomal_S20p Pfam Description: Ribosomal protein S20
  misc_feature (345)..(345): n is a, c, t, g, unknown, or other
  misc_feature (389)..(389): n is a, c, t, g, unknown, or other
  misc_feature (414)..(414): n is a, c, t, g, unknown, or other
atagctggagctccccgcggtggcggccgctctagaactagtggatcccccgggctgcaggaattcgtctcacccctagaaaaagccttcataccctgctcgtcagcccggataagataacgcccatctgcacgggccacgcgaagcgttcgagctcctcccacggcagccatggtcaccgccaccacctccccgctcttctccctctcctccctccgcgcctccctcccttcccccacccgatttcacacgtctctctcgctccgagccctctccccacgtgcccgtctctctgcctccctccctttcgcctccccactcgtttcaggcgggtacgggacctgngcggcgacttcagtgtcgtccgcgggaaggctgagacggcgggngctaggagtggtgtgcgaagccacnactgggcggcggccggactcggttaagaagagggagcgccagaacgacaagcaccgcatcccaaatcacgcgcgcaaggccgagatgcgcactaggatgaaaaaagtcctaagaagctctgaaaagctaaggaagaacctgacccgcagctggagaaaa

SEQ ID NO: 72646 - DNA, 577 bp, Zea mays
  misc_feature: Ceres CLONE 1556258
  misc_feature: Encodes the peptide sequence at SEQ ID NO. 72647
  misc_feature (405)..(405): n is a, c, t, g, unknown, or other
  misc_feature (476)..(476): n is a, c, t, g, unknown, or other
  misc_feature (535)..(535): n is a, c, t, g, unknown, or other
aagctggagctccccgcggtggcggccgctctagaactagtggatcccccgggctgcaggaattcgtctcacccctagaaaaatatgggtgtcaaagcgtcggttctgcctgctggcactgactgccaccattttatactgtgaggataattggaataatttgcgaaaagccttatggaagcatatttttaagtatccctacagttcttgatccatcattagctcccgaatgacatcctatacttcatatatgtactgcatcacgcatataagattgtgagggtctttctagtgaggaatatgatgagaaaacagatgtcgtggccaatgagattatgagaaggcttgcaaagaagttgcttactcgatctctagaatcacagtcctgcaacatgtaggctcacnactacacactgaagatttctcgctcgagatgacggtacatattgacacatgcctcgtggtaaacggaatcncatactagctatcccctttcatactacctcgatagagggcctttactgtgtcggtgacnactgtttcccgggctacgtgacataactgacgcatctcaagg

SEQ ID NO: 72647 - protein, 35 aa, Zea mays
  misc_feature: Ceres CLONE 1556258
  misc_feature (8)..(8): Xaa is any aa, unknown, or other
  misc_feature (28)..(28): Xaa is any aa, unknown, or other
MPRGKRNXILAIPFHTTSIEGLYCVGDXCFPGYVT

SEQ ID NO: 72648 - DNA, 1573 bp, Zea mays
  misc_feature: Ceres CLONE 1556259
  misc_feature: Encodes the peptide sequence at SEQ ID NO. 72649
agcgcggtgtccaccactccctcctctcctctcccgtcctatccatccggcacgcccagcatccatccactcctcccctgctccggctccggctccggctccgccatgggcctttcaacagtttactccccggccggaccgcgcctcgtgccggcccctctcggccgctgccgctctgcccagccccgccgcccgcgccgagccccgctcgccaccgtccggtgctccgtcgacgccaccaagcaggcgcaggatggcgtggcgacggcggtcgcgacggaggcgccggcgtcgcggaaggagtgcttcggggtcttctgcaccacctacgacctcaaggcggaggacaagaccaagtcgtggaagaagctagtgaatgttgctgtgtcaggcgcggccgggatgatatcaaatcacctgctgttcaaactcgcttctggtgaggttttcggacaagaccaaccaataccacttaagctactcggctcagaaagatcgtttcaagccctcgaaggtgtagctatggaactggaggactcgctgtatccactgctgagggaagtcagcattggcatagatccttacgtggtctttcaagatgtagattgggcccttcttattggcgctaagccccgaggtcccggcatggagcgagctgcgctactggatatcaatggccaaatctttgctgaccaggggaaagcacttaatgcggtcgcctcgcggaacgcgaaagtcttagttgtcggaaatccctgtaacactaatgcgctgatttgtttgaaaaatgccccaaacataccggcaaaaaactttcatgcattgacgaggttggatgaaaatagagcaaagtgccagctggcactaaaagcaggtgtattttatgacaaagtatcaaacgtgactatttgggggaaccattcgacgactcaggttcctgatttcttgaatgccaaaattgatggaagaccagtgaaagaagtcattaaggataccaagtggttagaggaagagttcaccctcacagttcaaaagcgtggaggtgtgctcatccaaaaatggggcagatcatcagctgcatcgaccgctgtttcgatagtggatgctattagatccctcgtaactcctaccccagaaggtgactggttttctacaggggtttatacgactggaaatccttatggcatagcagaggatatcatgttcagcatgccatgcagatcgaagggtgatggtgattacgaactagctagtgatgtgttgatggacgattttctctgggaacggattaaaaagagcgaagctgaattgcttgctgagaagaaatgcgttgcccatcttacaggagaggggaatgcattctgtgatcttccggaagataccatgctaccaggagaagtgtagtttagttacagaagcaacagcagcggaatgcatttgccaatacattagctgagacttgaaacatctgcttgccagatgcagcaactacttttatatatatatgtgtatattcaataattgtgccacacgaatttgactatgatgcaaacctcttaaaaaaaaaaaaaaa

SEQ ID NO: 72649 - protein, 432 aa, Zea mays
  misc_feature: Ceres CLONE 1556259
  misc_feature (241)..(413): Pfam Name: Ldh_1_C Pfam Description: lactate/malate dehydrogenase, alpha/beta C-terminal domain
  misc_feature (90)..(239): Pfam Name: Ldh_1_N Pfam Description: lactate/malate dehydrogenase, NAD binding domain
  misc_feature: SWISSPROT Homolog: EC 1.1.1.82 Malate dehydrogenase (NADP(+))
MGLSTVYSPAGPRLVPAPLGRCRSAQPRRPRRAPLATVRCSVDATKQAQDGVATAVATEAPASRKECFGVFCTTYDLKAEDKTKSWKKLVNVAVSGAAGMISNHLLFKLASGEVFGQDQPIPLKLLGSERSFQALEGVAMELEDSLYPLLREVSIGIDPYVVFQDVDWALLIGAKPRGPGMERAALLDINGQIFADQGKALNAVASRNAKVLVVGNPCNTNALICLKNAPNIPAKNFHALTRLDENRAKCQLALKAGVFYDKVSNVTIWGNHSTTQVPDFLNAKIDGRPVKEVIKDTKWLEEEFTLTVQKRGGVLIQKWGRSSAASTAVSIVDAIRSLVTPTPEGDWFSTGVYTTGNPYGIAEDIMFSMPCRSKGDGDYELASDVLMDDFLWERIKKSEAELLAEKKCVAHLTGEGNAFCDLPEDTMLPGEV

SEQ ID NO: 72650 - DNA, 659 bp, Zea mays
  misc_feature: Ceres CLONE 1556261
ctggagctccccgcggtggcggccgctctagaactagtggatcccccgggctgcaggaattcgtctcacccctagaagaaaagctcttcaagcgctcaaaatccaggaatcatcttctgagtctgaggaatcacccgagagaataaatagcgcagtaggtacacgatcatcaagagctgctgcttcacggtctttgcttgaagcatgtgcaggtaatggtttcagagaataccaaccctaggcaaccggcctaactcacaatgacatgtttgggtacaatgtatcccctgtccaagaccagctgctgcattaccaaagcatgtatccacctcaacatccgtcaataacaatggggtttcatgacggttcttgggctgcaacaacgaatggaaactttcattatgctctaccatcccacttatattctagtacactcatattcagaataactgggaaccagtttattgatatatccttacatggctcccgccttcagccatatacctccagagcctattcactatgccgcatgcagctttagagtcatgcctatgtcactgccttttcaaaacggacatcggcaggctgctagtcttactcacagagacatgaatctctaaaggcgccctgcaaagttgactaactcgacaggcaacgaa

SEQ ID NO: 72651 - DNA, 603 bp, Zea mays
  misc_feature: Ceres CLONE 1556262
  misc_feature: Encodes the peptide sequence at SEQ ID NO. 72652
ctggagctccccgcggtggcggccgctctagaactagtggatccccccgggctgcaggaattcgtctcacccctagaaaacgctagtaccagtagtcgtcgcgttagcaggcagatctgagttagccggcggatccgatccgtgcgcgtgcagtgtacgtgtgtccggtggagatggccacagcttacgctcccatggcgagccaggtgatgaagagcagcctcgtcgtgcactcgaggccgaaggggcctgtcaggcgctgctgcgctcacgaggcggccgcgggtcaccgtcaaggccatccagcccgagaaggcacgttacaggtggtgcagcccatcaacggcgaacccttcatcggcaggctggagacgccggtcacctccagcccgctcgttcggtgggaactctccaaacttcccggcttacgaaacggccttgagcccgctgttgcggggcgttcaaggtcggcctcccgcacgggtaccttcctcgtggggccctttcgggctcaggggcccgctccgcagcacgccgtggacggggcaggccggggcgctttggggccccccggcttttgtgccttcccttaaggtctggctc

SEQ ID NO: 72652 - protein, 132 aa, Zea mays
  misc_feature: Ceres CLONE 1556262
  misc_feature (43)..(133): Pfam Name: PsaL Pfam Description: Photosystem I reaction centre subunit XI
MASQVMKSSLVVHSRPKGPVRRCCAHEAAAGHRQGHPAREGTLQVVQPINGEPFIGRLETPVTSSPLVRWELSKLPGLRNGLEPAVAGRSRSASRTGTFLVGPFRAQGPAPQHAVDGAGRGALGPPGFCAFP

SEQ ID NO: 72653 - DNA, 594 bp, Zea mays
  misc_feature: Ceres CLONE 1556269
  misc_feature: Encodes the peptide sequence at SEQ ID NO. 72654
  misc_feature (509)..(509): n is a, c, t, g, unknown, or other
aaagctggagctccccgcggtggcggccgctctagaactagtggatcccccgggctgcaggaattcgtctcacccctagaaaaagaggcaaacgccatagcggccaatcacttggcggcggcggcggccatggggcggctgaccgaggagcacgcggcgcgcgaggcgggctcggcggggaccaacgccacgtccctcaagctcacgcaccgcgctctctccgacgtgtcgtgcctgagcagcttctagaacctggagcacctcgacctcggcttcaactgcctcgtcactctcgagggtttgtgctcctgtgcacatgtgaagtggctttcagttcacgaatacaagcttgtgagcttaataggggtggaggcgctctcacagctgcacgtactgcatgctggcaagaacgcatctgctgagatggacgacgtcacatctttgacaagcctcggagcatcgagtgcttaatctgacgatatctactaccgtctgcgagctcgatcagntggcaacagctgcatacacttgatctctctgagaatcctgattttgctatgggaaatgctctggtcaaggctaagtctatgagca

SEQ ID NO: 72654 - protein, 39 aa, Zea mays
  misc_feature: Ceres CLONE 1556269
MGRLTEEHAAREAGSAGTNATSLKLTHRALSDVSCLSSF

SEQ ID NO: 72655 - DNA, 526 bp, Zea mays
  misc_feature: Ceres CLONE 1556289
  misc_feature (511)..(511): n is a, c, t, g, unknown, or other
ctggagctccccgcggtggcggccgctctagaactagtggatcccccgggctgcaggaattcgtctcacccctagaaaaaatcactccccacgcgattcgatcctctcgccggcccaggcatcgtagaatccccccaccgaaaaaatcaagcgggcatacaaagagcgcgtgcgcactgcgcagtgcttggaataggtgggtcgaacttcgaaggggttcgaggacttcagctatggcatctgtgggacgtgcaagacgaagaggggaaaggagatggagggaaaggggaaaaagggtccccttggttcccaggggcgtggaaggaaattacttgggtccaaggttccaagaaaaatttctcttcccccaaaaaaaaattatttccccggggggggggggggcctccccccggggggtaaaagataaacccccccgggggggcgcaaaaaaaaaaccctcttgggggggggtccccccccgaaaaaaatttttggggaaaaaacccccccncttaaatttcttctt

SEQ ID NO: 72656 - DNA, 990 bp, Zea mays
  misc_feature: Ceres CLONE 1556290
  misc_feature: Encodes the peptide sequence at SEQ ID NO. 72657
agcgctgcttgcttgtccgttgtcgcagagagagaaagagtgggatggcaatggagaggtcgttgtcgtgcgcggagaggggcagccagtacggcgccggggcgggggcgggggcgatgaacctccggagctacagcgcctcctacgagcgaccgacgacagcggcgccgtccacggtgcagcgcgccaggagcgtgagctcgtggagcacgccgccggcgccgccgcccgtgcagcgggccgggagcaccaagagcggccccaccgccgccgccggtggccgggccgccccggggctgaacctgcgctcctacagcgcctcctacgcggcctcctacgggcccaccctggccgataccggcgggcagctgaagcgctccggcagcgtcaccaactggacctccgccaaccgccgctccgtcaacctgagggggtacgccccgtccttcgccgcgatggacgacaccgccggcgcggtcccggcgcccaggaggaagctgcgggcgggggcggacgacgccgaggtgcagcggcggcggctggtcgtgtacaagacgtacggcgtggaagggaaggtccgggagtcggtgcgccgcggcgtcagctggatcaagggcaagtgctccggcgcggcctacggctggtggtgatcgatcgccgtgcccaccggcctatcggagtggtactactacggtctaccgtatgagctgatgcgctgcatgcccaccgccgcaccagtacctcctgttacttgttcttggagttaggatttttttaaaaaaaaatctttaggagatggatttggtggtatgtactgtagcatactagcatgagctgtggagcttcttctcttggtgagtgatctcgtgtcttgtgagggaaggagggagttcatgctgtgggtgtcctactcctctgtacagaacagaaatctggactcagtctggtctatgtaaatataggtgctgcgtatgtataaaaaaaaaaaaa

SEQ ID NO: 72657 - protein, 201 aa, Zea mays
  misc_feature: Ceres CLONE 1556290
MAMERSLSCAERGSQYGAGAGAGAMNLRSYSASYERPTTAAPSTVQRARSVSSWSTPPAPPPVQRAGSTKSGPTAAAGGRAAPGLNLRSYSASYAASYGPTLADTGGQLKRSGSVTNWTSANRRSVNLRGYAPSFAAMDDTAGAVPAPRRKLRAGADDAEVQRRRLVVYKTYGVEGKVRESVRRGVSWIKGKCSGAAYGWW

SEQ ID NO: 72658 - DNA, 696 bp, Zea mays
  misc_feature: Ceres CLONE 1556291
  misc_feature: Translation starting site: 80
  misc_feature (313)..(313): n is a, c, t, g, unknown, or other
  misc_feature (344)..(344): n is a, c, t, g, unknown, or other
  misc_feature (362)..(362): n is a, c, t, g, unknown, or other
  misc_feature (368)..(368): n is a, c, t, g, unknown, or other
  misc_feature (387)..(387): n is a, c, t, g, unknown, or other
  misc_feature (526)..(526): n is a, c, t, g, unknown, or other
ctccccgcggtggcggccgctctagaactagtggatcccccgggctgcaggaattcgtctcacccctagaaaaaacttcatgatcgatttcatgatgggcggtgtttcagctgctgtttcgaagactgctgctgctcccatcgagcgtgtgaagctgcttattcagaaccaagatgagatgattaagtctggtaggctatcagagccgtacaagggtattgttgactgcttcaaacgtaccattaaggatgagggtttctcttccttgtggaggggtaacactgctaatgttattcgttacttccctactcanggctttgaactttgcatttaaggactacttncagaggtttgtttacttncagaanggataggatgggttattgnaagtggtttgctggccaacctgggcctctgggtggtgctgctgggggctccctcttttgtttttggggactccttggactacgcgagaccaagtttggccaatgatgccaaggctggccaggggaggagtgaaaagcantttcatgggccttggggatgtctaccccaaaaacctcaaatctggaggggatggcggggctttaccgggaaataaacctttcccgggttgggaaatctttgtttatcgggggcctgaactttggggccttaaaaatcccatcaggcccgttgtcccttacggggaaaccc

SEQ ID NO: 72659 - DNA, 631 bp, Zea mays
  misc_feature: Ceres CLONE 1556292
  misc_feature: Encodes the peptide sequence at SEQ ID NO. 72660
  misc_feature (604)..(604): n is a, c, t, g, unknown, or other
ctggagctcaccgcggtggcggccgctctagaactagtggatcccccgggctgcaggaattcgtctcacccctagaaaaagccttcctccatccctcccccctaccctaccccccacacggccacacacacaccgccgcgtccgacccccacgccgtcgactgctcgaccggtcggctccgatggggtacgtgctgtcggcggtgggcagggtgctggagcagcccacggcgtggggggcggcctgggagatggcactcctcgcggggcccctgtgggcggcggccctcctcggcctgctgctcggctgggcctggcgcccgcgctgggcatccggcctcgtcgtcgccaccgcggacgacggcggtagccccgccgccgccgcgcagccgcccttcgccacgctcgacttctggaaggcccagctccccgcccgcctccgcgccccgctcggcaccgccgtgcagcagagggagggtgacacggacgccgtgcaacggaaccgcggaacggtggcgcttggcaggtcctcagagacggagacggcgacggtggggggtggggatggccgacctggtgaacctctggaggctggtggaggggcngcggactgcggcccggcctggaccaat

SEQ ID NO: 72660 - protein, 150 aa, Zea mays
  misc_feature: Ceres CLONE 1556292
MGYVLSAVGRVLEQPTAWGAAWEMALLAGPLWAAALLGLLLGWAWRPRWASGLVVATADDGGSPAAAAQPPFATLDFWKAQLPARLRAPLGTAVQQREGDTDAVQRNRGTVALGRSSETETATVGGGDGRPGEPLEAGGGAADCGPAWTN

SEQ ID NO: 72661 - DNA, 752 bp, Zea mays
  misc_feature: Ceres CLONE 1556294
  misc_feature (174)..(174): n is a, c, t, g, unknown, or other
  misc_feature (176)..(176): n is a, c, t, g, unknown, or other
  misc_feature (184)..(184): n is a, c, t, g, unknown, or other
  misc_feature (185)..(185): n is a, c, t, g, unknown, or other
  misc_feature (202)..(202): n is a, c, t, g, unknown, or other
  misc_feature (228)..(228): n is a, c, t, g, unknown, or other
  misc_feature (230)..(230): n is a, c, t, g, unknown, or other
  misc_feature (231)..(231): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (243)..(243): n is a, c, t, g, unknown, or other
  misc_feature (311)..(311): n is a, c, t, g, unknown, or other
  misc_feature (421)..(421): n is a, c, t, g, unknown, or other
ctccccgcggtggcggccgctctagaactagtggatcccccgggctgcaggaattcgtctcacccctagaaaaatttcttttgccagtgaagagggatcatttgtacaattgtactagcattcgcatttgttcaaatatttgtggaatataataaacaaatacatgcacgattnanaaaaaaannaaaaaaaggaaagaaancaaaacagaaaaaaggaaaggagtgncnngnnnngaaaggnacaaaaaaaaaaaaaaaaaaaaaatttcccggggaacttcaaccaattttggggccgctgtggacaangccctctgggggccccgaaaccccaaggggggggaaaaaaaacagggggggaaaatttgggagaaaaaaaaaaccggggagagtgtttggccttttgggcgaacccgttncccttttggggaaaataaaaggaaaaaaccgcgcaatttttccccccctaaaagggccccccccccccaaaaaaaagggccccgtttttctggcgataaaggggccaaaggggggaaatttttttttcaccccagttcccagtaaaaaaagggggggggagcaaaaaaaacccctcctcccacaagaggtttttgttctttgggaaccccccaaaacccgggggttaaccccccccttcaaatttcaaaaaaaaaaaaaaaaagtctttgccccaaaaaaaaaaagagggggaaaataccttgggggaaaaaagggggttcaaaccacccc

SEQ ID NO: 72662 - DNA, 645 bp, Zea mays
  misc_feature: Ceres CLONE 1556299
  misc_feature: Translation starting site: 171
aagctggagctccccgcggtggcggccgctctagaactagtggatcccccgggctgcaggaattcgtctcacccctagaaaaagcctccgctggacaccccgctccgcctccactcctcgcgccgctgccgcatctcctctacaggtaagaaggagagaaagagggcgaaatggtgaagcacaacaacgtcatccccaacgggcacttcaagaagcactggcagaactatgtcaagacatggttcaaccagcccgcccgcaagcagaggcgccgcatcgcacgtcaaaagaaggctgtgaagatattcccacgaccaactgctggccctcttcgtcccattgttcaatgccagactctcaagtcaacatgaagtcagggctgggagaggctttacccttgaggagttgaagctgcgggcattcaaaaaggcttgctccaccattggcattctggggatcaccgccgcaagaccaattcctttgagggctgcgagccaatgtccagaggcttaagaaatacaggcccaaactgggtattttcccaagggttgctcccaagggtaaggctgggggactttactctggggggagttttccccggctccccggggtacggggggaccacatgccaatttacccgggggg

SEQ ID NO: 72663 - DNA, 731 bp, Zea mays
  misc_feature: Ceres CLONE 1556306
  misc_feature: Translation starting site: 159
  misc_feature: SWISSPROT Homolog: EC 1.2.1.12 Glyceraldehyde-3-phosphate dehydrogenase (phosphorylating)
  misc_feature (1)..(1): n is a, c, t, g, unknown, or other
  misc_feature (298)..(298): n is a, c, t, g, unknown, or other
nagctggagctccccgcggtggcggccgctctagactagtggatcccccgggctgcaggaattcgtctcacccctagaaaaatatccgcatccgctgcctccgcctctcgagtctcgtccacccgtcgtcctcctagctcctctactcgccagtcgccatgggcaagattaagatcggaatcaacggcttcggaaggatcggcaggctcgtggccagggtcgccctccagagcgaggatgtcgagctcgtcgccgtcaacgaccccttcatcacacggactacatgacctacatgttncagtacgacaccgtccacggccactgggaagcacagcgacatcacactcaggactccaagacccttcttcttcgtggacaaagcggtgcaccgtccttggcatcagggaacccctgaggaaatccccgtggggggaaggcctgccccttagtttttcctgggaatccacccggggttcttcctggaaaaggaaaaagggttgctgacattccccaggggggggggccaaaaaggggtgtttttccttgcccccaagcaaaaaggccccccgtttttgttttttggggccaaaaggggaaaaatacccccccgggagtttaaaaatttttttcccaaggggggggggtgccacaaaaatggcttttggccccccttggtaaaggggttttttggaaaacctttcggggttttttgtagagggtttataaaaaca

SEQ ID NO: 72664 - DNA, 704 bp, Zea mays
  misc_feature: Ceres CLONE 1556309
  misc_feature: Encodes the peptide sequence at SEQ ID NO. 72665
  misc_feature (264)..(264): n is a, c, t, g, unknown, or other
ctcaccgcggtggcggccgctctagaactagtggatcccccggggctgcaggaattcgtctcacccctagaaaaaaaaaggcagcacaccaactcaccaagaaagtgtggaactgctcctgcctgcagcctcctgctcatcgaccctttcgccccacaagctcgattcctcgctcggccatggctgcacccgcggaggagacgcttgccgccgaggatacggcgtcaccaccgccgccggcgaggtctgcggggttctggtccnttggcgaggataagtctgtccacaggctctcggcgggggtaaaactgctgatgtacttttgtggaaagacagaagactctgctgcggtaattggtggtgcaactgtcccatggggttctggtcaaaatgaaaaaacccatctcccggacccggggtttcccggggcggattccgggacggacccttttggtccggggggcaatggcactgttctttataaaaaaagtccccccgggaggtcccgaagggcaaatattctgaaaccctggctggaaaattatggcctgaaatttggggggtaaaaaaaaaaagggactttgccccggtttgggggaaattgcctcgggccaaaaacccgggagaaatttcccgggggggggggcgccccccctttgggttttttttcaaagaaagggggggattttgttgtttcccctgag

SEQ ID NO: 72665 - protein, 128 aa, Zea mays
  misc_feature: Ceres CLONE 1556309
  misc_feature (29)..(29): Xaa is any aa, unknown, or other
MAAPAEETLAAEDTASPPPPARSAGFWSXGEDKSVHRLSAGVKLLMYFCGKTEDSAAVIGGATVPWGSGQNEKTHLPDPGFPGADSGTDPFGPGGNGTVLYKKSPPGRSRRANILKPWLENYGLKFGG

SEQ ID NO: 72666 - DNA, 688 bp, Zea mays
  misc_feature: Ceres CLONE 1556311
  misc_feature: Encodes the peptide sequence at SEQ ID NO. 72667
ctggagctccccgcggtggcggccgctctagaactagtggatcccccgggctgcaggaattcgtctcacccctagaaaaaaacggaagtttcggcggcgccggcgtgctcgtgatctcaacccaaggcgtgcctccgctccggtcacccgtcgctccacgcaaccatgtcgaggaggaagaccagggagcccaaggaggagaacgtcacccttggacccactgtccgtgaaggagagtatgtctttggtgtcgctcacatctttgcatccttcaatgacaccttcattcatatcactgatttgtctgggagggaaactctggttcggatcaccggtggcatgaaggtgaaggctgaccgtgacgagtcgtcaccttacgctgctatgcttgctgctcaagacgtcgcacagcgctgcaaggagcttggcattactgcactgcaacattaagctttcgcgcccccggaggcaacaagacccagacccctggaactggtggccagttctgcctcagggcgcctggctggttccgggatgaaaatccgacgcctttgaggaactttccccgggccccccttgaaaaacctccaaaaaaggggctttaaaagggaaaaaaggacccttaaacccccccccctcccgcggggttttccccgggttttggggcggggggcactttataaaaacc

SEQ ID NO: 72667 - protein, 94 aa, Zea mays
  misc_feature: Ceres CLONE 1556311
  misc_feature (28)..(95): Pfam Name: Ribosomal_S11 Pfam Description: Ribosomal protein S11
MSRRKTREPKEENVTLGPTVREGEYVFGVAHIFASFNDTFIHITDLSGRETLVRITGGMKVKADRDESSPYAAMLAAQDVAQRCKELGITALQH

SEQ ID NO: 72668 - DNA, 625 bp, Zea mays
  misc_feature: Ceres CLONE 1556321
  misc_feature: Encodes the peptide sequence at SEQ ID NO. 72669
ctggagctccccgcggtggcggccgctctagaactagtggatcccccgggctgcaggaattcgtctcacccctagaaaaagctttattatctctggtctggtcgctgcgcctcccgcttggccgcgagcccgcgaccatggcggcgccacccgtccccgtcctctgcagcgcttccccatgtcgcatcaccacccacctcgcccctcctgcctttcggaccgttgccgcggcgcggccgcaggccttgcccttcgtcttgtgcgtcgagcagcgcgtggggccctcggcgcgcgcgcgcgcgccgttcgcggccaagcgcggcggcggcggcgaggtatccgcggaagctccagacggcacgcgcgcgctgctccaggcggcgctctggggcgccgaggctgcctatatactctggctcttccttctgccttacgccccgggcgacccggtctgggcaatctcgcaggctaccatcagcgacctcatcggcctatcactcaacttcttcttcgtcctgccgctgctcaactcagttggcgttcacctgctcgaatcgcctctacttcaccctatggcagaaggattgttcaacttggtgctcgcttggacgctgctttttgcgcc

SEQ ID NO: 72669 - protein, 162 aa, Zea mays
  misc_feature: Ceres CLONE 1556321
MAAPPVPVLCSASPCRITTHLAPPAFRTVAAARPQALPFVLCVEQRVGPSARARAPFAAKRGGGGEVSAEAPDGTRALLQAALWGAEAAYILWLFLLPYAPGDPVWAISQATISDLIGLSLNFFFVLPLLNSVGVHLLESPLLHPMAEGLFNLVLAWTLLFA

SEQ ID NO: 72670 - DNA, 642 bp, Zea mays
  misc_feature: Ceres CLONE 1556323
  misc_feature: Encodes the peptide sequence at SEQ ID NO. 72671
aagctggagctccccgcggtggcggccgctctagaactagtggatcccccgggctgcaggaattcgtctcacccctagaaaaatcttctcttctgtctgtcttcctccgtgcgtcccggcgcgaaccctagccgagattagattgaggcgagcgccatcaccggaggaagaggaagacacgatgctgcgggttgcgggaagaaggctctcgtcttccctctcctggcgccccgccgtggcggcggccaggggccccctcgccggcgctggcgcccccgatcgggacgacggctcggctcgcggccggagccagacgcggttctccatcgactcccccttctttgtcgctgccaggggtttctcttcgactgaaacacttgtcccaggaaaccaagatgctggcctagctgacctcccagcaactgtggctgctgtgaagaatcctaaccctaaggtggtttatgatgagtacaatcatgaaagatatcctcctggagatcccagcaaacgtgcatttgcttactttgtcctgagtggtgggagattcatatatgcatcactgctgcgtctcctcgtattgaagtttgtcctgagcatgtcagcaagtaaggacgtgcttgcccttgcttcactcgaggtgga

SEQ ID NO: 72671 - protein, 153 aa, Zea mays
  misc_feature: Ceres CLONE 1556323
  misc_feature: SWISSPROT Homolog: EC 1.10.2.2 Ubiquinol--cytochrome-c reductase
MLRVAGRRLSSSLSWRPAVAAARGPLAGAGAPDRDDGSARGRSQTRFSIDSPFFVAARGFSSTETLVPGNQDAGLADLPATVAAVKNPNPKVVYDEYNHERYPPGDPSKRAFAYFVLSGGRFIYASLLRLLVLKFVLSMSASKDVLALASLEV

SEQ ID NO: 72672 - DNA, 634 bp, Zea mays
  misc_feature: Ceres CLONE 1556328
  misc_feature: Encodes the peptide sequence at SEQ ID NO. 72673
gaaagctggagctccccgcggtggcggccgctctagaactagtggatcccccgggctgcaggaattcgtctcacccctagaaaaaattcgaccattccatcctttccttatcccctcccacttcgtctcccttcctggcttcctttcttcgccatggcaaccatgtccctccgctccctcgccatggccatggccgacaccgcgctcccgcccgcccacaagctcctccccacagtttccctcccgctcctctcctcgtccacccgcgccgcgccgctcctcctcttcgccaggcgccgcctgccgctcgcgcccctcgttacctcctccgacgccgttgaggccaagtcggcagacgaggaggaggagaaggccggagagcccgtcgacatggaagctggggagtttgaggaggtgctagcctcaggcggcgagggtgaggggcagtacgctgctgtggagccgccagaaagagccaaggtctaccgttgggaacctcccctacgacgtcgacagcgaaggactcccgcaaatcttccaccaagcccgggttcttccaagtcccccgaaggtatcttcaaacgaaaaaacttggccaaaaccgtgggttttgggtttgttacccatgagcacc

SEQ ID NO: 72673 - protein, 160 aa, Zea mays
  misc_feature: Ceres CLONE 1556328
MATMSLRSLAMAMADTALPPAHKLLPTVSLPLLSSSTRAAPLLLFARRRLPLAPLVTSSDAVEAKSADEEEEKAGEPVDMEAGEFEEVLASGGEGEGQYAAVEPPERAKVYRWEPPLRRRQRRTPANLPPSPGSSKSPEGIFKRKNLAKTVGFGFVTHEH

SEQ ID NO: 72674 - DNA, 631 bp, Zea mays
  misc_feature: Ceres CLONE 1556330
  misc_feature: Translation starting site: 158
ggagctccccgcggtggcggccgctctagaactagtggatcccccgggctgcaggaattcgtctcacccctagaaaaagcgccgccgcagccccaaaccctcatcccccatcaacctcaggggtgccccagccaccccacccttcactcacctaaccatggcggagcgcggcggcgagcgtggtggagagcgcggcgggttcggccgtggcttcggtcgcggcgggcgcggtgaccgtggtgggcgtcgcggcggccgccgtggcccgcgccaggaggaagagaagtgggttcccgtcaccaagctcggccgccttgtcaaggagaacaagatcaccaagatcgaggagatctacctccactcgctccccgtcaaggagcaccagatcgtcgagaccctcgtcccggggctcaaggacgaggtcatgaagatcacgcccgtccagaagcagacccgtgccgggcagcgcactcgcttcaaggccttcgtcgttgtcggcgatggcgacggccacgtcggcctgggagtcaatgcgccaaggaggtggccaccgccatccgcggcgccatcatcctagccaagctctccgtcgtccccgtcagagagggtactggggggacaagatcggaca

SEQ ID NO: 72675 - DNA, 673 bp, Zea mays
  misc_feature: Ceres CLONE 1556337
  misc_feature: Encodes the peptide sequence at SEQ ID NO. 72676
  misc_feature (315)..(315): n is a, c, t, g, unknown, or other
  misc_feature (376)..(376): n is a, c, t, g, unknown, or other
  misc_feature (469)..(469): n is a, c, t, g, unknown, or other
  misc_feature (483)..(483): n is a, c, t, g, unknown, or other
  misc_feature (507)..(507): n is a, c, t, g, unknown, or other
  misc_feature (528)..(528): n is a, c, t, g, unknown, or other
  misc_feature (648)..(648): n is a, c, t, g, unknown, or other
aagctggagctcaccgcggtggcggccgctctagaactagtggatcccccgggctgcaggaattcgtctcacccctagaaaaaatccgcattcctcagatccagattcgagccccagccccgcttcgagatccagctagctctctatcaagcatccggcggagcgagcagcggggggctcggcgagagagaagatgaagcggaagacgcggaacaagatcatcgtatggacactggccctggctgcagtggcgattctggtgggcggcacgattgcgctggtgctcacggcggggacgtggaaggccaagataangaagtcgcaggagaagatctgtaacaaggggtgggagtgctcggggaagcagtactgctgncacgacaccatcaccgacttctttcaggtgtacccagttcgagaacctctttcgccaagcgcacacccccgtcgcgcacgccggtcggggtcntgggactaccaggnctttcatcacccgccgcgggcccntctcgagcccccagggggttnctgcaccaccgggcggcaagcagatgcagaatgatggggagctctgcgccttcccttggggcacggtcggcgcccaagacttcatgtgggggtacgggcgtggccgacccggcggccccnacggattgggggggctggggctcca

SEQ ID NO: 72676 - protein, 122 aa, Zea mays
  misc_feature: Ceres CLONE 1556337
  misc_feature (41)..(41): Xaa is any aa, unknown, or other
  misc_feature (61)..(61): Xaa is any aa, unknown, or other
  misc_feature (97)..(97): Xaa is any aa, unknown, or other
  misc_feature (105)..(105): Xaa is any aa, unknown, or other
  misc_feature (112)..(112): Xaa is any aa, unknown, or other
MKRKTRNKIIVWTLALAAVAILVGGTIALVLTAGTWKAKIXKSQEKICNKGWECSGKQYCXHDTITDFFQVYPVREPLSPSAHPRRARRSGSWDYQXFHHPPRAXLEPPGGXCTTGRQADAE

SEQ ID NO: 72677 - DNA, 654 bp, Zea mays
  misc_feature: Ceres CLONE 1556354
  misc_feature: Encodes the peptide sequence at SEQ ID NO. 72678
atagctggagctccccgcggtggcggccgctctagaactagtggatcccccgggctgcaggaattcgtctcacccctagaaaaatttcagcctcccctccctcacaagctctccagattccgctcccgcccgcgcaactagccagcctccaactccatggagaattatcacatgctcttcggacggccgtccacgcagccgtcctctgccgccacctccaactcctacaacttcatgctgccccctgccggcagcaccagcggcgccggcggcctgcgcgaccacgatagaggcggcggccagcacagcgggcatgccggcggcgtaccgtcgtcctcttccttcttcgcggagccatccaacacctcctccaaggacagtggcgcagcagctagcagcccgggagaagaaggagcgccggcctcggttcgccttccagacgcgcagccaggtcgacatcctcgacgacggctaccggtggcggaagtacggccagaaggccgtcaagaacaacaagttcccaagaagctactacagatgcactcaccaagggtgcaacgtgaagaagcaggtgcagcggctgtcaagggacgatgggcgttggtggtgaccacatacgagggcacccacacacaccccattgagaagtctaat

SEQ ID NO: 72678 - protein, 98 aa, Zea mays
  misc_feature: Ceres CLONE 1556354
  misc_feature (50)..(95): Pfam Name: WRKY Pfam Description: WRKY DNA -binding domain
  misc_feature: The sequence is a functional homolog of SEQ ID NO 16 in the 11/375,241 US patent application
  misc_feature: The sequence is a functional homolog of SEQ ID NO 2842 in the 10/374,780 US patent application
  misc_feature: The sequence is a functional homolog of SEQ ID NO 454 in the 10/225,066 US patent application
  misc_feature: The sequence is a functional homolog of SEQ ID NO 158 in the 10/714,887 US patent application
  misc_feature: The sequence is a functional homolog of SEQ ID NO 158 in the 11/435,388 US patent application
  misc_feature: The sequence is a functional homolog of SEQ ID NO 515 in the 10/374,780 US patent application
  misc_feature: The sequence is a functional homolog of SEQ ID NO 1112 in the 10/225,066 US patent application
  misc_feature: The sequence is a functional homolog of SEQ ID NO 2440 in the 10/374,780 US patent application
  misc_feature: The sequence is a functional homolog of SEQ ID NO 586 in the 10/412,699 US patent application
  misc_feature: The sequence is a functional homolog of SEQ ID NO 612 in the 10/225,066 US patent application
  misc_feature: The sequence is a functional homolog of SEQ ID NO 142 in the 10/714,887 US patent application
  misc_feature: The sequence is a functional homolog of SEQ ID NO 142 in the 11/435,388 US patent application
  misc_feature: The sequence is a functional homolog of SEQ ID NO 1610 in the 10/412,699 US patent application
  misc_feature: The sequence is a functional homolog of SEQ ID NO 970 in the 10/666,642 US patent application
  misc_feature: The sequence is a functional homolog of SEQ ID NO 154 in the 10/666,642 US patent application
  misc_feature: The sequence is a functional homolog of SEQ ID NO 236 in the 10/714,887 US patent application
  misc_feature: The sequence is a functional homolog of SEQ ID NO 236 in the 11/435,388 US patent application
  misc_feature: The sequence is a functional homolog of SEQ ID NO 1370 in the 10/666,642 US patent application
  misc_feature: The sequence is a functional homolog of SEQ ID NO 2246 in the 10/374,780 US patent application
  misc_feature: The sequence is a functional homolog of SEQ ID NO 256 in the 10/714,887 US patent application
  misc_feature: The sequence is a functional homolog of SEQ ID NO 256 in the 11/435,388 US patent application
  misc_feature: The sequence is a functional homolog of SEQ ID NO 670 in the 10/225,066 US patent application
  misc_feature: The sequence is a functional homolog of SEQ ID NO 90 in the 10/412,699 US patent application
MPAAYRRPLPSSRSHPTPPPRTVAQQLAAREKKERRPRFAFQTRSQVDILDDGYRWRKYGQKAVKNNKFPRSYYRCTHQGCNVKKQVQRLSRDDGRWW

SEQ ID NO: 72679 - DNA, 665 bp, Zea mays
  misc_feature: Ceres CLONE 1556364
ctggagctccccgcggtggcggccgctctagaactagtggatcccccgggctgcaggaattcgtctcacccctagaaaaatgaattaactaaaaaagcggatataaagggaataaaaatccaaattgcgggtcgtctagcaggaaaagaaattgcacgtgccgaatgcatcaaaaagggtagactacccctccaaacaattcgcgctaaaattgattattgctgctatccaattcgaactatctatggagtattaggtgtcaaaatttggatattcgtagaagaagaataactaaccatgtcttcccattccgcccagtgatagaataaaaaagacaagaaccttgtttttccaaaaatccctaaaaaaaagaagaaagtatccctctttctataagatttaatgaaaattaagaaatcttttaatataattgctatgcttagtgtgtgactcgttagttttttctttagggtcaaaaatggaaaaaaacttagtaatgatagaaaattaactaataaccaacctattgcttcgtattgtcgagatcctaactaagaaacagtcactatgtgaataaatacatctatcaaaaatgagtagatctatcatatagttgtagcaactgcatttttttctctacaaaagaaacctgattctaggctgtg

SEQ ID NO: 72680 - DNA, 655 bp, Zea mays
  misc_feature: Ceres CLONE 1556367
  misc_feature (655)..(655): n is a, c, t, g, unknown, or other
tggagctccccgcggtggcggccgctctagaactagtggatcccccgggctgcaggaattcgtctcacccctagaaaaaaatattaacacattgaaacatttctccttataaagagcatttcttggagtatagaggctggaaggattcgcgaagcattgaagcatgaacaataatttgtaaattgttaagtaatttagctcatcttaatataacatttttcctgtcatggagtattccaggttgattttgacccagtaaggtggcttgatcgagctttgatacgtttatgctcaaaatttggagattatcagaaggagacaccctcatcgttcagtttatccccacgactatcaatatttccccaatttatatttaatttgaggcgttctcagtttgttcaggtttttaataacagtcctgatgaaactgcgtattttaggatgatgttggacagagagaatgtaaccaatacagttgtgatgattcaaccttcacttatatcctattcatttcaatcagggccagagccagttctcttggatgcaactgcaattgcttctgacaagatccttttattggactcttattttactgttgtcatattccatggggtaaccattgcgcagtggcgaaatgctggctaccaagatcaan

SEQ ID NO: 72681 - DNA, 693 bp, Zea mays
  misc_feature: Ceres CLONE 1556373
  misc_feature: Encodes the peptide sequence at SEQ ID NO. 72682
  misc_feature (330)..(330): n is a, c, t, g, unknown, or other
  misc_feature (345)..(345): n is a, c, t, g, unknown, or other
  misc_feature (403)..(403): n is a, c, t, g, unknown, or other
cgctctagactagtggatcccccgggctgcaggaattcgtctcacccctagaaaaactcgagctcacacccacatatatacacacagaaatagtatatactaccaagcttgccgcttgtcgcctcacaacctacgacgagcggctaccttaattagctaagctagaattcttggggggcgcacgcggcagcgtctagctccgaggcgcggcggccatggcgaagccgcaggaggtgcgcagcgtcgactccttctcgcagctgccgttcatccggccggccccgcccccggctccggcgcagcccgaggacgcccacatccgggctctcngctgcgacttctccnacgacgaccagcagcagcggcaaggccagcagcagcagcagcaccgccaggaacgccngcgccgggcgacccccccgacgccgccaacgggagctggatcacgttcgaagagcaacaacggacccacaaaaaaccggcggcgccggcggcgccgcccttaacaggaaattcaagtggccattactggttgccgaaatttccccaactttccaagcccctgggcggggcacccaaaacccgcccaaaggcggaagggggaaccacgccaaggggggcccaacttccggggcctcccttcgccattgacccgtttcggggccggggccaattttgaggcgcttttaaaat

SEQ ID NO: 72682 - protein, 96 aa, Zea mays
  misc_feature: Ceres CLONE 1556373
  misc_feature (39)..(39): Xaa is any aa, unknown, or other
  misc_feature (44)..(44): Xaa is any aa, unknown, or other
  misc_feature (63)..(63): Xaa is any aa, unknown, or other
MAKPQEVRSVDSFSQLPFIRPAPPPAPAQPEDAHIRALXCDFSXDDQQQRQGQQQQQHRQERXRRATPPTPPTGAGSRSKSNNGPTKNRRRRRRRP

SEQ ID NO: 72683 - DNA, 665 bp, Zea mays
  misc_feature: Ceres CLONE 1556374
  misc_feature: Encodes the peptide sequence at SEQ ID NO. 72684
  misc_feature (446)..(446): n is a, c, t, g, unknown, or other
  misc_feature (515)..(515): n is a, c, t, g, unknown, or other
ctggagctccccgcggtggcggccgctctagaactagtggatcccccgggctgcaggaattcgtctcacccctagaaaaagaggcgagggaaaacaagtgagtgagaaagagagagagaggagggaaaatgctgcgccacgccgcccgccgcctcgtttcccgcgccgtcgctccgcccaccgcgcgccgggcgctcgccacggcggaggtgcccgcggaggccgtcgaggactccacgttcgtcgaggcctggaaaaaggtcgcccccaacatcgagcccccagcgacgcccctctccctcatgcagccgcgcccgcccacgccagctaccatccctaccaagctcaccgtcaacttcgtcctcccctacaagtccgagatcgccaacaaggaggttgacatggtaattgtaccagctacaactggtcagatgggtgttttgccnaggcatgttgcccacattgcagagctcaagcctggtgttctctcagtacatgaaggaaacgatgtgagncagtacttttgtgagcaggtggggttgctttcgtccatgcaaactccattgctgataattggggctgttgagggattccctgggggatcggaaccaccccaccattggttcaaaaggggccccgctaatttcctggccaagcttggggcg

SEQ ID NO: 72684 - protein, 179 aa, Zea mays
  misc_feature: Ceres CLONE 1556374
  misc_feature (72)..(156): Pfam Name: ATP-synt_DE_N Pfam Description: ATP synthase, Delta/Epsilon chain, beta-sandwich domain
  misc_feature: SWISSPROT Homolog: EC 3.6.3.14 H(+)-transporting two-sector ATPase
  misc_feature (129)..(129): Xaa is any aa, unknown, or other
MLRHAARRLVSRAVAPPTARRALATAEVPAEAVEDSTFVEAWKKVAPNIEPPATPLSLMQPRPPTPATIPTKLTVNFVLPYKSEIANKEVDMVIVPATTGQMGVLPRHVAHIAELKPGVLSVHEGNDVXQYFCEQVGLLSSMQTPLLIIGAVEGFPGGSEPPHHWFKRGPANFLAKLGA

SEQ ID NO: 72685 - DNA, 685 bp, Zea mays
  misc_feature: Ceres CLONE 1556378
  misc_feature: Encodes the peptide sequence at SEQ ID NO. 72686
  misc_feature (42)..(42): n is a, c, t, g, unknown, or other
  misc_feature (333)..(333): n is a, c, t, g, unknown, or other
  misc_feature (337)..(337): n is a, c, t, g, unknown, or other
ctccccgcggtggcggccgctctagaactagtggatcccccngggctgcaggaattcgtctcacccctagaaaaaaaatagaaaaatcaagtgaagccggtaaagaaaaaaatggcagtggttggcctatccagtgctttcgctcctctcagaggttcttggatagccgtaaggatcaggcagggtggccaacgtgcagggatcagcttgtgtccatctccaaggagcaggaggagctgcgcggcagtggttcgggcggaggtgagcttcgtggacgccgacgaagcgagaagctcgtgggcgaagagggctacacggtgctggacatcaggnacanggcgcagcgcgagagggcacacatcaagttcttccacacacgtgccctctctcattgagacccaagacaacgaccttggggaccatcgttgagcggcagcttgcaaacaacttcgcgggggctcttcttggggctggccttcccaaagctaaacccggaattccccctgaaagtcaagacaaatttccccccgaaaacaacctgctgggttttctgccagaaaggtccaaccacctgcttccaaatgccctggaaaaaaaaaggctcccaaaatttggatggcctccaccggggtttcaaaaaatgaaacccggaaaccttttaatttttggggaaaaaaaacctctc

SEQ ID NO: 72686 - protein, 105 aa, Zea mays
  misc_feature: Ceres CLONE 1556378
  misc_feature (76)..(76): Xaa is any aa, unknown, or other
MAVVGLSSAFAPLRGSWIAVRIRQGGQRAGISLCPSPRSRRSCAAVVRAEVSFVDADEARSSWAKRATRCWTSGTXRSARGHTSSSSTHVPSLIETQDNDLGDHR

SEQ ID NO: 72687 - DNA, 693 bp, Zea mays
  misc_feature: Ceres CLONE 1556390
  misc_feature: Encodes the peptide sequence at SEQ ID NO. 72688
  misc_feature (466)..(466): n is a, c, t, g, unknown, or other
ctggagctccccgcggtggcggccgctctagaactagtggatcccccgggctgcaggaattcgtctcacccctagaaaaactccaccatctacgaacgggggccgggaaaagatcggctacagacagatgaggctctgtctccggcaagcggcggccaccagctcacccctcgcagctaccctccgcggcaagacttctacgagcaccctcgccccccatggccggctcagcttcagccacaccacgtcgctgcagacggcgcccgggcaccgcgggctccgagcagggtgggcggtgcgcgtgctcccgctgacggaggagaacgtggagaaggtgctggacgaggtgcggccgagcctgatggcggacggcggcaacgtggcgctgcacgagatcgacggcctcgtcgtcgtgctcaagctgcagggcgcgtgcggctcctgccccagctccaccatgacgctncagatgggcatcgagacgcgcctccgcgacaagatccccgacatcctcgaggtcgagcagatcgtcgacaccgagaccggcctcgaccctcacgccgacaacgtcgaacaggtgcttgatgagatcagaccgtacctctccggcactggaggtggaagcctcgagcttctccagattgacggatacgtcgtcaagatccggatcggcggacctgcagccggtgtatg

SEQ ID NO: 72688 - protein, 188 aa, Zea mays
  misc_feature: Ceres CLONE 1556390
  misc_feature (67)..(134): Pfam Name: NifU Pfam Description: NifU-like domain
MRLCLRQAAATSSPLAATLRGKTSTSTLAPHGRLSFSHTTSLQTAPGHRGLRAGWAVRVLPLTEENVEKVLDEVRPSLMADGGNVALHEIDGLVVVLKLQGACGSCPSSTMTLQMGIETRLRDKIPDILEVEQIVDTETGLDPHADNVEQVLDEIRPYLSGTGGGSLELLQIDGYVVKIRIGGPAAGV

SEQ ID NO: 72689 - DNA, 692 bp, Zea mays
  misc_feature: Ceres CLONE 1556396
  misc_feature: Encodes the peptide sequence at SEQ ID NO. 72690
  misc_feature (479)..(479): n is a, c, t, g, unknown, or other
  misc_feature (489)..(489): n is a, c, t, g, unknown, or other
ctggagctccccgcggtggcggccgctctagaactagtggatcccccgggctgcaggaattcgtctcacccctagaaaaaagagccgcaccagcacactcccgcagcagtagccgccgccgccgccgccgcagcccagccgtaggaaacaggaggaagatgccggcggggcacgggcttcggtcgcggacccgcgacctgttcgcgcggccgttccgcaagaagggttacatcccgctcaccacgtacctgcgcacctacaagatcggcgactacgtcgacgtcaaggtgaacggcgccgtgcacaagggcatgccgcacaagttctaccacggccgcaccggtcgcgtctggaacgtcaccaagcgcgccatcggcgttgagatcaacaagcaggttaatggccgcatcatcaggaagcgtatccatgtccgtgtggagcatgtgcagccctcccgttgcacagaggagttccgcttngaggaagccnagacgatcagctcagggttgatgcccaggaccgtggtggagtgatcagcaccaagaggcagcctggtgggacccaacctggcttcatgggtgaaggtgctaccctggagaacgttactcccattccctatgatgggggaaatgaaccccagggggggtacctaaaaagaatttttttttctttggccgttttaagggggcgtg

SEQ ID NO: 72690 - protein, 124 aa, Zea mays
  misc_feature: Ceres CLONE 1556396
  misc_feature (2)..(100): Pfam Name: Ribosomal_L21e Pfam Description: Ribosomal protein L21e
  misc_feature (107)..(107): Xaa is any aa, unknown, or other
  misc_feature (111)..(111): Xaa is any aa, unknown, or other
MPAGHGLRSRTRDLFARPFRKKGYIPLTTYLRTYKIGDYVDVKVNGAVHKGMPHKFYHGRTGRVWNVTKRAIGVEINKQVNGRIIRKRIHVRVEHVQPSRCTEEFRXEEAXTISSGLMPRTVVE

SEQ ID NO: 72691 - DNA, 635 bp, Zea mays
  misc_feature: Ceres CLONE 1556397
  misc_feature: Encodes the peptide sequence at SEQ ID NO. 72692
ctggagctccccgcggtggcggccgctcctagaactagtggatcccccgggctgcaggaattcgtctcacccctagaaaaaatcagcctcatcaacctcgacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacggaggtacgacgcggccgtcgtcgtcactaccaccaccactgctagagctgcggcggctgctgtcacggttcccgccgcccccgcgcatgggccagcggctggcgccgtgcccacaaagcaagcggcggcacccgccgagaagaagagcccgtccggggtcggaacacatggcggccctcatggccaagggcaagaacggggttcatcccttaaatcaccgccgggcgaccgggacctagcaacaacggcccaagcccttcttctgctgaaccgctggggccccaacctcctcaacgggggggtaccctggttggaaccccctatttaagggccacttttccagggcttgggggggccggggctttggcaaggggcccccc

SEQ ID NO: 72692 - protein, 146 aa, Zea mays
  misc_feature: Ceres CLONE 1556397
MAFAPKTSSSSSLSSALQAAQSPPLLLRRMSSTATPRRRYDAAVVVTTTTTARAAAAAVTVPAAPAHGPAAGAVPTKQAAAPAEKKSPSGVGTHGGPHGQGQERGSSLKSPPGDRDLATTAQALLLLNRWGPNLLNGGVPWLEPPI

SEQ ID NO: 72693 - DNA, 504 bp, Zea mays
  misc_feature: Ceres CLONE 1556421
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (419)..(419): n is a, c, t, g, unknown, or other
  misc_feature (420)..(420): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnttttttccatgctgggactccccgcggtggcggccgctctagaactagtggatcccccgggctgcaggaattcgtctcacccctagaaaaagctagtaccagtagtcgtcgcgttagcaggcagatctgagttagccggcggatccgatccgtgcgcgtgcagtgtacgtgtgtcggtggagatggccacagcttacgctcccatggcgagccagggtgatgaagagcagcctcgtcgtgcactcgaggccgaagggcctgtcaggcgctgctgcgctcagaggcggccgcggttcaccgtcaagggcatccagcccgagaaggcaacgtaccanngtggtgcagcccatcaacggcgaaccccttcatcggcagccctggagacgccgggtcaacctccaccccggttcgttcgcggtg

SEQ ID NO: 72694 - DNA, 633 bp, Zea mays
  misc_feature: Ceres CLONE 1556423
  misc_feature: Encodes the peptide sequence at SEQ ID NO. 72695
atagctggagctccccgcggtggcggccgctctagaactagtggatcccccgggctgcaggaattcgtctcacccctagaaaaactccatccgaaaccaactgacatcgccccgcagccaagaagctcggctcggctcagctcagctcagttggttcctccattttgagtggaggactgactgtcctcccgtcggccgtctcgcgatgctgatggggttccccgtggggtactcggagacgcccaagctgctgctgcacctcctcttcctcctcgaccacctgcgccgcctctcctcctggctgctccgcctcgcgggcgccgccgacgccgacgccgacaccgacgccggccaccctcgccacccctgcgccgccgcccagcgcctggaggagcactcccccgcggtgcgcttcgactcgctgtcgtgcggaacggaaaaaggggtgatggcgccgcgcccgctgcccgagggctgctgcgtctgcctgggcgacttccacgccgccgccgaggtgcgccgcgcccggggctgccgccacgtcttccaccgcgcctgcctaccgctgggccgcgcacggccaccgcacctgcccgctctgccggacgccgctcctcccgccgctgccgctgc

SEQ ID NO: 72695 - protein, 142 aa, Zea mays
  misc_feature: Ceres CLONE 1556423
MLMGFPVGYSETPKLLLHLLFLLDHLRRLSSWLLRLAGAADADADTDAGHPRHPCAAAQRLEEHSPAVRFDSLSCGTEKGVMAPRPLPEGCCVCLGDFHAAAEVRRARGCRHVFHRACLPLGRARPPHLPALPDAAPPAAAA

SEQ ID NO: 72696 - DNA, 654 bp, Zea mays
  misc_feature: Ceres CLONE 1556427
  misc_feature (198)..(198): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (231)..(231): n is a, c, t, g, unknown, or other
  misc_feature (243)..(243): n is a, c, t, g, unknown, or other
  misc_feature (330)..(330): n is a, c, t, g, unknown, or other
  misc_feature (331)..(331): n is a, c, t, g, unknown, or other
  misc_feature (335)..(335): n is a, c, t, g, unknown, or other
  misc_feature (338)..(338): n is a, c, t, g, unknown, or other
  misc_feature (352)..(352): n is a, c, t, g, unknown, or other
ctggagctccaccgcggtggcggccgctctagaactagtggatcccccgggctgcaggaattcgtctcacccctagaaaaactccacccacgcctccactacaccacacagagccgcagcagactcgcaagggaaaggagatggatcgtctgcccgagtcgacccggagcatgaggaagtacgcgtcggaagccggcnggcttcnnncgcgcgcgcagggcccccacgggncggtcgctgacngcgcgcacggcgcacagcatgttcaccaacggcgctgcgcaccaagtccaaatctggccgcgttcctgctgggcagggtggcctttnngggncgntccgccccgttccngggcaaacttgggaggaggtgttcccctggggaccaaattcgcccggggttttttccccgccgggtgcccctttgccttttgcccccccagttgggggcccccttttgggccccggggggggggggggtttttaaccttaaaaccaattttgggggctcttctccccccccgccgaaaaaggggtgtgaccttttctctcccccccggggatatttctggttttttttcccgccccccccccccgggggggggggggggctctttttaaaaaaaaaatttgtgggggggaaacccccccccc

SEQ ID NO: 72697 - DNA, 686 bp, Zea mays
  misc_feature: Ceres CLONE 1556438
  misc_feature: Encodes the peptide sequence at SEQ ID NO. 72698
aagctggagctccccgcggtggcggccgctctagaactagtggatcccccgggctgcaggaattcgtctcacccctagaaaaagcgttcccaacctacccctgcaagccattgccctcgcctatcgcctcgtgcaagtccaagctcccacgactccaccgcgaccgggagagagtcagagagagacgcccgcctccagatcgtccggcggggatggcggcgtcggtctttccagcgctgctgctggccgtagcggcggtgcttctcctaccggtggcagaggccgtgtggctcgagctcccgccgtcggggaccaagtgcgtctccgaggagatccagcccaacgtcgtagtgctcgccgactacgctatcatgtacgagtcccaccccagctcgcatcccaccgtcgccgtcaaggttacatcaccctatggcaatactgtgcatcataatgaaaatgctacaacggggcagtttgcatttccccacttcagaagctgggaaactaccttgcatggttctgggatagacggcggggaaaaagggtcagggaccttctcttaatcttggttggaaaaaaggggattgctgccaaagggacgggggaactttgggtaaaaaagaaaaaattggggggggtaaaactaagcgcttgggaaatttggacggggggggggaggcctcccc

SEQ ID NO: 72698 - protein, 116 aa, Zea mays
  misc_feature: Ceres CLONE 1556438
MAASVFPALLLAVAAVLLLPVAEAVWLELPPSGTKCVSEEIQPNVVVLADYAIMYESHPSSHPTVAVKVTSPYGNTVHHNENATTGQFAFPHFRSWETTLHGSGIDGGEKGSGTFS

SEQ ID NO: 72699 - DNA, 569 bp, Zea mays
  misc_feature: Ceres CLONE 1556440
  misc_feature (228)..(228): n is a, c, t, g, unknown, or other
ggagctccccgcggtggcggccgctctagaactagtggatcccccgggctgcaggaattcgtctcacccctagaaaaccctctctctattttgttcttttttttcgtcgcttggcaaacagcttcgtctggcttccttgcctcggctaacggctaaaaaaaccagcgagcacgatttctcctctctctgtgagtgtgttttttttttacgtgctctcttgtctgcggncaacatacagctaactggcgagccgtggacgctcggccagctctgctggccgactaagggaggcgtcgtgggccctcacgcggcgagtgcgtccttgctggtgggcacactgccatcggttgtcagcaccgctccagttgaagagctctgcagtaaggaatgttgtagccccatggtccatttcaaaaatagtttaatggggggggggaaatcttttttgaaggcggggtaaaagggaaacgggaccctttaatccccccccccattttaaaataaccaaagttttaaaaaaaacccgtctccccccccacttttggggaaagtgggcccaaacccggaac

SEQ ID NO: 72700 - DNA, 532 bp, Zea mays
  misc_feature: Ceres CLONE 1556441
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (312)..(312): n is a, c, t, g, unknown, or other
  misc_feature (343)..(343): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttcaagctgggactccaccgcggtggcggccgctctagaactagtggaacccccgggctgcaggaattcgtctcacccctagaaaaagccgctagtaccagtagtcgtcgcgttagcaggcagatctgagttagccggcggatccgatccgtgcgcgtgcagtgtacgtgtgtcggtggagatggccacagcttacgctcccatggcgagccangtgatgaagagcaacctcgtcgtgcactcgnaggccgaaggggccctgtcaggcgctgctgcggctcaccaaggcgggccgcgggttcacccgtcaatggccattccagccccaaaaaaagcgaaccttcccagggtgggtggcaacccccattcaaacgggggaacccccttttattcgggaaacccctggaaaaaccccccgggtcccccttcccggc

SEQ ID NO: 72701 - DNA, 629 bp, Zea mays
  misc_feature: Ceres CLONE 1556443
  misc_feature: Encodes the peptide sequence at SEQ ID NO. 72702
  misc_feature (436)..(436): n is a, c, t, g, unknown, or other
  misc_feature (523)..(523): n is a, c, t, g, unknown, or other
aaagctggagctccccgcggtggcggccgctctagaactagtggatcccccgggctgcaggaattcgtctcacccctagaaaaagcatctggcctcaagcccctcaggcctcagctcaccaccacgaaccaaccgacagaaagagggacgaatggcgagctctcagtgctgcgataacccgccggccctgaacccggcctgcggggagggcaaggtcgtcgacagcttcggcgggctcaaggcctacgtcgccggccccgaggactccaaggccgccgtcgtcctcgtcgccgacgtcttcggattcgaagcgccgattatgaggaagatagccgacaaggttgcttcgtcagggtactttgttgtggtaccagatttgtttcatggggatccttatgcacctgagaatgttgagaagcccctttcttgtgtggantaagtcacatactccggaaaaaaggggtttgaagagacaaaaacaagttatggggggctctaaaggaaaaagggagtgtctgcctgnttggagctgcagggtatttgctggggtgcaaaaggttgtttgtgggagttttgcaaaaagctcatgaaaatccaggctgcctgggcctgttggcccccctcctttt

SEQ ID NO: 72702 - protein, 94 aa, Zea mays
  misc_feature: Ceres CLONE 1556443
  misc_feature: SWISSPROT Homolog: EC 3.1.1.45 Carboxymethylenebutenolidase
MASSQCCDNPPALNPACGEGKVVDSFGGLKAYVAGPEDSKAAVVLVADVFGFEAPIMRKIADKVASSGYFVVVPDLFHGDPYAPENVEKPLSCV

SEQ ID NO: 72703 - DNA, 671 bp, Zea mays
  misc_feature: Ceres CLONE 1556447
  misc_feature: Encodes the peptide sequence at SEQ ID NO. 72704
aaagctggagctccccgcggtggcggccgctctagaactagtggatcccccgggctgcaggaattcgtctcacccctagaaaaaaaccgccgagccagaggcacccggagcagcgcacagcaacagagcacacgccgcacaccgccgccgcctccgcagcagcagcagcaatggcgcgcgccggcgctctctgcctggtgctgctctgcctcgtggccgtgcactcagccacggcgcagaagtccacgacagccccggccgccgcgccggccgccgccaccaccccgccggcgaccccgaccaagaagtcgcccgcgcccgccgccgcgccgcccaccaccccggccaccctggccccggccgccgcgccgcacaccattccagctacacacactccccccacatcggggtcagtgacccctgccactcgaacacgagccgccgattcgacaaagtgcactccaacggcaaccggtcaaaacccgtctatcagggcaaaggcccccccaccggagtatcaccctactcaagttattatggggtccaggtgccctcaatgcgactatattttgaaccctataaggggagagcgcccatttaacacgctttgccggggaaaaagccaggacaaaagttggcccatcaatggggaggggtaatcaaagctgaag

SEQ ID NO: 72704 - protein, 162 aa, Zea mays
  misc_feature: Ceres CLONE 1556447
MARAGALCLVLLCLVAVHSATAQKSTTAPAAAPAAATTPPATPTKKSPAPAAAPPTTPATLAPAAAPHTIPATHTPPTSGSVTPATRTRAADSTKCTPTATGQNPSIRAKAPPPEYHPTQVIMGSRCPQCDYILNPIRGERPFNTLCRGKSQDKSWPINGEG

SEQ ID NO: 72705 - DNA, 648 bp, Zea mays
  misc_feature: Ceres CLONE 1556448
  misc_feature: Encodes the peptide sequence at SEQ ID NO. 72706
  misc_feature (564)..(564): n is a, c, t, g, unknown, or other
ggagctccccgcggtggcggccgctctagaactagtggatcccccgggctgcaggaattcgtctcacccctagaaaaatttgtctggttaattccgttaacgaacgagacctcagcctgctaactagctatgcggagccatccctccgtagttagcttcttagagggactatggccgtttaggccacggaagtttgaggcaataacaggtctgtgatgcccttagatgttctgggccgcacgcgcgctacactgatgtatccaacgagtatatagccttggccgacaggcccgggtaatcttgggaaatttcatcgtgatggggatagatcattgcaattgttggtcttcaacgaggaatgcctagtaagcgcgagtcatcagctcgcgttgactacgtccctgccctttgtacacaccgcccgtcgctcctaccgattgaatggtccggtgaagtgttcggacgggcaacaaggggggcggggtcggcgccccccgacgtcgcgagaagtccattgaaccttatcatttagaggaaggagaagtcgtaacaaggtttccgtangtgaacctgcggaaggatcatatcggagcgctcgcaaaacctccacacaccttcctgaaatagtagccactagcttcagctgct

SEQ ID NO: 72706 - protein, 57 aa, Zea mays
  misc_feature: Ceres CLONE 1556448
MPSKRESSARVDYVPALCTHRPSLLPIEWSGEVFGRATRGAGSAPPDVARSPLNLII

SEQ ID NO: 72707 - DNA, 688 bp, Zea mays
  misc_feature: Ceres CLONE 1556449
  misc_feature: Translation starting site: 149
ctccccgcggtggcggccgctctagaactagtggatcccccgggctgcaggaattcgtctcacccctagaaaaagtgaactcatcactcccgcttccagcttcccgcagcgagcatcaaaaggagaagagcgagagagagcagcaggcatggaaatgggcgacagcttcgagtactactgggagatgcagcagtacctggagtcagaggagctcagcctctacatgggcacccaggacgatgccctgtcctgctacgactccagctcgccggatggctccatctccaactcgtcctgggcgccggcgggcgtggcggccacggcgtccgagagcgggagggccccggcggcgcggcggccgcgaaacaagacatcctcatggagcgcgaccgcggcgcaagctcaacgagaagctctacgcgctgcgcaacgtcgtgcccaacatcacaaagatggacaggcgtcgatcatcaaggacgcgatcgagtactcgagcaactcaggggggaggaaccgcgggccctgcagggcctcaagcccggaaaagggggccccttcggcgggcccgggcacggggaagaaggcccccgtggttcttttaaaaacccgcccccccccgggccccctggaaggcccgggaactgcccttgccaaaaggggggcaaacccctgccggggggggaaaccg

SEQ ID NO: 72708 - DNA, 567 bp, Zea mays
  misc_feature: Ceres CLONE 1556450
aagctggagctccccgcggtggcggccgctctagaactagtggatcccccgggctgcaggaattcgtctcacccctagaaaaagtttgcatctccatccacctgtcctcgcgtctcccttcccagatccatcgactcgctcgggccgcccctcccgtcgtccccgttcgaaggtgcggcagccggcaggcgagcgatttcattcgacatgaaatcccgagtacgactacctttcaaaactctgctatggtgatctggtgtgggaaatcatgctttgcttctcagatttgcagacgattcttatttggacagctataatcagcaccaattgggggtttgatttccaaaattccgccaagttggacccaggattggggaaaacccttaaaaacctttcaaattttgggaaaatcgcgtggggaaaaaaagcctttttgggaaaatatcctttggggcctttttccccggggaacccttggggaaacttttttttgtttttttaagaggggggggcacacacaaaaaaaaagcttttttatatttttgagaaacaagggttgttaaaaaa

SEQ ID NO: 72709 - DNA, 729 bp, Zea mays
  misc_feature: Ceres CLONE 1556451
  misc_feature: Encodes the peptide sequence at SEQ ID NO. 72710
  misc_feature (258)..(258): n is a, c, t, g, unknown, or other
  misc_feature (298)..(298): n is a, c, t, g, unknown, or other
ccgcggtggcggccgctctagactagtggatcccccgggctgcaggaattcgtctcacccctagaaaaatgtgctctcgcctttccattcctccaccggcctcatcccccaactccgtcgagcattaccgtcagagggcggcggcgcggcgcggcgccgccggcgacggggaccgcgtgaggcaggctcccctcaaggctcgtcctcctcgtcgggaggcgtcgccgttgccccgccctctgggctggcgcggcgtgnaggggacagctggagatccgcccgtctctgcttggattgncttcctctcccgcagaaggtatgagcaatgtactcaccaaaccagagtctaggtttgggcccaaattcccaactcagggtacccaccagcagcaaatgggattaactgggggccaaacttggggtcctgggaattggagcaaataaccattcccaccttggctgggaggcaaacccttttccctggaccaatgaactggcctgaaaaaattttgttgagggtgtttccccaacttgggggggccctggaaaggggccacccccacaaagggattccttaaaaatttttggggggggtccaaggggtttaaccaatatccccctgggaaaaaaggccctttggggaaaaaatccccaccttgccaaaagttttttccccggggaggccccccacccgggtgggggaaaaaacccccttaaacaaaaaacccc

SEQ ID NO: 72710 - protein, 41 aa, Zea mays
  misc_feature: Ceres CLONE 1556451
MSNVLTKPESRFGPKFPTQGTHQQQMGLTGGQTWGPGNWSK

SEQ ID NO: 72711 - DNA, 681 bp, Zea mays
  misc_feature: Ceres CLONE 1556458
  misc_feature: Encodes the peptide sequence at SEQ ID NO. 72712
tggagtccccgcggtggcggccgctctagaactagtggatcccccgggctgcaggaattcgtctcacccctagaaaaagccagctcccactcgcaccgcccgtccgcccagaactatctcgctcgtccgcgttcagctcagctactccaatttcgcaacaagttgcaagcaataaccgaccaaggacgacgaacgggtcgatggccacgctctcctcctgcagccgcctgagtagcggcaccggcgccgcggccatcccacggcagccggcccgtgctggagccgtcctcgtcgtcacctgcaggcggagctcccctcgcgacgtccgcgccgcagccgctgccaccggcggcggcgccggctgccgtaaagctggcaaaccaagggggttgtcccttgccaacttgggcggaatttcaagctcggggcgggcccccgtcttactggaagaccaaaagggggctcccccccctccccggggggagggctttacccttgtttaaaaacccgggggggaaaaaaaaaaggccccaaaacaggggtttcgggggtgggtttaaaagggggggttttaacacaccccttttgtggcggggggaagcccaaggcaaaaatacccctcggggggggggggaaaaacaaaaccccccacttttaaaccatggggggaaacccgggccc

SEQ ID NO: 72712 - protein, 100 aa, Zea mays
  misc_feature: Ceres CLONE 1556458
MATLSSCSRLSSGTGAAAIPRQPARAGAVLVVTCRRSSPRDVRAAAAATGGGAGCRKAGKPRGLSLANLGGISSSGRAPVLLEDQKGAPPPPRGEGFTLV

SEQ ID NO: 72713 - DNA, 650 bp, Zea mays
  misc_feature: Ceres CLONE 1556459
  misc_feature: Encodes the peptide sequence at SEQ ID NO. 72714
  misc_feature (320)..(320): n is a, c, t, g, unknown, or other
  misc_feature (388)..(388): n is a, c, t, g, unknown, or other
ccgcggtggcggccgctctagaactagtggatcccccgggctgcaggaattcgtctcacccctagaaaaaaacgagaaatcgaacccacacgcaacgcgacgcctccacccgctcgcctagtccagaatccagatccagcgcccgcatctctctctctcgcgcgcgcgcgcgagcgcgatgagctgccgcgacgggcgatcgtgctagcggtaacagcgagcggtgcgcgagggcggagtgggagtgtggatccgaggggcggcaaatctggcaggcgccgcggtgggcttggcgggcgcgggggagggcggggggtggnccgggacaggcggggaggggaaagggaaggactgccggtaggctcagggccctggcgcaggaggctgnctcgcgtccatggcgctctcgtggtcctcggccctccgcctcgccgtcgccgccgtcctgctcgtcgccgtcgtcgtcgcgctcttcactctccccatcgagaagattttgaaggactttctggtatggatcagggagaatttgggtccatgggggccctttggtgttggccctcgcttacctccctctgacagtcttagctgttccgactcatttcttaccttgggaggggctatctattttggttggccgggggggttgt

SEQ ID NO: 72714 - protein, 84 aa, Zea mays
  misc_feature: Ceres CLONE 1556459
MALSWSSALRLAVAAVLLVAVVVALFTLPIEKILKDFLVWIRENLGPWGPFGVGPRLPPSDSLSCSDSFLTLGGAIYFGWPGGL

SEQ ID NO: 72715 - DNA, 672 bp, Zea mays
  misc_feature: Ceres CLONE 1556462
  misc_feature: Encodes the peptide sequence at SEQ ID NO. 72716
ggagctccccgcggtggcggccgctctagaactagtggatcccccgggctgcaggaattcgtctcacccctagaaaaatcagcctcatcaacctcgacgaaggaggaacgaacggacaggttgttgcacagaagcgacatggctttcgcgcccaaaacgtcctcctcctcctcgctgtcctcggcgttgcaggcagctcagtcgccgccgctgctcctgaggcggatgtcgtcgaccgcaacaccgagacgggagtacgacgcgggccgtcgtcgtcactaccacaccactgctagagctgcggcggctgctgtcccggttcccgccgccccgcgcaggggcggggccgggggcgggtgcaccaaagcaagggcggcacccgccaaaaggagagacctcgggggtcggaaacattggcgggcctctgggccaagggaaaaaggggttatcccgtaaattaccgccgggaccggaactaagaaaaaaggcaagggcctccttttgcggaaaggtgggggcccaaactcaccgaggggggggggcccgggtggaacccctaattggggggggccatttcaagggtttgggtgggggggggtttgggcaaggggccccacatggaaccccggttgggaaattcccggggaggggaaccccagaatttttttttcc

SEQ ID NO: 72716 - protein, 105 aa, Zea mays
  misc_feature: Ceres CLONE 1556462
MAFAPKTSSSSSLSSALQAAQSPPLLLRRMSSTATPRREYDAGRRRHYHTTARAAAAAVPVPAAPRRGGAGGGCTKARAAPAKRRDLGGRKHWRASGPREKGVIP

SEQ ID NO: 72717 - DNA, 692 bp, Zea mays
  misc_feature: Ceres CLONE 1556464
  misc_feature: Encodes the peptide sequence at SEQ ID NO. 72718
  misc_feature (550)..(550): n is a, c, t, g, unknown, or other
ctccccgcggtggcggccgctctagaactagtggatcccccgggctgcaggaattcgtctcacccctagaaaaactccccagtcgccactaaatccgctgccgtttcttctcgagtgtgaccatggcggctcagggatccctcgtcatgtggagggcggtcttcgcagcgctgggcttgctcatggtggccacgctggtgtacaccttggccaccgacggctcgccgttccgccttgagctgtttacgccgtggatggtggcaacactggctgatttttatgttaatgttattgcaatctcggcttgggttatctacaaggaagcaaactgggttagttctgctgtgtgggtggttctgttgttctgctatggcagtgctgacacttgcgcttatattgttaagagactttctgaagtacatctgcatggtcatccaaagatcctcttgaccttctatttatgaggcaaggtcatctatcccagagaaagtgctcttatgtagcaatgggaaggatctatttcagcattttggagatattcatgactgcngttgtcacatatactagcatcactgatggactaccttttaggaagaaatcggtgacaccggggatggcggcaaacgttaattggattctacaataatgtctttgcgatatcggtctgggttgctcacaaggaatcatcatgg

SEQ ID NO: 72718 - protein, 113 aa, Zea mays
  misc_feature: Ceres CLONE 1556464
MAAQGSLVMWRAVFAALGLLMVATLVYTLATDGSPFRLELFTPWMVATLADFYVNVIAISAWVIYKEANWVSSAVWVVLLFCYGSADTCAYIVKRLSEVHLHGHPKILLTFYL

SEQ ID NO: 72719 - DNA, 649 bp, Zea mays
  misc_feature: Ceres CLONE 1556468
  misc_feature: Encodes the peptide sequence at SEQ ID NO. 72720
  misc_feature (426)..(426): n is a, c, t, g, unknown, or other
ctccccgcggtggcggccgctctagaactagtggatcccccgggctgcaggaattcgtctcacccctagaaaaaaaaaaccaacgtgcttgatctccctccgccactccatccatctcctcgctcccagtccccgggaagcatggcgtccgtcaccgcccgcgccccggtagcggcccttcgcccgtcgtcggcatcgctcaagtcgtcgtcggccttccttggccactctagccgcctcggccgcaccgcgtctcccacgaggcgcagcctcaaggcggaggccaagggcgagtggctccccggccttccctccccctcctacctcgacggcagcctggcgggtgacaatggcttcgacccgttgggcctggcggaagaccccgagaacctgcggtggttcgtgcaggcggagctgggtgacggncggtggggcatgcttggcgtggccgggatgctcatcccggaagtgctgaccaaagccgggctgatcaacgcgccccagtggtacgaccccggcaagtcggaattatttcgggtcgtcgtccaacctgttcgtgggccaagttcatccggtccccctaaggggaaaatccggggggggggaggattaaaaaaccccgggaagggtaaacaggaacccccttttt

SEQ ID NO: 72720 - protein, 169 aa, Zea mays
  misc_feature: Ceres CLONE 1556468
  misc_feature (57)..(167): Pfam Name: Chloroa_b-bind Pfam Description: Chlorophyll A-B binding protein
MASVTARAPVAALRPSSASLKSSSAFLGHSSRLGRTASPTRRSLKAEAKGEWLPGLPSPSYLDGSLAGDNGFDPLGLAEDPENLRWFVQAELGDGRWGMLGVAGMLIPEVLTKAGLINAPQWYDPGKSELFRVVVQPVRGPSSSGPPKGKIRGGGGLKNPGKGKQEPPF

SEQ ID NO: 72721 - DNA, 694 bp, Zea mays
  misc_feature: Ceres CLONE 1556473
  misc_feature: Encodes the peptide sequence at SEQ ID NO. 72722
  misc_feature (592)..(592): n is a, c, t, g, unknown, or other
  misc_feature (646)..(646): n is a, c, t, g, unknown, or other
ctggagctccccgcggtggcggccgctctagaactagtggatcccccgggctgcaggaattcgtctcacccctagaaaaaagaaatgaacgataaggtgttagaggacttcgaagactggattgagaaggagaaaaacgaaggaatgttcttcaaaagccttggcaaggtcaaacctcggaacaagatggaaataaaggtgaaagccaaggtggaagcacagaaggtcaaagagattgcagaggagagtgcaggatcaaaaactcgtatgaacatttacctggggctgatggggatactcgggattacaattgcgaatgccatctttgcaacaccagaggtggagtggaggaaggttgctgctctgggtctgattttcattggtctggttgctcaggtcatctacgagcaggatatctcaccgccggaagctgagaagacagagaaaatagaagaataaaaaaggagttgcagacagacgcggtggggacggagaccgatgcggcggtggcttagggtaagtacgtgggttgtggtggcggcggttcaggagcaggaatgggaggttctgggcgcgatgggtgccgacgtgnttgaggtgggtagaggaggcgcctgcgtttgcgatgggttctggcgtgtcagcngcggcggttcaggagcaggaacggacggctctgggcgcatgacgcggt

SEQ ID NO: 72722 - protein, 124 aa, Zea mays
  misc_feature: Ceres CLONE 1556473
MNDKVLEDFEDWIEKEKNEGMFFKSLGKVKPRNKMEIKVKAKVEAQKVKEIAEESAGSKTRMNIYLGLMGILGITIANAIFATPEVEWRKVAALGLIFIGLVAQVIYEQDISPPEAEKTEKIEE

SEQ ID NO: 72723 - DNA, 650 bp, Zea mays
  misc_feature: Ceres CLONE 1556474
  misc_feature: Encodes the peptide sequence at SEQ ID NO. 72724
ctggagctccccgcggtggcggccgctctagaactagtggatcccccgggctgcaggaattcgtctcacccctagaaaaaggcccaaatcccccgactcctcgcttcctcccgttccgtcgccgccgcgcgcctcggagaagagatagaggcggccgctgcatcgaccccgcgccacctccgcctgcctcccccggcaccgatcggtacggccacctccctcgattcgattggctctaactacggaaccctaccctaggttcaatttgatctgtggattttgggggattttgtttagggtttgatcgatggcgtcgaacaggatcctgaaggacttgaaggacctgcagaaggacccgccctcctcctgcagcgcaggtcctgttggtgaagacatgttcccttggcaagccaccatcatggggccttcggacagcccatttgcaggtggcgtattcttggtgaacattcacttcccaccggattaccctttcaagccaccaaaggtgtctgtccgcaccaaggttgtccacccgaacatcatcagcaacgggtgcatttgccttgacattcttaacgaacagcggagccctgctttaactatctcaaaagtaaattgcctacattgtttattgggcgaagttctggctg

SEQ ID NO: 72724 - protein, 114 aa, Zea mays
  misc_feature: Ceres CLONE 1556474
  misc_feature (5)..(114): Pfam Name: UQ_con Pfam Description: Ubiquitin-conjugating enzyme
  misc_feature: SWISSPROT Homolog: EC 6.3.2.19 Ubiquitin--protein ligase
MASNRILKDLKDLQKDPPSSCSAGPVGEDMFPWQATIMGPSDSPFAGGVFLVNIHFPPDYPFKPPKVSVRTKVVHPNIISNGCICLDILNEQRSPALTISKVNCLHCLLGEVLA

SEQ ID NO: 72725 - DNA, 664 bp, Zea mays
  misc_feature: Ceres CLONE 1556487
  misc_feature: Encodes the peptide sequence at SEQ ID NO. 72726
  misc_feature (422)..(422): n is a, c, t, g, unknown, or other
  misc_feature (440)..(440): n is a, c, t, g, unknown, or other
  misc_feature (444)..(444): n is a, c, t, g, unknown, or other
ctggagctccccgcggtggcggccgctctagaactagtggatcccccgggctgcaggaattcgtctcacccctagaaaaaaggaagggaggccgaactgagcagttcgaccaggcagccatccacctccaaccccccttcgcctgcgcaaatcgttaccatcccagcgagaaagatggcgcgcgtctccaatgccaagaagcggcagggcgccaagcccgcctccgcgctcagcagcaccgacaccagcaccgccgcaaagaggaaggccgaggacgaccgccccgtgcgcgtctacgccgacggcatcttcgatctcttccacttcggccacgcccgcgccctcgagcaggccaagatgctgttccccaacacctatcttctcgtcggatgctgcaacgacgagctaacctaccgctacangggcaagaccgtcatganccangaagagcgatacgaatccctgcggcactgcaagtgggttgatgaggtcattcctgatgcaccgtggggttctcacacgggagtttattgataagctccgaatggacctatgtggctcagaaggccctgccttaggctgaacccagcggaaacccaaaggaatgtctaggaattttgttaaaaagatgggaaaatttcgggaaccaaaaggaaaaaagggg

SEQ ID NO: 72726 - protein, 119 aa, Zea mays
  misc_feature: Ceres CLONE 1556487
  misc_feature (41)..(120): Pfam Name: CTP_transf_2 Pfam Description: Cytidylyltransferase
  misc_feature: SWISSPROT Homolog: EC 2.7.7.15 Choline-phosphate cytidylyltransferase
  misc_feature (83)..(83): Xaa is any aa, unknown, or other
  misc_feature (89)..(89): Xaa is any aa, unknown, or other
  misc_feature (90)..(90): Xaa is any aa, unknown, or other
MARVSNAKKRQGAKPASALSSTDTSTAAKRKAEDDRPVRVYADGIFDLFHFGHARALEQAKMLFPNTYLLVGCCNDELTYRYXGKTVMXXEERYESLRHCKWVDEVIPDAPWGSHTGVY

SEQ ID NO: 72727 - DNA, 760 bp, Zea mays
  misc_feature: Ceres CLONE 1556493
  misc_feature: SWISSPROT Homolog: EC 1.1.3.15 (S)-2-hydroxy-acid oxidase
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (28)..(28): n is a, c, t, g, unknown, or other
  misc_feature (755)..(755): n is a, c, t, g, unknown, or other
  misc_feature (760)..(760): n is a, c, t, g, unknown, or other
nnnaaaattttttattttttttttatcntcatatttacagacaccccccaaaaatgggactccccgcggtggcggccgctctagaactagtggatcccccgggctgcaggaattcgtctcacccctagaaaaaagttaccaacactttcagcatatgcacgcaagggacgagattgattacccattaccaaaccaacagtttccagttcaacggtaggaacaggccgtcacggcgtcatccgccaaaggacaattcatttgctcacacaggcacaaacgctgagcgcctgagcctgctctcccggtctatgagatggcgttgatcacgaatgtctctgactatgaggagcttgcaaagcagaagctgcctaagatggtttatgacttctatgccgggggttgcaaaagagcggtggacactcaaggagaataaggaggcattcatccaagactctgtttcgaccatgggtgctgaatgatggtgcctcatattgacattgttctacaagtatattgggcttacaaaaagtccatgccctatgatgggtggagctccccaacggctttggcaaaaggcagcccccccctaaaaacggagaaggtttgcttcctgccccagggcggacagctgccttgcagggaactcatcaatgacggttggtcccccctgagttaccctttgcacccgttttaacgaaatctttaccttcaattgtgcacccagagaagaagggatattcaatgcctaacattgnaaagn

SEQ ID NO: 72728 - DNA, 688 bp, Zea mays
  misc_feature: Ceres CLONE 1556496
  misc_feature: Encodes the peptide sequence at SEQ ID NO. 72729
  misc_feature (307)..(307): n is a, c, t, g, unknown, or other
  misc_feature (317)..(317): n is a, c, t, g, unknown, or other
ctggagctccccgcggtggcggccgctctagaactagtggatcccccgggctgcaggaattcgtctcacccctagaaaaagtttcctgtttccatcctcttccacggttccacttccacccccatctcctcggcaagcccagcaaccccaatccccaatcccgtccgcttctttccccgtccccgaccttgccgaggaacctcccgctcccaaatcctagcctctcctccctcgccgctcccctccccatggaggacgaggacgccggcctcggcgacgggggcgaggcctccccctcgcaccatgnccgcgcgtcnggcgaccgggcgcgggacttggcgggcgtcccgaacagctcgcgctccgtgacgcagacggggaacgggtcccacccgctcatgatcaagggctactcctctcccaagggcatgggccttgggaaaaaaattcccaggaaacctttcacgtggggggtaccagggggggatttttttttccccccaggggaaaaaacccggggaaaacccgggggattttgggtttttttaaccctccccaaaaaagaaaaaaaaggggggcgcttttttagccccctttttaaaaaacaggggggggggggaaaaagggggggccccccttttttccgcccccacggggggggggcccccccccctgagggggggtgggg

SEQ ID NO: 72729 - protein, 146 aa, Zea mays
  misc_feature: Ceres CLONE 1556496
  misc_feature (20)..(20): Xaa is any aa, unknown, or other
MEDEDAGLGDGGEASPSHHXRASGDRARDLAGVPNSSRSVTQTGNGSHPLMIKGYSSPKGMGLGKKIPRKPFTWGVPGGDFFFPPGEKTRGKPGGFWVFLTLPKKEKKGGRFFSPLFKKQGGGGKRGGPPFFRPHGGGAPPPEGGW

SEQ ID NO: 72730 - DNA, 1403 bp, Zea mays
  misc_feature: Ceres CLONE 1556505
  misc_feature: Encodes the peptide sequence at SEQ ID NO. 72731
aagcacacagcgagcacgcaccagcatccttggcagcgatctgcttaattgcttctcccagcgcgtgcggccaagctagtaggggatccatcagatatccacgccatggccgccgcctccaccacgtcgaggaccaactcgcgggtgaactactcgaacgagatccacgacctctccaccgtgcagagcggctccgccgtccccaccttgttctacgacccggacaagtccatcgccgacatcttcccgccgcaccttgggaagaaggtgatctcggaggtggtggcgacgttccttctggtgttcgtcacctgcggggcggcgtccatctacggcgaggacgacaagcgcatctcgcagctggggcagtcggtggccggcgggctcatcgtcaccgtcatgatctacgccaccggccacatctccggcgcgcacatgaaccccgccgtcacgctctccttcgcatgcttccggcatttcccctggattcaggtgcccttctactgggcggcgcagttcacgggggcgatgtgcgcggcgttcgtgctcaaggcggtgctccaccccatcgccgtgatcggcaccaccacgccgtcggggccgcactggcacgcgctcctcatcgagatcgtcgtcaccttcaacatgatgttcgtcacctgcgccgtcgccaccgactccagggcggtgggtgagttggccgggttagcagtcggttccgcggtttgcattacttccatcttcgcagggccggtgtcgggcggatcgatgaacccggcgcggacgctggcgccggcggtggccagcaacgtcttcacgggcctctggatctacttcctcggccccgtcatcggcacgctctccggggcgtgggtctacacctacatccgcttcgaggaggcccccgccgccaaggacacgcagaggctctcctccttcaagctccgccgcatgcagagccagctcgccgccgacgagttcgacaccgtctaaattaaaacgcccacacgcgcatccacaacactgtcagcctgcaggtcaactcttcgcgcgtacgtacgctggacgctggctgagagagtgagtgagagagagagagtactgtactactgtgtgctcgctcgctcgctctgttcaaagacctcatcatatcaggtgggagctagagagatagagctgcgtgtatgtatgtgtgtgtgtgtacgtgcttggtgtaccctacctagcgggtgagagcagctagcgtgatgtttatgtatcttcgtcagtgttgcaaaagttaattgatatgcagctgatgtgtctggctttgctcgtttgcaaaagatgcatgcatgtgttggaactcggaacaccaaatatatatatgggtttttttttttgtccaaaaaaaaaaaaaaaaa

SEQ ID NO: 72731 - protein, 295 aa, Zea mays
  misc_feature: Ceres CLONE 1556505
  misc_feature (45)..(258): Pfam Name: MIP Pfam Description: Major intrinsic protein
  misc_feature: Functional homolog of the protein sequence given in SEQ ID NO 96886
  misc_feature: Useful for making plants with modulated silicon content
MAAASTTSRTNSRVNYSNEIHDLSTVQSGSAVPTLFYDPDKSIADIFPPHLGKKVISEVVATFLLVFVTCGAASIYGEDDKRISQLGQSVAGGLIVTVMIYATGHISGAHMNPAVTLSFACFRHFPWIQVPFYWAAQFTGAMCAAFVLKAVLHPIAVIGTTTPSGPHWHALLIEIVVTFNMMFVTCAVATDSRAVGELAGLAVGSAVCITSIFAGPVSGGSMNPARTLAPAVASNVFTGLWIYFLGPVIGTLSGAWVYTYIRFEEAPAAKDTQRLSSFKLRRMQSQLAADEFDTV

SEQ ID NO: 72732 - DNA, 699 bp, Zea mays
  misc_feature: Ceres CLONE 1556506
  misc_feature: Encodes the peptide sequence at SEQ ID NO. 72733
  misc_feature (356)..(356): n is a, c, t, g, unknown, or other
  misc_feature (401)..(401): n is a, c, t, g, unknown, or other
tggagctccccgcggtggcggccgctctagaactagtggatcccccgggctgcaggaattcgtctcacccctagaaaaagatcgtgggaggcaagagatcacacgcacacagcacactcgcatcccaggcagaaccctcgccgcctccgccgccgatgacgtccgtgcgcagctgtgccgcgtcgttaaccccgtcgatccgcgggatgtcggggctggtccggcaggaggcactgcggcgcgagctggacgggtgccagctgctggcgggcatctggtgccacgggttcacggtggcgcagctgcggagcatccgcgcgtcgctgcccgacgcggcgcggctggtggtggcgaanaactcggacatggcggcggcgggggggggcacccggtgggaagcncttaggccttgcccccggggcatgaacccttggctgttcgtgcgctccgacgagatcccccccggggcctcagcccttacggggactttccggagggggggggagctgcgggcttcacgagcttcacggggggccgtctaggggggggaggggtcttgcggggccaaggaatttctcgcagggttgggggaaaaggccccaccggggggcggttcctacccagacccccctcggaatggccggggggaggcccgcccgtccagagttccccgcccggtcttagggggggggtccgggg

SEQ ID NO: 72733 - protein, 128 aa, Zea mays
  misc_feature: Ceres CLONE 1556506
  misc_feature (67)..(67): Xaa is any aa, unknown, or other
MTSVRSCAASLTPSIRGMSGLVRQEALRRELDGCQLLAGIWCHGFTVAQLRSIRASLPDAARLVVAXNSDMAAAGGGTRWEALRPCPRGMNPWLFVRSDEIPPGASALTGTFRRGGELRASRASRGAV

SEQ ID NO: 72734 - DNA, 636 bp, Zea mays
  misc_feature: Ceres CLONE 1556511
  misc_feature: Encodes the peptide sequence at SEQ ID NO. 72735
ctggagctccccgcggtggcggccgctctagaactagtggatcccccgggctgcaggaattcgtctcacccctagaaaaaaaccccacccacccaacaggtaccctgccgttcgtcaggcggttcacgcccaaggaggtggaggccgccacgcgcggcttcaccgcggtgctcgacgctgccggcacggcctacagggcgcgcttcgccggcggcctcgtcgccaccgtcgtcaggcgccgccgcgacgctgacgccgccgacgccgacacgaccaccggccagggagaggggaggaggagggaccacggacgccttctacctggagctgcagctgctggcccgcctcaaccaccgccacgtcgtcaggctgcgcggcttcgcgctagcccaccacgcaaggttcctcgtcttcgatcacatggagaacaggagcctcaaggaatgcctccacgatccgctccggacgccgctggactggcggaccaggctgcaggtcgccattgacgtcgcggcagcactggaatacctctactaccactgcgaccccccggtgttccacgtgtccgtcaactccggcaccgtgctcatggacgccaacttcgtcgccaaggtgacagtcaccgacaactggcac

SEQ ID NO: 72735 - protein, 72 aa, Zea mays
  misc_feature: Ceres CLONE 1556511
  misc_feature: SWISSPROT Homolog: EC 2.7.11.1 Non-specific serine/threonine protein kinase
MENRSLKECLHDPLRTPLDWRTRLQVAIDVAAALEYLYYHCDPPVFHVSVNSGTVLMDANFVAKVTVTDNWH

SEQ ID NO: 72736 - DNA, 652 bp, Zea mays
  misc_feature: Ceres CLONE 1556512
  misc_feature: Encodes the peptide sequence at SEQ ID NO. 72737
  misc_feature (600)..(600): n is a, c, t, g, unknown, or other
  misc_feature (652)..(652): n is a, c, t, g, unknown, or other
aaagctggagctccccgcggtggcggccgctctagaactagtggatcccccgggctgcaggaattcgtctcacccctagaaaaaaagaaccaacgtgctcgatctccatctcgaccgtcgctcaccgggaagctacgctacgacgaagcatggcgtccgtcaccgcccgcgccccggtcgcggccctgcgcccgtcggcgtctctcaagtcgtcgtcgtcgtcggcggcggccttccttggccactctagccgcctcggccgcactgctaccgcgtcgccgacgaggcgcagcctaaaggcggaggccaagggcgagtggctcccgggccttccctcccccgcctacctcgacggcagcctgccgggtgacaatggcttcgacccgttgggcctggcggaggacccggagaacctgaggtggtacgtgcaggcggagctggtgaacgggcggtgggcgatgctgggcgtggccgggatgctgatcccggaggtgctgaccaaggccgggctgatcaacgcgccgcagtggtacgacgccggcaagtcggagtacttcgcgtcgtcgtcgacgctgttcgtgatcgagttcatcctgtttncactacgtggagatccggcggtggcaggacatcaagaaccccggcagcgtcn

SEQ ID NO: 72737 - protein, 167 aa, Zea mays
  misc_feature: Ceres CLONE 1556512
  misc_feature (62)..(164): Pfam Name: Chloroa_b-bind Pfam Description: Chlorophyll A-B binding protein
  misc_feature (151)..(151): Xaa is any aa, unknown, or other
MASVTARAPVAALRPSASLKSSSSSAAAFLGHSSRLGRTATASPTRRSLKAEAKGEWLPGLPSPAYLDGSLPGDNGFDPLGLAEDPENLRWYVQAELVNGRWAMLGVAGMLIPEVLTKAGLINAPQWYDAGKSEYFASSSTLFVIEFILFXLRGDPAVAGHQEPRQR

SEQ ID NO: 72738 - DNA, 582 bp, Zea mays
  misc_feature: Ceres CLONE 1556514
  misc_feature: Encodes the peptide sequence at SEQ ID NO. 72739
  misc_feature (386)..(386): n is a, c, t, g, unknown, or other
aaagctggagctccaccgcggtggcggccgctctagaactagtggatcccccgggctgcaggaattcgtctcacccctagaaaaaacagcatctcaagccaccatcgaccttcaagtctcgctacgtagcagtgcaataaaaaaagcagccgcaatggcgagcagcaccatggccctctcctccacggccttcgccggcaaggccgtgaacgtgccgtcgtcgtccgccttcggcgaggcccgcgtgacgatgcgcaaacggcggggaaggcaagccggcggcggcgtccgggagcccgtggtacggccccgaccgcgtgctgtacctggcccactgtccggcgagccgccgagctacctgacgggcgagttcccgggcgactacngctgggacaccgcggggcctgtcggcggacccccgagacgttcgccaagaaccgggagctgggaggtgatccactcccgctgggccatgctgggcgcgctcggctgcgtcttcccggagctgctcgcccgcaacggcgtcaagttcggccaaggccgtgtggttcaaggccggctcccagatcttcagcgaaggtg

SEQ ID NO: 72739 - protein, 142 aa, Zea mays
  misc_feature: Ceres CLONE 1556514
  misc_feature (64)..(139): Pfam Name: Chloroa_b-bind Pfam Description: Chlorophyll A-B binding protein
  misc_feature (78)..(78): Xaa is any aa, unknown, or other
MASSTMALSSTAFAGKAVNVPSSSAFGEARVTMRKRRGRQAGGGVREPVVRPRPRAVPGPLSGEPPSYLTGEFPGDYXWDTAGPVGGPPRRSPRTGSWEVIHSRWAMLGALGCVFPELLARNGVKFGQGRVVQGRLPDLQRR

SEQ ID NO: 72740 - DNA, 621 bp, Zea mays
  misc_feature: Ceres CLONE 1556518
ctggagctcaccgcggtggcggccgctctagaactagtggatcccccgggctgcaggaattcgtctcacccctagaaaaactcttctccgccagagtccgcgtcggccagatcaaacgaatcggcacgacgcatcggcatcgcctccgacgatcttgagacaaacaaacccaccgctgcggcaactccgcctcccgctgacaccgggatcgcctgaacacaggcagagaaaaagaggcgcaagttttgccccgcgaagatggagacctggacgtctcccggccgcttgagcagatgacgaaccttctcccgcaagaaggccttccagaaaggcgcccagaatccaaggccccccccccccaagagatccaaaaattaaaatttgcagctcgtggggaaactcaaaaaaaaaaaaatcccgccgggaatatgaccccggaaaaagaaaccaaagttggcttccccaaaaaaaaatgtggtactccggggcggccccaatggcgttcccaaatttaaaggccctctcaagggaaggaagatttttgggaacacatattgtttgtgagtaccccaaagcaaaaaaaaaactgctggccgcaaggagaaagatcccccccccctt

SEQ ID NO: 72741 - DNA, 597 bp, Zea mays
  misc_feature: Ceres CLONE 1556522
  misc_feature: Encodes the peptide sequence at SEQ ID NO. 72742
  misc_feature (478)..(478): n is a, c, t, g, unknown, or other
aagctggagctccccgcggtggcggccgctctagaactagtggatcccccgggctgcaggaattcgtctcacccctagaaaaaatccattcccacagcaccaagcaagagcaaagagcaacacaaggcaaggcagcacacgacccgcggcgacgcaagaagagaagccagcagtcgtctggatccatcgattgacatggccatggcggcggcagcggagggcaagagccggaggttcgcgctggcctgcggggtgctgagccagtacgtgaaggccgagcagcagatggcggccgccggggcccctgccccgcgcgccccggccacgacgctgagcctcatgcccggcgcggacgtcggcgccgagcaggagccggccgccgcgagggggcaggagacggccgggtccgcctccacggcggcgccgctcaccatcttctacggcggcaggggtggtcgtgttcgacgacttcccggcnggagaaggcagccgaggtcatgcgccctcgcagctggcgcccaaccgcccggccgcccccgggcccgggcgccggcgccgcgccaaccacctgcctatcgcccggaaaggcgtcgcttc

SEQ ID NO: 72742 - protein, 134 aa, Zea mays
  misc_feature: Ceres CLONE 1556522
  misc_feature (95)..(95): Xaa is any aa, unknown, or other
MAMAAAAEGKSRRFALACGVLSQYVKAEQQMAAAGAPAPRAPATTLSLMPGADVGAEQEPAAARGQETAGSASTAAPLTIFYGGRGGRVRRLPGXRRQPRSCALAAGAQPPGRPRARAPAPRQPPAYRPERRRF

SEQ ID NO: 72743 - DNA, 710 bp, Zea mays
  misc_feature: Ceres CLONE 1556524
  misc_feature: Encodes the peptide sequence at SEQ ID NO. 72744
  misc_feature (402)..(402): n is a, c, t, g, unknown, or other
  misc_feature (403)..(403): n is a, c, t, g, unknown, or other
gcggtggcggccgctctagaactagtggatcccccgggctgcaggaattcgtctcacccctagaaaaactctcgctccgttgctcgcctcgggtcaaaccctaagcagggagttgatttatccgctgcagccatgagtaagttgcagtctgagtctgtcaaggatgccatctcccagattgttggggatgccaaggagaagaataggaagttcactgagactgtggaacttcagattggtctgaagaattatgatccacagaaggacaagcgtttcagtggctctgttaagttgccccatatccctcgtcccaagatgaaggtgtgcatgcttggtgatgcccagcatgttgaggaggccgaagaagatgggacttgactacatggatgtggaggctctcannaaaatgaccaagaaccaggaacctggttaaaaaggctggccaaaaattaccatgcttttcttggaatcaaaggcatcatcaagcaaaatccccctcctccttggtccgggtcccaaaaaggggagggaagttcccaacccctggttacccccccgggaatcccctcaggtcccagggggaaacaaaaaatagggggaccgtacagtttcccacctcaaaaaaggttcttttgccagggggggtgcccctttggacaactttggcgatggggaggaaaaaaaaaaattcccgccaaaacttccccaaa

SEQ ID NO: 72744 - protein, 81 aa, Zea mays
  misc_feature: Ceres CLONE 1556524
MSKLQSESVKDAISQIVGDAKEKNRKFTETVELQIGLKNYDPQKDKRFSGSVKLPHIPRPKMKVCMLGDAQHVEEAEEDGT

SEQ ID NO: 72745 - DNA, 696 bp, Zea mays
  misc_feature: Ceres CLONE 1556526
  misc_feature: Translation starting site: 211
  misc_feature: SWISSPROT Homolog: EC 3.6.3.14 H(+)-transporting two-sector ATPase
tcaccgcggtggcggccgctctagaactagtggatcccccgggctgcaggaattcgtctcacccctagaaaaaatcgcatacgcctgcctgcccacccacctccccttttccttcctcttcgccccagcgacgcggccgcccggagaccgagcgaggcaggcaactaaccaccgagaggcagggacaggaacaggaagccggaggcgaagatgtcgtcggtgttcagcggcgatgagacggcccccttcttcggcttcctcggcgccgccgccgccctcgtcttctcatgcatgggcgccgcgtacgggaccgcgaaagagcggcgtcggcgtggcgtcaatgggtgtgaagcggccggaactcctcatgagggggcgggggcccgtggtatggcttgggttcccccgaatcaacgggcttttaatccccttattattagcaggggggacaaccccaaggccagccctccaccctttttgaggggccccccacctttcctccggggttgccctgggggctcctgggggcttgagctggaaggtgccctcggattttccggggaaggccgggagccgggggaaaatggccaacacccaaaatttttttcgtggggcggtaacccctcacccccttttttggcgaaagccctgttcccctctataggcgcccttgggggggaaaaaccccttccccgc

SEQ ID NO: 72746 - DNA, 700 bp, Zea mays
  misc_feature: Ceres CLONE 1556530
  misc_feature: Encodes the peptide sequence at SEQ ID NO. 72747
  misc_feature (336)..(336): n is a, c, t, g, unknown, or other
  misc_feature (700)..(700): n is a, c, t, g, unknown, or other
gcggtggcggccgctctagactagtggatcccccgggctgcaggaattcgtctcacccctagaaaaaatctcccctcccccttgccctcaggtctccccaccgcccccgatccaccattcctcctccggatttcgcagtcagcggtggtgaaggtagcgggcgcggaggaagatggggctcgcgttcgggaagctcttcagccggctcttcgccaagaaggagatgcggattcttatggtcggtctcgacgccgccggtaaaaccaccatcctctacaagctcaagctcggcgagatcgtcacaaccatccccaccatcggttttcatggtgaaanctgtgagtacaaggacatttagcttccacggtctgggatgtcggggggtcagacaaaatcaaaacctttctggaggggtttccttccggacccccacgggtcttatcttttgttgtggaaagaaatgaccgtgaccgtgttttttaaagccaaaaattaacttgcccgggtgcctgaccgggggaaacccccggggaggctggggcgggtggttttccccaaaaaggcaaaatctccctatgggcctaaggggcggcgtaaaaccagggcaaagctggggattacacccccgggggggggggaaactgggggaattccgagagcatttgggccacaaattgggaagggggtttttccaaggggn

SEQ ID NO: 72747 - protein, 61 aa, Zea mays
  misc_feature: Ceres CLONE 1556530
  misc_feature (5)..(61): Pfam Name: Arf Pfam Description: ADP-ribosylation factor family
  misc_feature (55)..(55): Xaa is any aa, unknown, or other
MGLAFGKLFSRLFAKKEMRILMVGLDAAGKTTILYKLKLGEIVTTIPTIGFHGEXCEYKDI

SEQ ID NO: 72748 - DNA, 684 bp, Zea mays
  misc_feature: Ceres CLONE 1556535
  misc_feature: Encodes the peptide sequence at SEQ ID NO. 72749
aagctggagctcaccgcggtggcggccgctctagaactagtggatcccccgggctgcaggaattcgtctcacccctagaaaaacgcacaatccatccatccatctattctccagtccacccattccattccactacccacgcgcagaattcacgcgaacgcacacgcacccacacgacacatccagatgatgcttagggtttccccgtccccggccgccgcggtgccaacccagctctccggtgcgcccgcgacccctgctcccgtcgtcagggtggcggcgccgcgcggcgtcgcctcgccggccgctggcgccgcgtgcagggccgcggcaaagggaagggagtgctcaagcgggtcgtgtcccacccttcgaggaaataagggggaactcgcctttgtggccagtcccccaaaaaagtcttggcgccccaaaagttcctaaataaatgggaggcccccctcaaaagacaaaaaaacgggggaaaaaaacccccttatggaaaacaaccccccttttcccttttttaaaccgggaaaaagggggtttaaaagagttttcccaatttttttggggaaccccccccccaaaaaaaggggggccccctaaaaactctttgggtccccaaaaaaaaggggggggggggggggggggcccccctgttggggccccctccaaaagggt

SEQ ID NO: 72749 - protein, 85 aa, Zea mays
  misc_feature: Ceres CLONE 1556535
  misc_feature: SWISSPROT Homolog: EC 1.16.3.1 Ferroxidase
MMLRVSPSPAAAVPTQLSGAPATPAPVVRVAAPRGVASPAAGAACRAAAKGRECSSGSCPTLRGNKGELAFVASPPKKSWRPKSS

SEQ ID NO: 72750 - DNA, 1462 bp, Zea mays
  misc_feature: Ceres CLONE 1556546
  misc_feature: Encodes the peptide sequence at SEQ ID NO. 72751
aaacgcgtctctctgtaaaccacagtccacagccaccaagatcgccgcgctctctccaacatctcctgaccaaagcgaatccagcatcaccggggtccaggaggcagcatggctgacgaccagcagccaccggcgcaacggtactggttcccgtactggacctcgcctgctcctcggccggtcgcccgcccgcagctgtcgaggcgggaaactcgcccggcaccgtcacctcctgcaacagcgtcgccgtcgcggcggccgtcgcatccgcaacaggcggcgacgccggcatccagaggcgctggcggtggtgtccctgatccacctgcccagccgcagcccacgcggctgtccagcaggccatcgccgtcgccttcccgcgctcagccactgtcgcccattagagagcccaacgcttcaccggcaccggttgccaaagagcacaagcagccttctcctcttcatcataccgagcatggtgttcctaagcaaaaagacatcaccgttccgcaagagaaaaccatccatgaaccgcttgtagcatccaagacacaaacaaagaccccagagaaagaaaaagacaaggaaaagggaaaggagaaggagaaggaaggcagccagctgcacaaggaaaaagataaggagaagaaagacaaggagaaggaaaaggaaaaagataaagagaaggaggatcataaagataagaaagacaaggatcacaaagagaagaaagaaaagaataaagagaaggaaggcagccagctacacaaggagctcaaggcgggtgtcgccgacatggtgcacacgctcagctcttcggcaccgtcatccgggggcggccacgagcgtgctggctctgcggcggcgggaacaacaatcatcacgctggccggcgagaacaagggcacgtccatgaaggtagacagcagcgccgtagcctacggcacggcggacgcggcgggcagcaaggagcgccgcggccacaagctcgacggcagcgtcatcgtgagcgggaaggagcaagctggggccggcaaagggctgacagctttcgtcaacagcaacgtgcaggtcatcaacaactcgctgctgctgcagagctcctgccacggcggcgacctgggggtgcacctcaagctgtccaccaaggccaagaagaaggacggcaaggaagccgggggcaatagtggctctgctgctgcgccaaaaaaatgatcaaccttcatccatatcgctggcgcgctgcatgcatggctatcgagcaatgactaataattatttgttaagtatcaatcaaaacagagagttggacggacctggttagcgtcgtcgattatttatatgtacaacatggatgtgagttcgcaaaaattcgtgctgaatgatgcctgtaaaacctaacaagatgccaaaatgggctaatcaagcaaccaaatctctgtgtacaaaaaaaaaaaaaaaa

SEQ ID NO: 72751 - protein, 368 aa, Zea mays
  misc_feature: Ceres CLONE 1556546
MADDQQPPAQRYWFPYWTSPAPRPVARPQLSRRETRPAPSPPATASPSRRPSHPQQAATPASRGAGGGVPDPPAQPQPTRLSSRPSPSPSRAQPLSPIREPNASPAPVAKEHKQPSPLHHTEHGVPKQKDITVPQEKTIHEPLVASKTQTKTPEKEKDKEKGKEKEKEGSQLHKEKDKEKKDKEKEKEKDKEKEDHKDKKDKDHKEKKEKNKEKEGSQLHKELKAGVADMVHTLSSSAPSSGGGHERAGSAAAGTTIITLAGENKGTSMKVDSSAVAYGTADAAGSKERRGHKLDGSVIVSGKEQAGAGKGLTAFVNSNVQVINNSLLLQSSCHGGDLGVHLKLSTKAKKKDGKEAGGNSGSAAAPKK

SEQ ID NO: 72752 - DNA, 678 bp, Zea mays
  misc_feature: Ceres CLONE 1556551
  misc_feature: Encodes the peptide sequence at SEQ ID NO. 72753
ctggagctccccgcggtggcggccgctctagaactagtggatcccccgggctgcaggaattcgtctcacccctagaaaaaaaaaaggggtccttcaagtttactacttgagcttgaaaattgcgttagcagttccacaagcctcgcgctggtagtctggtacagacgtacagtacagtcgctgccgcgaaaggggaatcgcgcgaggcgagatggagctctcgccggtggggaggtgggccgacctccccgaggacatcgccgtagccgtcgcctcctgcctccagggatggaaagctctctacatcagccagcacataagaatggctgttgcaatatctaatgtggttgaatttgtgggcagcagcttaaataatgggtcacttgaatccgaatactatctgaaagctattgctgatttggccttgatacctgatataggattcctggatgtccagttttttcttgttctcaaggaatcatagtgcgataataaacctaattgggactgcactactcgatcgcatctttgcatgtgctgccaactgaagtcagtaaagcactccaagctcacggagtagcagaaaggggaattttgggtaaccctggcattagggggtttcaagggtttcccggtgcccgaacaatacaagtggccccaaatctttctagggggagc

SEQ ID NO: 72753 - protein, 90 aa, Zea mays
  misc_feature: Ceres CLONE 1556551
MELSPVGRWADLPEDIAVAVASCLQGWKALYISQHIRMAVAISNVVEFVGSSLNNGSLESEYYLKAIADLALIPDIGFLDVQFFLVLKES

SEQ ID NO: 72754 - DNA, 649 bp, Zea mays
  misc_feature: Ceres CLONE 1556553
  misc_feature: Translation starting site: 162
  misc_feature: Pfam Name: DUF602 Pfam Description: Protein of unknown function, DUF602
  misc_feature (414)..(414): n is a, c, t, g, unknown, or other
  misc_feature (415)..(415): n is a, c, t, g, unknown, or other
  misc_feature (418)..(418): n is a, c, t, g, unknown, or other
  misc_feature (423)..(423): n is a, c, t, g, unknown, or other
  misc_feature (424)..(424): n is a, c, t, g, unknown, or other
  misc_feature (426)..(426): n is a, c, t, g, unknown, or other
  misc_feature (427)..(427): n is a, c, t, g, unknown, or other
  misc_feature (428)..(428): n is a, c, t, g, unknown, or other
  misc_feature (464)..(464): n is a, c, t, g, unknown, or other
ctggagctccccgcggtggcggccgctctagaactagtggatcccccgggctgcaggaattcgtctcacccctagaaaaaattgtcttcgtccgtccagcaccagctttcctccgcaccccgatccggacagcctcgccggaaccctaaccctagcgcgccatggcgggatccgcccagcccgcatccagggccgtcgtgctacgcctggacgacctggcgctgcccccgcggcacctcaccgtcccctcccacctccccgtctccgacctcctccgctccatcccgctcccctcgccctcctgctactacctcaccgccgacgggcgcccgctgccggcctcctccccggtggcggcgctcccgccgtcggcctccgtccagctccgccctcgcgcgctcgggggcggcggcnngcnacggnngnnncacgggcgccgagtcccgcgactgctacctctcccngtacctcgccaagaagcccaacagggcggaccccaacgagggcgcgctctcccgctttacctgcttgccgctcttcgggggaaccccttggcggggcccgcgtttcccaaacgccttgggaaacttaaaaacaaggagccccccctttaagggcgctgtttccaaaaagccctgcccagggcccg

SEQ ID NO: 72755 - DNA, 713 bp, Zea mays
  misc_feature: Ceres CLONE 1556554
  misc_feature: Encodes the peptide sequence at SEQ ID NO. 72756
  misc_feature (614)..(614): n is a, c, t, g, unknown, or other
  misc_feature (615)..(615): n is a, c, t, g, unknown, or other
  misc_feature (616)..(616): n is a, c, t, g, unknown, or other
  misc_feature (617)..(617): n is a, c, t, g, unknown, or other
  misc_feature (618)..(618): n is a, c, t, g, unknown, or other
  misc_feature (619)..(619): n is a, c, t, g, unknown, or other
  misc_feature (620)..(620): n is a, c, t, g, unknown, or other
  misc_feature (621)..(621): n is a, c, t, g, unknown, or other
  misc_feature (622)..(622): n is a, c, t, g, unknown, or other
  misc_feature (630)..(630): n is a, c, t, g, unknown, or other
  misc_feature (631)..(631): n is a, c, t, g, unknown, or other
  misc_feature (632)..(632): n is a, c, t, g, unknown, or other
aagctggagctccccgcggtggcggccgctctagaactagtggatcccccgggctgcaggaattcgtctcacccctagaaaaagcgtcagggcctctcgatcgctcatcagtcgccagaggagtagttgatcgaggtgagtgaggttgaaaagcaggcggcgaacaaagacaccatcgtcatggacggcggatactacggcggccgcgatcagcgctacagcggcgggtactacggcggcggtggcatcgcgacgccggggtacgctccggcggtcccgtacgggatgtcgcaggtgaacatcgagggcaacgggtgcgggcgggcgctgccgccgcagccgaccgtgaaggtgtactgccgcgccaaccccaactacggcatggaggcgtcgcgacgggaaggtggtgcttgcccccggcaaacccccaggacgagtaccagccctggatcaaggacatgccgtgggagcacgagcttccaggaccgaggagggttccccggccttccccctggtgaacaagggcacccggggaagccatccagccctccctggggggatccccccccggggcgcctggggcccctaaaacccggaatttttttgggagaaannnnnnnnngggggggnnnttttgggaagggaaagccccgaaatttgggaaagggttttccctgggtccccagggggaaaaaaatttttccctttaattt

SEQ ID NO: 72756 - protein, 177 aa, Zea mays
  misc_feature: Ceres CLONE 1556554
  misc_feature (145)..(145): Xaa is any aa, unknown, or other
  misc_feature (146)..(146): Xaa is any aa, unknown, or other
  misc_feature (147)..(147): Xaa is any aa, unknown, or other
  misc_feature (148)..(148): Xaa is any aa, unknown, or other
  misc_feature (151)..(151): Xaa is any aa, unknown, or other
MDGGYYGGRDQRYSGGYYGGGGIATPGYAPAVPYGMSQVNIEGNGCGRALPPQPTVKVYCRANPNYGMEASRREGGACPRQTPRTSTSPGSRTCRGSTSFQDRGGFPGLPPGEQGHPGKPSSPPWGDPPPGRLGPLKPGIFLGEXXXXGGXFGKGKPRNLGKGFPWVPRGKKIFPFN

SEQ ID NO: 72757 - DNA, 639 bp, Zea mays
  misc_feature: Ceres CLONE 1556555
  misc_feature: Encodes the peptide sequence at SEQ ID NO. 72758
  misc_feature (397)..(397): n is a, c, t, g, unknown, or other
  misc_feature (398)..(398): n is a, c, t, g, unknown, or other
  misc_feature (620)..(620): n is a, c, t, g, unknown, or other
  misc_feature (624)..(624): n is a, c, t, g, unknown, or other
  misc_feature (639)..(639): n is a, c, t, g, unknown, or other
aaacctggagctccccgcggtggcggccgcctcctagactagtggatcccccgggctgcaggaattcgtctcacccctaggaaaactcttctcttaagatggacagccccgtttgttcactttccaaaaccctcaccaatggcggacctcgaaaccctagccacgcccgcccctgcctctgcctctgcctccaccaagaagaagaagaaacactccaagaagcacaaggccgccagtgacgcccccaccaatgtcaccgtcgacgcatcccttatgggcggttcctcctacgtcgcggccgcccccgtggtcggctacttcccctccgggtacgacccactcactaccgctgcgggggcggattctgccccccccccccgggggggggggggggaannatcccccctgggggggactcgtggtcccgaaaccccgggggggaacggattgcggggggcggaagtttgcccgtaagggccccctgccccagggctccaactaaccccttggggtcccttgaaaaagcccccggccaccccagggatgtggccatcgcggggaaaaaaaatttggaagggtagggcccccccctggagatgccgccccccgcgcgttttctncgcnctttagagggggaan

SEQ ID NO: 72758 - protein, 111 aa, Zea mays
  misc_feature: Ceres CLONE 1556555
  misc_feature (87)..(87): Xaa is any aa, unknown, or other
MADLETLATPAPASASASTKKKKKHSKKHKAASDAPTNVTVDASLMGGSSYVAAAPVVGYFPSGYDPLTTAAGADSAPPPRGGGGEXSPLGGTRGPETPGGNGLRGAEVCP

SEQ ID NO: 72759 - DNA, 659 bp, Zea mays
  misc_feature: Ceres CLONE 1556559
  misc_feature: Encodes the peptide sequence at SEQ ID NO. 72760
ggagctccccgcggtggcggccgctctagaactagtggatcccccgggctgcaggaattcgtctcacccctagaaaaacgttagtcgtccgcccgcgctagtgccatccacactcttctcttctccccggccggaccggagtcaggcagccgaagcaagaaaagcaagcggctttggaagttgggatccatggcgtccacctcgtgcttcctccaccagtccaccgcccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcaagccccgccgccgccgcctacggggaagcagccaacgtgttcggcaagaccaagaagaacacggacttcatctcctacgtcggcgacggcttcaagctgctgatcccgtccaagtgggaacccagcaaggagcggggagtcccccgggcaggtgctccgctacgaggacaacttcgacgcccaccagcaacgtgtccgtcttcatccagcccatcttccaagagggccatcaccgggttacgggtccccccgaggaggttcctctcgca

SEQ ID NO: 72760 - protein, 156 aa, Zea mays
  misc_feature: Ceres CLONE 1556559
MASTSCFLHQSTARVAAPSPRLAAPPRSAQLFVCKAQKQQAAAAESDVSRRAALALLAGVAAVGAKASPAAAAYGEAANVFGKTKKNTDFISYVGDGFKLLIPSKWEPSKERGVPRAGAPLRGQLRRPPATCPSSSSPSSKRAITGLRVPPRRFLS

SEQ ID NO: 72761 - DNA, 651 bp, Zea mays
  misc_feature: Ceres CLONE 1556560
  misc_feature: Encodes the peptide sequence at SEQ ID NO. 72762
  misc_feature (415)..(415): n is a, c, t, g, unknown, or other
aaagctggagctccccgcggtggcggccgctctagaactagtggatcccccgggctgcaggaattcgtctcacccctagaaaaaaccagcaagaccaaccaacccacttctgactgaccactgtgccgcgccgtgctcaccgaacggtcgaccacacagaacgacgatggccgcgtcggcgctgcaccagaccaccagcttcctcgggcaggcctggtcgcccgcgcccgccgcgtcgatgcccgcgggcgcatcaccatgcggcgcaacgtcaagaacgttcccccgaacatatttgtacggcccttgacccccccaagtaccttgtgcccttctcccaaagaaaacccctcctttactgaaccggaaatttccccccccaatatttggggggggaacccccggccctcttttncccaacacgaaaaattttttccccaacccggggacgcaaaaggggttcccctcccccgtgggggaaaactttgggggccccgggcctccctttttcccccaaattctttggttaaaaaaaggcgccacatttctgcggaggaggggtgggtgtttaagggggccggccgccacatttttttctgaaggggggggggtgggagtctcctccggggaaaccccaccccctctgtgact

SEQ ID NO: 72762 - protein, 47 aa, Zea mays
  misc_feature: Ceres CLONE 1556560
MAASALHQTTSFLGQAWSPAPAASMPAGASPCGATSRTFPRTYLYGP

SEQ ID NO: 72763 - DNA, 679 bp, Zea mays
  misc_feature: Ceres CLONE 1556565
  misc_feature: Encodes the peptide sequence at SEQ ID NO. 72764
aagctggagctcaccgcggtggcggccgctctagactagtggatccccgggctgcaggaattcgtctcacccctagaaaaacttgtgatttctaatggaaagattactgcccacaggtgttccgaacactccgtaagttgttctaggttgacccagcagattatatgttgtccctctgtggagatgatgctcttcgtgagctctcatcccctggcaagagtggaagcttctcttacttgacaaatgatgatcgttacaggatcagcacaatgaacacacgtgaagtgaagatgcttttgaggatgcttctagcttactacaatcatgtccgtgcatttgaggataccttagtgacgaaactctttggactacattgtgtgaagtctggatcacaccggatgacagttcgttctgtgatgatgcgaaatttgttctgctctgatcatactatccatatgcgtattgatctgacaggatcatctcttgctcgtatatctgactagccaccagcatagattgatgagtctacagctctgacagaccttgatcctaactttatctatcggttacataaacatggcaccaacagtctcatatgcaagtggacgaggactgtgatatcctcgagctggacacgattatcgactacagtcctataggagggtgtacatctactagg

SEQ ID NO: 72764 - protein, 112 aa, Zea mays
  misc_feature: Ceres CLONE 1556565
  misc_feature (2)..(113): Pfam Name: PIP5K Pfam Description: Phosphatidylinositol-4-phosphate 5-Kinase
  misc_feature: SWISSPROT Homolog: EC 2.7.1.68 1-phosphatidylinositol-4-phosphate 5-kinase
MLSLCGDDALRELSSPGKSGSFSYLTNDDRYRISTMNTREVKMLLRMLLAYYNHVRAFEDTLVTKLFGLHCVKSGSHRMTVRSVMMRNLFCSDHTIHMRIDLTGSSLARISD

SEQ ID NO: 72765 - DNA, 684 bp, Zea mays
  misc_feature: Ceres CLONE 1556572
  misc_feature: Encodes the peptide sequence at SEQ ID NO. 72766
  misc_feature (336)..(336): n is a, c, t, g, unknown, or other
  misc_feature (366)..(366): n is a, c, t, g, unknown, or other
  misc_feature (391)..(391): n is a, c, t, g, unknown, or other
ctggagctccccgcggtggcggccgctctagaactagtggatcccccgggctgcaggaattcgtctcacccctagaaaaagtgacctcagacctcacacattcacagtgtcacgctgcctcaacgtcatgtctctcctcgcctcccccacgccgttcggcgtgaccgccatccgccgccgcgtcgccccgcttcctctcctccctgctggcggtcgcgccgccctgcacgtggccctcgcgcgccgcggcggggtctcgtcccggacgcagcggcgcctcgaggaacgaggggagcagaagcgcccgcggtggggtcgtggcgcccgacgtggacnaagacccggcggaagccggggtggctgaantgggaaggggaccccctgggggtcnaaggtgtcaacggagcccatgccccggctggcaaaacccgaaaaccccaaactttggggaaggaaccccagtggaaggcccccgggttttttttggaaaaaaattggggggtttggggtcccctccggcccaatggttggggggcgcgttgggccccttaaaagtgggggaaaaaatttaaaaacacccccttttagagggccccaccaggggtgtcccgggggagaaaaaaaacacccgccttggtgtgttggaacccccctggggggccccccccctctaggaaaaaaata

SEQ ID NO: 72766 - protein, 78 aa, Zea mays
  misc_feature: Ceres CLONE 1556572
  misc_feature (70)..(70): Xaa is any aa, unknown, or other
MSLLASPTPFGVTAIRRRVAPLPLLPAGGRAALHVALARRGGVSSRTQRRLEERGEQKRPRWGRGARRGXRPGGSRGG

SEQ ID NO: 72767 - DNA, 606 bp, Zea mays
  misc_feature: Ceres CLONE 1556575
  misc_feature: Encodes the peptide sequence at SEQ ID NO. 72768
tggagctccccgcggtggcggccgctctagaactagtggatcccccgggctgcaggaattcgtctcacccctagaaaaaaacctcgtgttcgttcggagcgcacacacacacaaccagatctcccccaaatccacccgtcggcacctccgcttcaagatgcagatctttgtgaaaaccctgaccggcaagactatcaccctcgaggtggagtcgtctgacaccattgacaacgttaaggccaagatccaggacaaggagggcatccccccagaccagcagcggctcatcttcgctggcaaacagcttgaggacgggcgcacgcttgctgactacaacatccagaaggagagcaccctccaccttgtgctccgcctcaggggaggcatgcagatctttgtgaaaaccctgaccggcaagactatcaccctcgaggtggagtcctctgacaccattgacaacgtcaaggccaagatccaggacaaagagggcatcctccagaccagcagcggctcatctttgctgggaaagcaaccttgaggaccggccccaacgcttggcgaactaacacattccagaaaagggggaccccccccccccccttgggg

SEQ ID NO: 72768 - protein, 126 aa, Zea mays
  misc_feature: Ceres CLONE 1556575
  misc_feature (6)..(74): Pfam Name: ubiquitin Pfam Description: Ubiquitin family
  misc_feature: SWISSPROT Homolog: EC 3.1.2.15 Ubiquitin thiolesterase
MQIFVKTLTGKTITLEVESSDTIDNVKAKIQDKEGIPPDQQRLIFAGKQLEDGRTLADYNIQKESTLHLVLRLRGGMQIFVKTLTGKTITLEVESSDTIDNVKAKIQDKEGILQTSSGSSLLGKQP

SEQ ID NO: 72769 - DNA, 657 bp, Zea mays
  misc_feature: Ceres CLONE 1556582
  misc_feature: Translation starting site: 552
  misc_feature (218)..(218): n is a, c, t, g, unknown, or other
  misc_feature (219)..(219): n is a, c, t, g, unknown, or other
  misc_feature (232)..(232): n is a, c, t, g, unknown, or other
tccccgcggtggcggccgctctagtactagtggatcccccgggctgcaggtattcgtctcacccctggaaaaaaagaaaacagagaagcacgcaccagcaatccttggaaagtttcccgcgcaaaaaactaaaaaagaattataaacggaagaagaacggcaggcgaagcatcgccagattggtatatcgatcgattgatcggtggcggagggatggnnagtgaactactcnaacgagatccacgacctctccaccgtgcagagcggctccgccgtccccaccttgttctacgacccggacaagtccatcgccgacatcttcccgccgcaccttgggaaagaagggatctctgatgtggcggccacgttccgggggggagttcatcacctggcggggcgcgtccacccaccgggggggacaaaaacccatctcgccacctggggcagtcggggggccagcaggctcatccttccccgccaaggttctagggcgaaggggcaaaatattcggggggcccacataaaacccgccggtaacagttctcgtagcaatgttcgggggaatttcccatagattcgaggagcccgtgcagtcgggggggggctcgttgcggcgggggagtattggagaggagttacaataataaaatgaatccc

SEQ ID NO: 72770 - DNA, 681 bp, Zea mays
  misc_feature: Ceres CLONE 1556600
  misc_feature: Translation starting site: 241
  misc_feature (373)..(373): n is a, c, t, g, unknown, or other
  misc_feature (412)..(412): n is a, c, t, g, unknown, or other
ctccccgcggtggcggccgctctagaactagtggatcccccgggctgcaggaattcgtctcacccctagaaaaaaaagaccggcaccccgccgggtccgaggtgcatcgcggcatcggcatcgccacaaagcccatctcacagcctcgcagcctcttctcctcgtccatctcttccgcctccctccccgcgccgccgttcgccgaagccccgcgtcgcgtcgcgtcgcgtagagtgcttgatggctgccgcaaggggcattaaccagcttctgaagagaattctccacaaccagtccgctggtccatggctgctttcttcatttcgggggaatcatgaagagtcctctgctggattgagagcattggcgcttncttggagttgggtgcctcgggtcttttgagttttgctancataacatcttgctgatgaccttgacacggtttggcagccccaaattatccatggccacatgctgggatcatgaagttctatgatcatgcatcaattcgccgagggcatcaagtttaccaacagttggggcttcttgccactcatgtgcctgattccaaccggggaatgggtggggggggcctttttctggggaggaaacaaaggcatgggttgctggaaattgaggtcttttaggggcccaaaggagaaggggaaaattttccccgcc

SEQ ID NO: 72771 - DNA, 704 bp, Zea mays
  misc_feature: Ceres CLONE 1556603
  misc_feature: Encodes the peptide sequence at SEQ ID NO. 72772
  misc_feature (313)..(313): n is a, c, t, g, unknown, or other
  misc_feature (316)..(316): n is a, c, t, g, unknown, or other
ctccccgcggtggcggccgctctagaactagtggatcccccgggctgcaggaattcgtctcacccctagaaaaaaacaacccctgtctgtgggagaagggaggagccagagccagccagccagccaccgcccacggcggccacacaacctcggtcggcgcggcggctcaacccaatggctccttcctccccccgccgcccgctgcgccaccacccgtctcccctcgtcgtcctcgccgtcgccgtcctcctcgtctcgctccgaatctcgcgcaccgccgatgggctgccggaggcgggaggaggaggaggcnacngtctgtaccgggagattctcagagacgagaccgtgcagaggctcaaagagctgggcaaagatatctgatgggggatgctaccttgaaaggacgttttctgaattcggctttcatcaaaaccactgtgtcatcctccgctggaagaaaagaacctgggctaccaacctggggccatcaaaaggggaaatttctgggccaatatgaaccggcaatttccaaccaaaaaggccttgttgaattggaatccaattggacaccggcccttaattccggggattaacaaaggaaattttgggtattaatttcccccatctccaccccctaaagggtttttaaaaaattccggggaaaatccccaaaggtttaaaaagcccccggggggggtctt

SEQ ID NO: 72772 - protein, 69 aa, Zea mays
  misc_feature: Ceres CLONE 1556603
  misc_feature (47)..(47): Xaa is any aa, unknown, or other
  misc_feature (48)..(48): Xaa is any aa, unknown, or other
MAPSSPRRPLRHHPSPLVVLAVAVLLVSLRISRTADGLPEAGGGGGXXLYREILRDETVQRLKELGKDI

SEQ ID NO: 72773 - DNA, 662 bp, Zea mays
  misc_feature: Ceres CLONE 1556605
  misc_feature: Encodes the peptide sequence at SEQ ID NO. 72774
tggagctccccgcggtggcggccgctctagaactagtggatcccccgggctgcaggaattcgtctcacccctagaaaaaatcttctcgcgtcgattgcttgcccagctcgcttcgtcttcgtcttccttctcccccttctcctcgcctccggttaaccgccacagcctggattcgccatctcccgcggcggcgcggccggccgctgctgctgcgtcggcgcgtgagatggatgattgcggcggcggcggcggcaagaggccgttccagctggcgcggtcgctgacgtaccaccaccacccggggcaccggccggcggctgcgtccaggtggcggcggcagcaccagcagcatcagctcgcggacgagccgcgcgcgccccggccgcaggcggtggtgctgtacacgacgtcgctgcgcggggtgcggcgcacgttcgcggactgcgccgcggtgcgcgccatcctgcgcggcttccgcgtggccgttgacgagcgggacgtgtccatggacgcggcgctccggcgggaggtccaggcgctgcttggcccgcgcggccgcgccttcgggctcccgcgctgctcatcggggggcgcctcgccggcgcgccggaaaaggtgcggcagcttaacgagaaccggccaacttcagcgccttcttctag

SEQ ID NO: 72774 - protein, 145 aa, Zea mays
  misc_feature: Ceres CLONE 1556605
  misc_feature (57)..(125): Pfam Name: Glutaredoxin Pfam Description: Glutaredoxin
MDDCGGGGGKRPFQLARSLTYHHHPGHRPAAASRWRRQHQQHQLADEPRAPRPQAVVLYTTSLRGVRRTFADCAAVRAILRGFRVAVDERDVSMDAALRREVQALLGPRGRAFGLPRCSSGGASPARRKRCGSLTRTGQLQRLLL

SEQ ID NO: 72775 - DNA, 1244 bp, Zea mays
  misc_feature: Ceres CLONE 1556612
  misc_feature: Encodes the peptide sequence at SEQ ID NO. 72776
aactgtcagtcagtcggtggcagagacgagcaccttctccagtttttttctcagttctcactccatggccgccgcggcctgcaacccagtggctccttccgggcctgtgccgttcaaggacgtcgacgacggcagtgttccagagcacactcccaaggaggagttcggcgacctcgtggccgcgctgccgagcaggcagcagtccatcctggagctgcgcctgtaccagggcttctggctgccggagcactgggtgccggggaccatcgtgttccagcgccgcttcacgccgcgccccgacgacgtgatcctcgcgagctaccccaagtgcggcaccacgtggctgaaggcgctggccttcgccacggcggcgcgtacggcgtacccgcccggtggcgccaggcacccgctccgacggctcaacccgcacgactgcgtcccgttcatcgacgagatcttcgccagcggggaggaggcgaagctcgaggccctcccgtcgccgaggctgatgaacacgcacctgccctacgccctgctcccggcgcccgtcaccgccaccgccaccgggtgcagggtcgcgtacgtgtgcagggaccccaaggacatggtggtctcgctctggcacttcctccggcgcgccaagccggacctcttgttcgccgacacgttcgagtccgtctgcgacggcaccgtggtggtcggcccggtctgggaccacgtcctctcctactggcgtgcgagcgtggcggccccggacagggcgctcttcctcaggtacgaggacatgctgcgggaccccggcggcaacgtgcggcggctcgccgagttcatgggccgcccgttctcggccgccgaggaggccgccggcgacgtcgcggccgtcgtggagctctgcagcttcgacgagatgaaagggctggaggtgaacaggcctggtagcggcaccgcggggaggtaccgccccatgccgcgcgacgccttcttccggaagggtgtcgccggggactgggcgaaccacatgacgccggagatggcggcgcggctggacgggatcttccgtgaaaagctccaagggacggggcttatcttctcataatgcaaatgtgtatacggctcttgatttgcgtggtcatctcttctgatcttttccgtggtgtcttgtgtttacacgagatatgttagatccaaaataagtagtgatgatttaatatatacatcatatgcatcaaaaaaaaaaaaaaaaa

SEQ ID NO: 72776 - protein, 343 aa, Zea mays
  misc_feature: Ceres CLONE 1556612
  misc_feature (78)..(339): Pfam Name: Sulfotransfer_1 Pfam Description: Sulfotransferase domain
  misc_feature: SWISSPROT Homolog: EC 2.8.2.1 Aryl sulfotransferase
MAAAACNPVAPSGPVPFKDVDDGSVPEHTPKEEFGDLVAALPSRQQSILELRLYQGFWLPEHWVPGTIVFQRRFTPRPDDVILASYPKCGTTWLKALAFATAARTAYPPGGARHPLRRLNPHDCVPFIDEIFASGEEAKLEALPSPRLMNTHLPYALLPAPVTATATGCRVAYVCRDPKDMVVSLWHFLRRAKPDLLFADTFESVCDGTVVVGPVWDHVLSYWRASVAAPDRALFLRYEDMLRDPGGNVRRLAEFMGRPFSAAEEAAGDVAAVVELCSFDEMKGLEVNRPGSGTAGRYRPMPRDAFFRKGVAGDWANHMTPEMAARLDGIFREKLQGTGLIFS

SEQ ID NO: 72777 - DNA, 642 bp, Zea mays
  misc_feature: Ceres CLONE 1556613
  misc_feature: Encodes the peptide sequence at SEQ ID NO. 72778
aaagctggagctccccgcggtggcggccgctctagactagtggatcccccgggctgcaggaattcgtctcacccctagaaaaacccgtctggccacccatccgatcccacccggcagcggcgctgcgcaatggccacccacgcagctctcgccgcctcccgcatccccgccggcgcccggctgcacagcagggcgccggcgtcgtccaggcacggcgtgcagaggctggacttcgccgacttctccgggctcaggccggggtcgtgctccgtgagcgctgccgcgcgggaggcgtccttctccgacgtccttggcgcgcagctcgtcgccaaggccaccggggagaacgccgtgagggcgcccgcagaagcgaagctgagggtggcgatcaacggcttcggccgcatcggccggaacttcctccggtgctggcacggccgcgaggactcgccgatcgacgtcgtcgtcgtggacgacagcggaggcgtcaggaacgcgtcccaccctcctcagtacgactcgatgctcggggaccttcaaggccgacgtcaagaacgtgggacaaacctacccttcaagggggaacgggcaaccccaataacgggccgtcctccaacaagggaacccgcttcaaagctcccg

SEQ ID NO: 72778 - protein, 171 aa, Zea mays
  misc_feature: Ceres CLONE 1556613
  misc_feature (83)..(167): Pfam Name: Gp_dh_N Pfam Description: Glyceraldehyde 3-phosphate dehydrogenase, NAD binding domain
  misc_feature: SWISSPROT Homolog: EC 1.2.1.13 Glyceraldehyde-3-phosphate dehydrogenase (NADP(+)) (phosphorylating)
MATHAALAASRIPAGARLHSRAPASSRHGVQRLDFADFSGLRPGSCSVSAAAREASFSDVLGAQLVAKATGENAVRAPAEAKLRVAINGFGRIGRNFLRCWHGREDSPIDVVVVDDSGGVRNASHPPQYDSMLGDLQGRRQERGTNLPFKGERATPITGRPPTREPASKLP

SEQ ID NO: 72779 - DNA, 611 bp, Zea mays
  misc_feature: Ceres CLONE 1556617
  misc_feature: Translation starting site: 109
ccccgcggtggcggccgctctagaactagtggatcccccgggctgcaggaattcgtctcacccctagaaaaaacgtcacgctctacaacggcactgcttgcgctcgccatggcagtcgactccgcctcgtcgtcctccatgatgtcgtcacggtcgctcttcatgattgggcaccgggagacgccctccttcctcggcgaggagaccctgctgacacacgccgaggcggcccggccgtatttcgacatgcgcatctcggtggaccgcaacacgcctatctggttccccggcagcacccctccggggtacttcggcggtaatcttcgcggccactgatgctatgatcacagggggctcggatacgacccggagaacctgcggtagaacctgcaggcggagctggtgcactgcgcggtgggccatgctcgacgcgctgagcatcatcatccccgagttcctgaccttgatgggcgtcctcagcaagcacttctggttcaccgacggcgagcagcagtacttcatcgagatcaccaccctcttcatcgtcgaggtcatcctcatcggctgagaccatggcccccgatgggctgacatcaataacctcggaagcg

SEQ ID NO: 72780 - DNA, 655 bp, Zea mays
  misc_feature: Ceres CLONE 1556618
  misc_feature: Encodes the peptide sequence at SEQ ID NO. 72781
ctggagctccccgcggtggcggccgctctagaactagtggatcccccgggctgcaggaattcgtctcacccctagaaaaacaccagcggcatctatagcaaccggtccagcactttcacgctcagctccagcaatggctgcctccaccatggcgatctcctccacggcgatggccggcacccccatcaaggtgggctccttcggcgagggccgcatcaccatgcgcaagaccgtgggcaaacccaaagtggcgacgtccggcagcccctggtacggccccaaccgcgtcaagtacctcggccccttctccggcgagaccccgagctacctcaccagcgagttccccggcgactaccgctgggacaccgccgggctgtccgccgaccccgagaccttcgccaagaaccgcgagctggaggtgatccactcccgctgggccatgctcggcgcgctcggctgcgtcttccccgagctgctctccctcaacggcgtcaagttcggcgaggccttctggttcaaggccggctcccatatcttcagcgagggcgggctggactacctcggcaaccccagcctgatccacgcgcagagcatcctcgccatctgggcctgccaggtcgtagctcatgggtgccgtcgagggctaccgcattgc

SEQ ID NO: 72781 - protein, 174 aa, Zea mays
  misc_feature: Ceres CLONE 1556618
  misc_feature (61)..(174): Pfam Name: Chloroa_b-bind Pfam Description: Chlorophyll A-B binding protein
MAASTMAISSTAMAGTPIKVGSFGEGRITMRKTVGKPKVATSGSPWYGPNRVKYLGPFSGETPSYLTSEFPGDYRWDTAGLSADPETFAKNRELEVIHSRWAMLGALGCVFPELLSLNGVKFGEAFWFKAGSHIFSEGGLDYLGNPSLIHAQSILAIWACQVVAHGCRRGLPHC

SEQ ID NO: 72782 - DNA, 577 bp, Zea mays
  misc_feature: Ceres CLONE 1556622
  misc_feature: Encodes the peptide sequence at SEQ ID NO. 72783
ctggagctccccgcggtggcggccgctctagaactagtggatcccccgggctgcaggaattcgtctcacccctagaaaaaaacgtcagaaccaaacgcggcccccttgccctctcctacttctcctcccccgccccgccgccattccccccccactcttcaccaccgcagcgccgccgcgtacaaggcgattaggcgaagctgcaccggaaggagaaggagagaagcgagagtctccccagccagagcaagccgaatccgaagctagcggagaggagagagggctgagtgaggatgccgacggttacctgcaacgcgtgcaacgcggggttcgacgacgaggagcagcagcggcttcactaccgctctgaatggcaccgttacaacctcaagcgcaaggtgggctggagttcctggtgtcacaagaggctctgtttcttggctaggcaagctgctttggggcggaaggggaaaaaaggccgggctagccccccaaaggccttttaaagcttggccccctttggggggaaaaggaataccaaaaacccccaaaaagcctccaagaaggggattctttt

SEQ ID NO: 72783 - protein, 70 aa, Zea mays
  misc_feature: Ceres CLONE 1556622
MPTVTCNACNAGFDDEEQQRLHYRSEWHRYNLKRKVGWSSWCHKRLCFLARQAALGRKGKKGRASPPKAF

SEQ ID NO: 72784 - DNA, 551 bp, Zea mays
  misc_feature: Ceres CLONE 1556627
  misc_feature (299)..(299): n is a, c, t, g, unknown, or other
ttccccgcggtggcggccgctctagaactagtggatcccccgggctgcaggaattcgtctcacccctagaaaaaagcacgtctgtttctccccagctccaagccggacgacgcagcgtagcagcagagagccagagaccagagatggccgccctcgccgccgcctccacggccgccttcgccgcgagccgcgcgcgcgcctctcgtggctgctccgccgcaccggcgacagcagcagcgtgtcgctcgcgtcctcgtgagacgtctccgcgcgctgcgctgtcgtcgtgctgctgtctngggcgcaactcccctcgcgggggccgcgaaatgcgggctgacccctgcagggatccaaggcgttccgacccccagaaaaactccatcaaaaactccccccgtccctaaaaaattacgcccaaaaagccccccgggtttcctttaagccccctttggaaaaacccaagcccggtttagaaaacccccaaaattcggggtttttttgggggcccaaaagggtgtcccccccctttttttgggggggggaaaagg

SEQ ID NO: 72785 - DNA, 716 bp, Zea mays
  misc_feature: Ceres CLONE 1556631
  misc_feature: Encodes the peptide sequence at SEQ ID NO. 72786
  misc_feature (345)..(345): n is a, c, t, g, unknown, or other
ctccccgcggtggcggccgctctagaactagtggatcccccgggctgcaggaattcgtctcacccctagaaaaaacacacccatccaattccagctgctgatcgtgatcctgcaccccgagccgtacacaagagctagtcggtagaacttgcaggagcggagcagaactaagtgcagagaacaggacatatggctacgccggcggtgaaggtttacgggtgggctatctcgccgttcgtatcgcgggctcttctggccctggaggaggccggcgtcgactacgagctcgtccccatgagccgccaggacggcgaccaccgccgcccgggagcactcgccaggaanccttttcggggagggtgcccgtgctcgaggatggcggacctcacgctcttcgaatcacgtgcgatcgcgaggcatgtttctccggaagcacaaacccgaacctgcttgggcggcggcaggctggaacaaaacggcaaagggggaccttgtggctgggaggtggaggccccaccagcggaacccggcgggcgattccccctccgaagggagggggggggttccccccttttcctggggcccgagaggcaaacaagggggggggggggcaaaaaacttgggaaaacccaaaaaaggggggggggggtgttaaaagaggggggtgtggcccctgaaaaatttcctcgcggggaattcttttttcccctcgaaac

SEQ ID NO: 72786 - protein, 175 aa, Zea mays
  misc_feature: Ceres CLONE 1556631
  misc_feature (4)..(80): Pfam Name: GST_N Pfam Description: Glutathione S-transferase, N-terminal domain
  misc_feature: SWISSPROT Homolog: EC 2.5.1.18 Glutathione transferase
  misc_feature (52)..(52): Xaa is any aa, unknown, or other
MATPAVKVYGWAISPFVSRALLALEEAGVDYELVPMSRQDGDHRRPGALARXPFRGGCPCSRMADLTLFESRAIARHVSPEAQTRTCLGGGRLEQNGKGGPCGWEVEAPPAEPGGRFPLRREGGGSPLFLGPERQTRGGGGKKLGKTQKRGGGVLKEGGVAPEKFPRGEFFFPLE

SEQ ID NO: 72787 - DNA, 751 bp, Zea mays
  misc_feature: Ceres CLONE 1556640
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (148)..(148): n is a, c, t, g, unknown, or other
  misc_feature (149)..(149): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (180)..(180): n is a, c, t, g, unknown, or other
  misc_feature (181)..(181): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (216)..(216): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (244)..(244): n is a, c, t, g, unknown, or other
  misc_feature (245)..(245): n is a, c, t, g, unknown, or other
  misc_feature (246)..(246): n is a, c, t, g, unknown, or other
  misc_feature (247)..(247): n is a, c, t, g, unknown, or other
  misc_feature (248)..(248): n is a, c, t, g, unknown, or other
  misc_feature (249)..(249): n is a, c, t, g, unknown, or other
  misc_feature (250)..(250): n is a, c, t, g, unknown, or other
  misc_feature (251)..(251): n is a, c, t, g, unknown, or other
  misc_feature (252)..(252): n is a, c, t, g, unknown, or other
  misc_feature (253)..(253): n is a, c, t, g, unknown, or other
  misc_feature (254)..(254): n is a, c, t, g, unknown, or other
  misc_feature (255)..(255): n is a, c, t, g, unknown, or other
  misc_feature (256)..(256): n is a, c, t, g, unknown, or other
  misc_feature (257)..(257): n is a, c, t, g, unknown, or other
  misc_feature (258)..(258): n is a, c, t, g, unknown, or other
  misc_feature (259)..(259): n is a, c, t, g, unknown, or other
  misc_feature (260)..(260): n is a, c, t, g, unknown, or other
  misc_feature (261)..(261): n is a, c, t, g, unknown, or other
  misc_feature (262)..(262): n is a, c, t, g, unknown, or other
  misc_feature (263)..(263): n is a, c, t, g, unknown, or other
  misc_feature (264)..(264): n is a, c, t, g, unknown, or other
  misc_feature (265)..(265): n is a, c, t, g, unknown, or other
  misc_feature (266)..(266): n is a, c, t, g, unknown, or other
  misc_feature (267)..(267): n is a, c, t, g, unknown, or other
  misc_feature (268)..(268): n is a, c, t, g, unknown, or other
  misc_feature (269)..(269): n is a, c, t, g, unknown, or other
  misc_feature (270)..(270): n is a, c, t, g, unknown, or other
  misc_feature (271)..(271): n is a, c, t, g, unknown, or other
  misc_feature (272)..(272): n is a, c, t, g, unknown, or other
  misc_feature (273)..(273): n is a, c, t, g, unknown, or other
  misc_feature (297)..(297): n is a, c, t, g, unknown, or other
  misc_feature (422)..(422): n is a, c, t, g, unknown, or other
  misc_feature (459)..(459): n is a, c, t, g, unknown, or other
  misc_feature (495)..(495): n is a, c, t, g, unknown, or other
  misc_feature (501)..(501): n is a, c, t, g, unknown, or other
  misc_feature (503)..(503): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggnnnncccnnncgggggggggggggnnngnnncnnnnnngnnngggnnggggggggggggnnncccnnnnnnnnngggnnggggnnnggnnnnnnnnnnnnncnnnnncnnnngngnnngnnnnnnnnnnnnnnnnnnnnnnnnnnnnnnnnnnnnnnnnnnnnnnnnnnnnccaaaaactgggagactccaccgncggatggcgggcccgctctagaactagtggatccccccgggctgcagggaaattcgtctcacccctagaaaaaagcatctcaagccaccatcgacccttcagtctcgctacgtagcagtgcaatnaaaaagcagcccgcatggcgagcagcaccatggcccntctcctcacggcttcgccgggcagccgtgaacgtgncgttcntntcccgccttcggaaggccgcgtgacattccccaaacggcgcgaaagccaagccacgggggggtccgggaacccggggtagggccccaaccctggttgtacctgggcccattgccgggaaagcccccgatttccttgaggggggattttccggggaaaaaacgggtgtgggaacccccgggggggttttttggaaacccccaaaaatttttccccaaaaaaccgggaaactcgcgggggggaccccccc

SEQ ID NO: 72788 - DNA, 602 bp, Zea mays
  misc_feature: Ceres CLONE 1556642
  misc_feature: Encodes the peptide sequence at SEQ ID NO. 72789
  misc_feature (354)..(354): n is a, c, t, g, unknown, or other
  misc_feature (398)..(398): n is a, c, t, g, unknown, or other
  misc_feature (411)..(411): n is a, c, t, g, unknown, or other
catagctggagctccccgcggtggcggccgctctagaactagtggatcccccgggctgcaggaattcgtctcacccctagaaaaacccctcccactcggccactcccagtgccagccgccgtgcgctcgctcgcgcgcgctctctttctgggacgaccggtgggatatctccaccgccgccttacgccaggtgcagaccttcgctgatctcttcgccagcgaagagcgtccatcagtaaaatggtggcccttgcaaatgaagaggccttggcccatgatgaagatatcatggatgatgttgattctgatgttgaagaatcggactcagaagacgattcaggtgaagaagctcanggctagccttcagacaaagctatatacaacaaggaggccatccnttgaaaaactgangatattgcctggccccagaatgtggactggatacacaagctcaccattgagcatgatcaggggggaaaaggttgatgtgaattgatgatcctgctcgtggaacttgcggttttacacccaagccttgggatggcacaaggccaggcttttgagaagctgcagtccatgaaaggtcaaggtccctcaggccc

SEQ ID NO: 72789 - protein, 39 aa, Zea mays
  misc_feature: Ceres CLONE 1556642
  misc_feature (38)..(38): Xaa is any aa, unknown, or other
MVALANEEALAHDEDIMDDVDSDVEESDSEDDSGEEAXG

SEQ ID NO: 72790 - DNA, 652 bp, Zea mays
  misc_feature: Ceres CLONE 1556644
  misc_feature: Encodes the peptide sequence at SEQ ID NO. 72791
  misc_feature (450)..(450): n is a, c, t, g, unknown, or other
aaagctggagctccccgcggtggcggccgctctagaactagtggatcccccgggctgcaggaattcgtctcacccctagaaaaaatggtgcgggtccccctctgctccgttttccaattagtgaaccagataggagtcttcttcctccccgaccacaccgctcctctccttccaagccctcgtcaccaccagcctgctctcattcctgtgccacctggatctcaactgcttgcgctcaacatgctccccacacactctcgctgcggcgtgtgcccgcccaacccgtgcatcgctctctgtcgcttccgcctcatcataggtgatggcgtcgtcgtccccgcagcagcacacgaggtcggctcgtcctcgaacctcgcgcaatttaggaatagcggcggatccttcccaggtagacttggatgttgcggtccagcgaatgtcgggggtgtnggaaggagatctccaccgctggagggctctccacgcccatcctccctcccccatccccgctgccagctctgacgctgacagtgccgcagagacgacgctggagtattgtattagtttgtttatcttttgttttgatctaggtcttaatttgccttgatatgtgcaaggcctgcagttgaatgcaatgcgagcaacagctcag

SEQ ID NO: 72791 - protein, 145 aa, Zea mays
  misc_feature: Ceres CLONE 1556644
MVRVPLCSVFQLVNQIGVFFLPDHTAPLLPSPRHHQPALIPVPPGSQLLALNMLPTHSRCGVCPPNPCIALCRFRLIIGDGVVVPAAAHEVGSSSNLAQFRNSGGSFPGRLGCCGPANVGGVGRRSPPLEGSPRPSSLPHPRCQL

SEQ ID NO: 72792 - DNA, 804 bp, Zea mays
  misc_feature: Ceres CLONE 1556648
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (62)..(62): n is a, c, t, g, unknown, or other
  misc_feature (63)..(63): n is a, c, t, g, unknown, or other
  misc_feature (64)..(64): n is a, c, t, g, unknown, or other
  misc_feature (65)..(65): n is a, c, t, g, unknown, or other
  misc_feature (66)..(66): n is a, c, t, g, unknown, or other
  misc_feature (67)..(67): n is a, c, t, g, unknown, or other
  misc_feature (68)..(68): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (89)..(89): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (125)..(125): n is a, c, t, g, unknown, or other
  misc_feature (126)..(126): n is a, c, t, g, unknown, or other
  misc_feature (127)..(127): n is a, c, t, g, unknown, or other
  misc_feature (128)..(128): n is a, c, t, g, unknown, or other
  misc_feature (129)..(129): n is a, c, t, g, unknown, or other
  misc_feature (130)..(130): n is a, c, t, g, unknown, or other
  misc_feature (131)..(131): n is a, c, t, g, unknown, or other
  misc_feature (132)..(132): n is a, c, t, g, unknown, or other
  misc_feature (133)..(133): n is a, c, t, g, unknown, or other
  misc_feature (134)..(134): n is a, c, t, g, unknown, or other
  misc_feature (135)..(135): n is a, c, t, g, unknown, or other
  misc_feature (136)..(136): n is a, c, t, g, unknown, or other
  misc_feature (137)..(137): n is a, c, t, g, unknown, or other
  misc_feature (138)..(138): n is a, c, t, g, unknown, or other
  misc_feature (139)..(139): n is a, c, t, g, unknown, or other
  misc_feature (140)..(140): n is a, c, t, g, unknown, or other
  misc_feature (141)..(141): n is a, c, t, g, unknown, or other
  misc_feature (142)..(142): n is a, c, t, g, unknown, or other
  misc_feature (143)..(143): n is a, c, t, g, unknown, or other
  misc_feature (144)..(144): n is a, c, t, g, unknown, or other
  misc_feature (145)..(145): n is a, c, t, g, unknown, or other
  misc_feature (146)..(146): n is a, c, t, g, unknown, or other
  misc_feature (147)..(147): n is a, c, t, g, unknown, or other
  misc_feature (148)..(148): n is a, c, t, g, unknown, or other
  misc_feature (149)..(149): n is a, c, t, g, unknown, or other
  misc_feature (150)..(150): n is a, c, t, g, unknown, or other
  misc_feature (151)..(151): n is a, c, t, g, unknown, or other
  misc_feature (152)..(152): n is a, c, t, g, unknown, or other
  misc_feature (153)..(153): n is a, c, t, g, unknown, or other
  misc_feature (154)..(154): n is a, c, t, g, unknown, or other
  misc_feature (155)..(155): n is a, c, t, g, unknown, or other
  misc_feature (156)..(156): n is a, c, t, g, unknown, or other
  misc_feature (157)..(157): n is a, c, t, g, unknown, or other
  misc_feature (158)..(158): n is a, c, t, g, unknown, or other
  misc_feature (159)..(159): n is a, c, t, g, unknown, or other
  misc_feature (160)..(160): n is a, c, t, g, unknown, or other
  misc_feature (161)..(161): n is a, c, t, g, unknown, or other
  misc_feature (162)..(162): n is a, c, t, g, unknown, or other
  misc_feature (163)..(163): n is a, c, t, g, unknown, or other
  misc_feature (164)..(164): n is a, c, t, g, unknown, or other
  misc_feature (165)..(165): n is a, c, t, g, unknown, or other
  misc_feature (166)..(166): n is a, c, t, g, unknown, or other
  misc_feature (167)..(167): n is a, c, t, g, unknown, or other
  misc_feature (168)..(168): n is a, c, t, g, unknown, or other
  misc_feature (169)..(169): n is a, c, t, g, unknown, or other
  misc_feature (170)..(170): n is a, c, t, g, unknown, or other
  misc_feature (171)..(171): n is a, c, t, g, unknown, or other
  misc_feature (172)..(172): n is a, c, t, g, unknown, or other
  misc_feature (173)..(173): n is a, c, t, g, unknown, or other
  misc_feature (174)..(174): n is a, c, t, g, unknown, or other
  misc_feature (175)..(175): n is a, c, t, g, unknown, or other
  misc_feature (176)..(176): n is a, c, t, g, unknown, or other
  misc_feature (177)..(177): n is a, c, t, g, unknown, or other
  misc_feature (178)..(178): n is a, c, t, g, unknown, or other
  misc_feature (179)..(179): n is a, c, t, g, unknown, or other
  misc_feature (180)..(180): n is a, c, t, g, unknown, or other
  misc_feature (181)..(181): n is a, c, t, g, unknown, or other
  misc_feature (182)..(182): n is a, c, t, g, unknown, or other
  misc_feature (183)..(183): n is a, c, t, g, unknown, or other
  misc_feature (184)..(184): n is a, c, t, g, unknown, or other
  misc_feature (185)..(185): n is a, c, t, g, unknown, or other
  misc_feature (186)..(186): n is a, c, t, g, unknown, or other
  misc_feature (187)..(187): n is a, c, t, g, unknown, or other
  misc_feature (188)..(188): n is a, c, t, g, unknown, or other
  misc_feature (189)..(189): n is a, c, t, g, unknown, or other
  misc_feature (190)..(190): n is a, c, t, g, unknown, or other
  misc_feature (191)..(191): n is a, c, t, g, unknown, or other
  misc_feature (192)..(192): n is a, c, t, g, unknown, or other
  misc_feature (193)..(193): n is a, c, t, g, unknown, or other
  misc_feature (194)..(194): n is a, c, t, g, unknown, or other
  misc_feature (195)..(195): n is a, c, t, g, unknown, or other
  misc_feature (196)..(196): n is a, c, t, g, unknown, or other
  misc_feature (197)..(197): n is a, c, t, g, unknown, or other
  misc_feature (198)..(198): n is a, c, t, g, unknown, or other
  misc_feature (199)..(199): n is a, c, t, g, unknown, or other
  misc_feature (200)..(200): n is a, c, t, g, unknown, or other
  misc_feature (201)..(201): n is a, c, t, g, unknown, or other
  misc_feature (202)..(202): n is a, c, t, g, unknown, or other
  misc_feature (203)..(203): n is a, c, t, g, unknown, or other
  misc_feature (204)..(204): n is a, c, t, g, unknown, or other
  misc_feature (205)..(205): n is a, c, t, g, unknown, or other
  misc_feature (206)..(206): n is a, c, t, g, unknown, or other
  misc_feature (207)..(207): n is a, c, t, g, unknown, or other
  misc_feature (208)..(208): n is a, c, t, g, unknown, or other
  misc_feature (209)..(209): n is a, c, t, g, unknown, or other
  misc_feature (210)..(210): n is a, c, t, g, unknown, or other
  misc_feature (211)..(211): n is a, c, t, g, unknown, or other
  misc_feature (212)..(212): n is a, c, t, g, unknown, or other
  misc_feature (213)..(213): n is a, c, t, g, unknown, or other
  misc_feature (214)..(214): n is a, c, t, g, unknown, or other
  misc_feature (215)..(215): n is a, c, t, g, unknown, or other
  misc_feature (216)..(216): n is a, c, t, g, unknown, or other
  misc_feature (217)..(217): n is a, c, t, g, unknown, or other
  misc_feature (218)..(218): n is a, c, t, g, unknown, or other
  misc_feature (219)..(219): n is a, c, t, g, unknown, or other
  misc_feature (220)..(220): n is a, c, t, g, unknown, or other
  misc_feature (221)..(221): n is a, c, t, g, unknown, or other
  misc_feature (222)..(222): n is a, c, t, g, unknown, or other
  misc_feature (223)..(223): n is a, c, t, g, unknown, or other
  misc_feature (224)..(224): n is a, c, t, g, unknown, or other
  misc_feature (225)..(225): n is a, c, t, g, unknown, or other
  misc_feature (226)..(226): n is a, c, t, g, unknown, or other
  misc_feature (227)..(227): n is a, c, t, g, unknown, or other
  misc_feature (228)..(228): n is a, c, t, g, unknown, or other
  misc_feature (229)..(229): n is a, c, t, g, unknown, or other
  misc_feature (230)..(230): n is a, c, t, g, unknown, or other
  misc_feature (231)..(231): n is a, c, t, g, unknown, or other
  misc_feature (232)..(232): n is a, c, t, g, unknown, or other
  misc_feature (233)..(233): n is a, c, t, g, unknown, or other
  misc_feature (234)..(234): n is a, c, t, g, unknown, or other
  misc_feature (235)..(235): n is a, c, t, g, unknown, or other
  misc_feature (236)..(236): n is a, c, t, g, unknown, or other
  misc_feature (237)..(237): n is a, c, t, g, unknown, or other
  misc_feature (238)..(238): n is a, c, t, g, unknown, or other
  misc_feature (239)..(239): n is a, c, t, g, unknown, or other
  misc_feature (240)..(240): n is a, c, t, g, unknown, or other
  misc_feature (241)..(241): n is a, c, t, g, unknown, or other
  misc_feature (242)..(242): n is a, c, t, g, unknown, or other
  misc_feature (243)..(243): n is a, c, t, g, unknown, or other
  misc_feature (250)..(250): n is a, c, t, g, unknown, or other
  misc_feature (251)..(251): n is a, c, t, g, unknown, or other
  misc_feature (435)..(435): n is a, c, t, g, unknown, or other
  misc_feature (463)..(463): n is a, c, t, g, unknown, or other
  misc_feature (482)..(482): n is a, c, t, g, unknown, or other
  misc_feature (774)..(774): n is a, c, t, g, unknown, or other
  misc_feature (775)..(775): n is a, c, t, g, unknown, or other
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttnnggggggcaaagctgggagctccacctacggtggcggcccgctctagaactagtggatcccccggggctgcaggaattcgtctcacccctagaaaaaacgacactccacactccaagcgagctagagctagagctatagagatcactctccttctccgcgtgaggtagtgacgcccagccatggnctacatggcactgcgcgccgtggcaacngcgctgctgggtggtggcnggcgtcccgtgtgtcaggccggtcggcgtccaaccccgggggctgtacaaacccggtgccggggaaaaacggggtgtgggcccggggattccaacccaaaacccccgggaaaaaaaggggcctgggccccccccgggcggggccttccaaacttggggcccccgggggggggggttcgcgggttcccgggggcggcgccccccccccgccggggggggggccccgggggcccccccctttgtgggggggcccccccccaaggggggggtttttccttttttttaaaccaccnnggggggggccccccgagggggtgtgtccc

SEQ ID NO: 72793 - DNA, 485 bp, Zea mays
  misc_feature: Ceres CLONE 1556657
  misc_feature (1)..(1): n is a, c, t, g, unknown, or other
  misc_feature (2)..(2): n is a, c, t, g, unknown, or other
  misc_feature (3)..(3): n is a, c, t, g, unknown, or other
  misc_feature (4)..(4): n is a, c, t, g, unknown, or other
  misc_feature (5)..(5): n is a, c, t, g, unknown, or other
  misc_feature (6)..(6): n is a, c, t, g, unknown, or other
  misc_feature (7)..(7): n is a, c, t, g, unknown, or other
  misc_feature (8)..(8): n is a, c, t, g, unknown, or other
  misc_feature (9)..(9): n is a, c, t, g, unknown, or other
  misc_feature (10)..(10): n is a, c, t, g, unknown, or other
  misc_feature (11)..(11): n is a, c, t, g, unknown, or other
  misc_feature (12)..(12): n is a, c, t, g, unknown, or other
  misc_feature (13)..(13): n is a, c, t, g, unknown, or other
  misc_feature (14)..(14): n is a, c, t, g, unknown, or other
  misc_feature (15)..(15): n is a, c, t, g, unknown, or other
  misc_feature (16)..(16): n is a, c, t, g, unknown, or other
  misc_feature (17)..(17): n is a, c, t, g, unknown, or other
  misc_feature (18)..(18): n is a, c, t, g, unknown, or other
  misc_feature (19)..(19): n is a, c, t, g, unknown, or other
  misc_feature (20)..(20): n is a, c, t, g, unknown, or other
  misc_feature (21)..(21): n is a, c, t, g, unknown, or other
  misc_feature (22)..(22): n is a, c, t, g, unknown, or other
  misc_feature (23)..(23): n is a, c, t, g, unknown, or other
  misc_feature (24)..(24): n is a, c, t, g, unknown, or other
  misc_feature (25)..(25): n is a, c, t, g, unknown, or other
  misc_feature (26)..(26): n is a, c, t, g, unknown, or other
  misc_feature (27)..(27): n is a, c, t, g, unknown, or other
  misc_feature (28)..(28): n is a, c, t, g, unknown, or other
  misc_feature (29)..(29): n is a, c, t, g, unknown, or other
  misc_feature (30)..(30): n is a, c, t, g, unknown, or other
  misc_feature (31)..(31): n is a, c, t, g, unknown, or other
  misc_feature (32)..(32): n is a, c, t, g, unknown, or other
  misc_feature (33)..(33): n is a, c, t, g, unknown, or other
  misc_feature (34)..(34): n is a, c, t, g, unknown, or other
  misc_feature (35)..(35): n is a, c, t, g, unknown, or other
  misc_feature (36)..(36): n is a, c, t, g, unknown, or other
  misc_feature (37)..(37): n is a, c, t, g, unknown, or other
  misc_feature (38)..(38): n is a, c, t, g, unknown, or other
  misc_feature (39)..(39): n is a, c, t, g, unknown, or other
  misc_feature (40)..(40): n is a, c, t, g, unknown, or other
  misc_feature (41)..(41): n is a, c, t, g, unknown, or other
  misc_feature (42)..(42): n is a, c, t, g, unknown, or other
  misc_feature (43)..(43): n is a, c, t, g, unknown, or other
  misc_feature (44)..(44): n is a, c, t, g, unknown, or other
  misc_feature (45)..(45): n is a, c, t, g, unknown, or other
  misc_feature (46)..(46): n is a, c, t, g, unknown, or other
  misc_feature (47)..(47): n is a, c, t, g, unknown, or other
  misc_feature (48)..(48): n is a, c, t, g, unknown, or other
  misc_feature (49)..(49): n is a, c, t, g, unknown, or other
  misc_feature (50)..(50): n is a, c, t, g, unknown, or other
  misc_feature (51)..(51): n is a, c, t, g, unknown, or other
  misc_feature (52)..(52): n is a, c, t, g, unknown, or other
  misc_feature (53)..(53): n is a, c, t, g, unknown, or other
  misc_feature (54)..(54): n is a, c, t, g, unknown, or other
  misc_feature (55)..(55): n is a, c, t, g, unknown, or other
  misc_feature (56)..(56): n is a, c, t, g, unknown, or other
  misc_feature (57)..(57): n is a, c, t, g, unknown, or other
  misc_feature (58)..(58): n is a, c, t, g, unknown, or other
  misc_feature (59)..(59): n is a, c, t, g, unknown, or other
  misc_feature (60)..(60): n is a, c, t, g, unknown, or other
  misc_feature (61)..(61): n is a, c, t, g, unknown, or other
  misc_feature (69)..(69): n is a, c, t, g, unknown, or other
  misc_feature (70)..(70): n is a, c, t, g, unknown, or other
  misc_feature (71)..(71): n is a, c, t, g, unknown, or other
  misc_feature (72)..(72): n is a, c, t, g, unknown, or other
  misc_feature (73)..(73): n is a, c, t, g, unknown, or other
  misc_feature (74)..(74): n is a, c, t, g, unknown, or other
  misc_feature (75)..(75): n is a, c, t, g, unknown, or other
  misc_feature (76)..(76): n is a, c, t, g, unknown, or other
  misc_feature (77)..(77): n is a, c, t, g, unknown, or other
  misc_feature (78)..(78): n is a, c, t, g, unknown, or other
  misc_feature (79)..(79): n is a, c, t, g, unknown, or other
  misc_feature (80)..(80): n is a, c, t, g, unknown, or other
  misc_feature (81)..(81): n is a, c, t, g, unknown, or other
  misc_feature (82)..(82): n is a, c, t, g, unknown, or other
  misc_feature (83)..(83): n is a, c, t, g, unknown, or other
  misc_feature (84)..(84): n is a, c, t, g, unknown, or other
  misc_feature (85)..(85): n is a, c, t, g, unknown, or other
  misc_feature (86)..(86): n is a, c, t, g, unknown, or other
  misc_feature (87)..(87): n is a, c, t, g, unknown, or other
  misc_feature (88)..(88): n is a, c, t, g, unknown, or other
  misc_feature (90)..(90): n is a, c, t, g, unknown, or other
  misc_feature (91)..(91): n is a, c, t, g, unknown, or other
  misc_feature (92)..(92): n is a, c, t, g, unknown, or other
  misc_feature (93)..(93): n is a, c, t, g, unknown, or other
  misc_feature (94)..(94): n is a, c, t, g, unknown, or other
  misc_feature (95)..(95): n is a, c, t, g, unknown, or other
  misc_feature (96)..(96): n is a, c, t, g, unknown, or other
  misc_feature (97)..(97): n is a, c, t, g, unknown, or other
  misc_feature (98)..(98): n is a, c, t, g, unknown, or other
  misc_feature (99)..(99): n is a, c, t, g, unknown, or other
  misc_feature (100)..(100): n is a, c, t, g, unknown, or other
  misc_feature (101)..(101): n is a, c, t, g, unknown, or other
  misc_feature (102)..(102): n is a, c, t, g, unknown, or other
  misc_feature (103)..(103): n is a, c, t, g, unknown, or other
  misc_feature (104)..(104): n is a, c, t, g, unknown, or other
  misc_feature (105)..(105): n is a, c, t, g, unknown, or other
  misc_feature (106)..(106): n is a, c, t, g, unknown, or other
  misc_feature (107)..(107): n is a, c, t, g, unknown, or other
  misc_feature (108)..(108): n is a, c, t, g, unknown, or other
  misc_feature (109)..(109): n is a, c, t, g, unknown, or other
  misc_feature (110)..(110): n is a, c, t, g, unknown, or other
  misc_feature (111)..(111): n is a, c, t, g, unknown, or other
  misc_feature (112)..(112): n is a, c, t, g, unknown, or other
  misc_feature (113)..(113): n is a, c, t, g, unknown, or other
  misc_feature (114)..(114): n is a, c, t, g, unknown, or other
  misc_feature (115)..(115): n is a, c, t, g, unknown, or other
  misc_feature (116)..(116): n is a, c, t, g, unknown, or other
  misc_feature (117)..(117): n is a, c, t, g, unknown, or other
  misc_feature (118)..(118): n is a, c, t, g, unknown, or other
  misc_feature (119)..(119): n is a, c, t, g, unknown, or other
  misc_feature (120)..(120): n is a, c, t, g, unknown, or other
  misc_feature (121)..(121): n is a, c, t, g, unknown, or other
  misc_feature (122)..(122): n is a, c, t, g, unknown, or other
  misc_feature (123)..(123): n is a, c, t, g, unknown, or other
  misc_feature (124)..(124): n is a, c, t, g, unknown, or other
  misc_feature (153)..(153): n is a, c, t, g, unknown, or other
  misc_feature (157)..(157): n is a, c, t, g, unknown, or other
  misc_feature (161)..(161): n is a, c, t, g, unknown, or other
  misc_feature (168)..(168): n is a, c, t, g, unknown, or other
  misc_feature (175)..(175): n is a, c, t, g, unknown, or other
  misc_feature (205)..(205): n is a, c, t, g, unknown, or other
nnnnnnnnnnnnnnnnnnnnnnnnnnnnnnnnnnnnnnnnnnnnnnnnnnnnnnnnnnnnngggggggnnnnnnnnnnnnnnnnnnnngnnnnnnnnnnnnnnnnnnnnnnnnnnnnnnnnnnnttaaaagctggggactccccgcggttggncggnccgnctctaanaactagntgggaatcccccgggctgcagggaattcgntgctcacccctaggaaaaaagcaacacagcaagacccgaccttggcctcctcctacagcagcaagcagcataaccagaggggagtgcagcaagccgtttcgagagacagctttaggctactgctagcagtatggcttccgctgcgcgcttcctggccgtggcccgtgggtcgtgggcgtggcgcactccctggcccagcaacaaactggcaacgccggaacgcccactttgggccgaacacggccccgcgggctccctggctggcttgcttgggccattc

SEQ ID NO: 72794 - DNA, 506 bp, Zea mays
  misc_feature: Ceres CLONE 1556659
  misc_feature: Encodes the peptide sequence at SEQ ID NO. 72795
  misc_feature (227)..(227): n is a, c, t, g, unknown, or other
  misc_feature (353)..(353): n is a, c, t, g, unknown, or other
tggagctccaccgcggtgggcggccgctctagaactagtggatcccccgggctgcaggaattcgtctcacccctagaaaaagtccgtgtccgtgtccgagtccgcccccgcaaggcccagctcctcactccacagcgccgcgcaatggcggccaagcagcggcaccggcagctgccactcctgcccctcctcgccgcggccgtcgcgtggtcgctactggcgcgccngccggccgccgcggggcacggggcactgggcacgctcgggcctcggcacagcccgcgaggcacacacagcacgcgcacgggggagggcgcgcgccagcgtgtgccctcccgcactggatggcgtcntccaactgttccaggcaactgggtgtaccaacaacccctgcccaattaccaaacccgcgggggggcccccttccggggaacccgaaatttcacctcgcccaaaaaataagggcccccccccaaaaaaaggttttccctcaaaaggacccgggg

SEQ ID NO: 72795 - protein, 105 aa, Zea mays
  misc_feature: Ceres CLONE 1556659
  misc_feature (28)..(28): Xaa is any aa, unknown, or other
  misc_feature (70)..(70): Xaa is any aa, unknown, or other
MAAKQRHRQLPLLPLLAAAVAWSLLARXPAAAGHGALGTLGPRHSPRGTHSTRTGEGARQRVPSRTGWRXPTVPGNWVYQQPLPNYQTRGGAPFRGTRNFTSPKK

SEQ ID NO: 72796 - DNA, 636 bp, Zea mays
  misc_feature: Ceres CLONE 1556660
  misc_feature: Encodes the peptide sequence at SEQ ID NO. 72797
  misc_feature (184)..(184): n is a, c, t, g, unknown, or other
  misc_feature (257)..(257): n is a, c, t, g, unknown, or other
ctggagctcaccgcggtggcggccgctctagaactagtggatcccccgggctgcaggaattcgtctcacccctagaaaaattcctcgcccgcccagtcctctaaccatcttctccaaacgcccggagatggtctcgctgcgatgcaccaccgcgcaccactccctcctcggctcgccgaactgnctcgcgcgcccgcggcggcggccgtgccccgtcgtgcgcgctgccgtccccgtggaagcccgggctcaagccnaagtctcactcatcccgaatgggaaccgtgggattctcttggtccttggcaaggccctgaaaatcccgaaaaactgaaacccccactctcgattttcctaagaaggggccatttggatccttctcctaaaaacccccgggaaatgttttttggacaaccccttgggaaattgggggcgagggtgtttttccccaaggggaaaaataatcgcctccttcccgggaagagatggattaatctctgcccccctctcaaaaaaagtttcctccaaatttccccgggaggggggaaattgtgctcggttccctccccccgcgaaagaagagggaggaaagagttttttttggtttggctgggcaattttactccgggggggggt

SEQ ID NO: 72797 - protein, 68 aa, Zea mays
  misc_feature: Ceres CLONE 1556660
  misc_feature (19)..(19): Xaa is any aa, unknown, or other
  misc_feature (44)..(44): Xaa is any aa, unknown, or other
MVSLRCTTAHHSLLGSPNXLARPRRRPCPVVRAAVPVEARAQAXVSLIPNGNRGILLVLGKALKIPKN

SEQ ID NO: 72798 - DNA, 675 bp, Zea mays
  misc_feature: Ceres CLONE 1556665
  misc_feature: Pfam Name: MARCKS Pfam Description: MARCKS family
  misc_feature: SWISSPROT Homolog: EC 3.2.1.18 Exo-alpha-sialidase
aaagctggagctccccgcggtggcggccgctctagaactagtggatcccccgggctgcaggaattcgtctcacccctagaaaaaactgctcgagctcagctcaagtaaccacagaaaatggcgtcacttctccgccctctcgtcctcgtgctcctgatcgcctcctgcacagcgcagcagtcaccgccggcgcagcccccgccaacgccgaacgcgccaccggccaactcgccgccccaggcgcctccagccggcaacccgccgccggcaggcaacccgccacccgcgcccaccgccactccacctccggccccgaccactccgcccccggccccgaccactcctcccccggctcccacaacgccgcccccggcgccgacaactccacctccggcccccaccacgccgcctccgtccccaccagcgtcgccaccgcccgctcccaccactccgccaccgtctcccccggcaagcccgccgcccgctcccgccaccccgccaccgtctccgcccatggcgccacctcccgccacgccccctccacccgccaccccgccgccaccggccgcgcccacgccggccccgagcgtggccccgactcccccgcccgtggcgacaccggctgcgtcccccaagagccccaagacgccgagccccgccgccgcgacgtccccg

SEQ ID NO: 72799 - DNA, 688 bp, Zea mays
  misc_feature: Ceres CLONE 1556670
  misc_feature: Translation starting site: 271
  misc_feature (46)..(46): n is a, c, t, g, unknown, or other
  misc_feature (79)..(79): n is a, c, t, g, unknown, or other
  misc_feature (283)..(283): n is a, c, t, g, unknown, or other
  misc_feature (392)..(392): n is a, c, t, g, unknown, or other
  misc_feature (393)..(393): n is a, c, t, g, unknown, or other
  misc_feature (394)..(394): n is a, c, t, g, unknown, or other
  misc_feature (395)..(395): n is a, c, t, g, unknown, or other
  misc_feature (398)..(398): n is a, c, t, g, unknown, or other
  misc_feature (402)..(402): n is a, c, t, g, unknown, or other
  misc_feature (403)..(403): n is a, c, t, g, unknown, or other
  misc_feature (404)..(404): n is a, c, t, g, unknown, or other
  misc_feature (406)..(406): n is a, c, t, g, unknown, or other
  misc_feature (407)..(407): n is a, c, t, g, unknown, or other
  misc_feature (424)..(424): n is a, c, t, g, unknown, or other
  misc_feature (425)..(425): n is a, c, t, g, unknown, or other
  misc_feature (470)..(470): n is a, c, t, g, unknown, or other
  misc_feature (480)..(480): n is a, c, t, g, unknown, or other
  misc_feature (483)..(483): n is a, c, t, g, unknown, or other
  misc_feature (492)..(492): n is a, c, t, g, unknown, or other
  misc_feature (512)..(512): n is a, c, t, g, unknown, or other
  misc_feature (515)..(515): n is a, c, t, g, unknown, or other
  misc_feature (516)..(516): n is a, c, t, g, unknown, or other
  misc_feature (559)..(559): n is a, c, t, g, unknown, or other
  misc_feature (585)..(585): n is a, c, t, g, unknown, or other
  misc_feature (614)..(614): n is a, c, t, g, unknown, or other
  misc_feature (649)..(649): n is a, c, t, g, unknown, or other
aagctggagctccccgcggtggcggccgctctagaactagtggatnccccggggctgcaggattcgtctcacccctagnaaagtaaccttccgggctcctcttcctctcctcgcgttcccccaccaaaccctaatccgagcacccagcgtcccagcccctacccgcttcctctcgcgccggcctttggggctctcaccctgagcggtaggaatccgcagggctccagttgggtgccagaagcatccaagtcgttggcgggagaccgggaaatggcggaaaaanagggggcgaaggttggggcggaagagatggaagagcgggagcaggaaggggaggcggaggatgtggacgttaattttcttctccccccccggtgggagggggggggggnnnnctncaannncnnctccaatatcttttacnnttataaaagaataaaatcctcccccaatgggccaaaaattaaacnatttttcccnaangcctgcttntggttttaaaaccacttaanttnnaagccaaaattccttaaaaattgacaaaattggtcgcccaagngcccaaaccctccctttgcgcggacnttcccaggggggggcgttccagagagcgnggtttgttggttccacccatcatacagccgagatnggaacccgcattaagaagggggaaacaaatatgccccag

SEQ ID NO: 72800 - DNA, 649 bp, Zea mays
  misc_feature: Ceres CLONE 1556672
  misc_feature: Encodes the peptide sequence at SEQ ID NO. 72801
  misc_feature (405)..(405): n is a, c, t, g, unknown, or other
  misc_feature (406)..(406): n is a, c, t, g, unknown, or other
  misc_feature (514)..(514): n is a, c, t, g, unknown, or other
  misc_feature (544)..(544): n is a, c, t, g, unknown, or other
  misc_feature (554)..(554): n is a, c, t, g, unknown, or other
tggagctccccgcggtggcggccgctctagaactagtggatcccccgggctgcaggaattcgtctcacccctagaaaaagcccccgaggaaggaaccctagcctagccttgctccgaccggtcgccgcggcgactgcgacgatgatggactgcgctggaggccgagaccccgtggaggacttcctcctcggcggcgccggcgccggcgacgacggagatctcgtcgccgtcttctgcgacgacggaggacttgggattgagggtatccatggagatgcttgtggatttgagcaatctaatttggggaaaaggggtagagatgaaccatgttcatctggcccaacatccaaagcttgccgtgaaaaaatgaggagggacaagctgaatgacaggttcctggaattnnagttcattatgaatcctggtaaggaagcaaagttagataaagcaaatatattgagtgatgcagccccgtatggtgggcacacttagaggtgaggcagaaaagctaaanggaatcaatgagaagttgcgggagatatcnaggatctganggaggagagagaccagcttcgtgaagagaaatgagactaaaggtagaaaaagataggctggaaccgccagtcaaagctttgaaggtagctcctac

SEQ ID NO: 72801 - protein, 116 aa, Zea mays
  misc_feature: Ceres CLONE 1556672
  misc_feature (88)..(88): Xaa is any aa, unknown, or other
  misc_feature (89)..(89): Xaa is any aa, unknown, or other
MMDCAGGRDPVEDFLLGGAGAGDDGDLVAVFCDDGGLGIEGIHGDACGFEQSNLGKRGRDEPCSSGPTSKACREKMRRDKLNDRFLEXXFIMNPGKEAKLDKANILSDAAPYGGHT

SEQ ID NO: 72802 - DNA, 654 bp, Zea mays
  misc_feature: Ceres CLONE 1556681
  misc_feature: Encodes the peptide sequence at SEQ ID NO. 72803
  misc_feature (572)..(572): n is a, c, t, g, unknown, or other
  misc_feature (634)..(634): n is a, c, t, g, unknown, or other
ggagctccccgcggtggcggccgctctagaactagtggatcccccgggctgcaggaattcgtctcacccctagaaaaagcagcaaaatctcaccaagtctgtcgctttggaaaccgttggtgacaccataaccactcctgttcgtcgtgcacccacgcgggcgaacagtgaaaggcatcgtctcgacgtctcgtgaccgctggactcgccgccgccccaggctagctcgatgattgggtgcgccaagccgctcgcggcgccgctgcaggcatgggctcgcccgccgtctcccgccggtcgccgcctccccccctcgttctgcgcccctgacacctccccagctctcacccgcgccgtcgagagcccaggccagtctcagtctgacgacgccccgccaccacgctcgggtgaggccgcctcgtccctggcgccgcgcgcgagctcgcatctcgaccgatggtcccggtcgcgggcgctgcggtcgggccaccggccggcgctgaaccgcgcggctctctcctcggcctcggtctcggcgccgccggtgatcaagtcgccgcggcccgagcacnctgccgtggcggtggaagatggcgaagacgacgacgtgtgcgaggccgagagggacgccgcngccggggaaggcatctacat

SEQ ID NO: 72803 - protein, 141 aa, Zea mays
  misc_feature: Ceres CLONE 1556681
  misc_feature (115)..(115): Xaa is any aa, unknown, or other
MIGCAKPLAAPLQAWARPPSPAGRRLPPSFCAPDTSPALTRAVESPGQSQSDDAPPPRSGEAASSLAPRASSHLDRWSRSRALRSGHRPALNRAALSSASVSAPPVIKSPRPEHXAVAVEDGEDDDVCEAERDAAAGEGIY
